United States Patent 9,567,581 (SELECTIVE REACTIVATION OF GENES ON THE INACTIVE X CHROMOSOME) - sequence listing, part 6

SEQ ID NO: 680 - DNA, 55908 bp, mus musculus
tcgggttaggctgcaggatctgttgctgctggcgcctgggagtttgctgcttctccgcccgagtccgggtccgcccccttctcttggacctgcctctcgccccgcctccgccctcactttgtagacgggacagcgagcgagttcagccacggaggtaagagcaggactttaacgtttgtcccgcaggcttttcgcggcgagctttcccgcgccgccccccacccttaccaggtcgccaattccgggtctgagaactcagtaccttcagcgggtccggagcggagcagtggacgcggaagggtaggactcacgggcggggatgggaaagctttggtctcggcgatgctccgactcttcacgccccctcccgtgacagaaacacgtgttgtgccgactctgtccctgctaggcactggttccaccggagcctgtaccttggaggtcgcggagccctgggcgcttgcggtgggattgcgctttttattccgtatgggggaaagcctgtccctccgggaggctgggggaaaaagcgggtcgttccgggaggccgtggggaagagcaggtccgtccgggaggccggggagaaagcgtggccgtctcggagcccagggtggggggtgggggaaagcgggtccgtccgggagcccgggggagagcgggtccgtccgggagcccgggggagagcgggtccgtccgggagcccgggggagagcgggtccgtccgggagcccgggggagagcgggtccgtccgggagcccgggggagagcgggtccgtccgggagcccgggggagagcgggtccgtccgggagcccgggggagagcgggtccgtccgggagcccgggggagagcgggtccgtccgggagcccgggggagagcgggtccgtccgggagcccgggagagagcgggtccgtagtccgtcccggagcccataggagagcgggtccggggtccgtctggtagccccgggggagagagtgggtctatccaggagcccgcgggggaaagcggctccgtccgggacctcggggagagccggtccagggttcgttccggagcccggcggggaaagcgggtccgtccgggcccccggaggaaagcagttccggggtccgtcccggagcccggggagaaagcgggtccgtccgggaccccagcggaaagcgggtctggggtccgtccgggagcctgggggaaaaccgggtcggtccgggagcccggggagagtaggtccggggtccgatccggagcccggggggaaagcgggtccgtccgggaccccgggcggaaaacgggtccggggtccgacccggagcccggggtgggaagcgggttcgtccaggagcctggggagagcagatcctggatcagtcccggagtccggggggaaagcgggtccgtctcggagcccgaggggagagcgggtccgtctgggaggccaaggcgaaagcgggtccatacgggaacccggaggtgggggaaaagggtccgtccggaaggcccggggtgggggatggggcggagagcaggtccgtcccagagtccgggaaaaagcctgtccgtctgtcccggagccccggggaaagcagagggatcagccggtaagatgctcctgcggaggaggccaccgtgcttcctaagtcccaggaaagtctttgggcagagtgcccagatttctcctgctccagagtagggaagtctaggtgtgcgtacccttagtcgctgatagggaagtatcttcatgttagaggagtttcccacgaattgcttgatttgcaaaggagaaaggtagggaaaaaaatggtgtaaaattaacttggctatctgataccaggtgtaagctaggagacataggatggttttaataatatttttttgttacccagggagtggaattcgattacgaaggtcctgaactactgcccttgtctcgggtactgtgcttttcacaacttcacggcatatggcaaaggggaagtgataatgaagttttagtaatttattattctgcttgctattatgcaagataaacaaaaatatgggagtagggtacttaaattattgatttttagccaaataagcaatgccataattccctttattactgtgggtgatcacagattaaataccttccattttgttaagtctctagatgcttttacagagtgttatatatattttggtattccagttggtttccttgtttggtctttgttgtgcccctttctccattaattccatatctgtaatattcagccaccgttttggaagtcttttgacactgagtcatagaaggaaatacattttaagaactgggtataagggattatatctgtactgctgagagcactagactgaagcaggaggatcacaagttcaaggccagcctggaataagtagcaagccgctttctttaaaaaaaaaaaaaaaaaacacctttatattgtgtctgtagttcacagatagacaatataattgacatatttgtaaaaatcattattatgtgcaagtacaatctaacactttatattttaaagatagagaccatgatatattaataaatcatattgcattgtgaaaaacactggccttacaccactgggtttcagacgtttgtctgcctttactgaaattatcagacgtgcagattgttcaggaatactctggaaataggttctgtgtgtttgcagcacagtggcagatataaaggtattccgtccctcttcccacttggaaaagtaaaggctatttattttagggatctactgggactcttcaagatggagtccagtgccctgtcgtgttttccagaaggttgaagatagagaaaatggtggctctcagatctaagataaacctcccaggacttgcagacagacacttggaggttgcgaaacatgttacttgagccgctcagtgactttcctggattcctgatgtcaccgagtgcttctcagagaataggacccctttgactcacttggttaagtccaacagtctcctctagcctgctagatatacgtaaccaccttaaaacgcggttaaataattgattataccaacattcaaagaaattaaagatgaaaatttctcctatccctgtatcataattcttattccccacatttattcacgtaactccagattttatacaggagtttgagccttgtttacaagtttggtgattgcttgcttgtttaatattgtcctgggggaattttttttagtgtgattaatattctttaaattttgccttaaaaacctaacaatattctaatcagtgatttggttttaacttatttagcctaaccaagccagcaacagaatttcgaggaggttttttgttttttgttttttgttttgtgtgtgtgtgttacaaagtaatagtataaaatcttgattatttatacaacttgatccttccattctgttggacttaagaagaagccaacaaggaaggacagaggtctggacttgcatgggagtgtctgtcccccttggacatttgaatttggccatctagtttattatgctcaagcagcagtgattagctatggtgtctttttttttttatagaagagttaggatgcattttaaaaaaccaaatagacattttcaaaatgatttttaaaatatatgaatcatagaagtctcaaggagactcaagtgccttaataacactcacagtgattagctttctttatgaatatcttcttcaaagattacatgtctattaatttttaatttaattttttaccaagtagccaattaagttgactacaagaaaggctataattgatcttagagcacaccttcctcttcagaacacacagagtgtatttttttgtccctctatattctagaacattaagtaatccctcttataaaattatgagatacttcaaacagcaaaaatagtcaatgctatcccatcacccaggtacacccactgtagatttaatagttgctaaagtttggctatacatttctttagatgatttttttttgtatttgattgacaccaagggataacatgttttcaaggagaccaaaaggcctcaggtaccctgaaactggagttacagtgagctttctaatttggatgttggtatccaaacttagggcatctttaagagcagcacaaacttttaactatcaagccatctctccagtcccaaaatgcatttttttgtttaattttatcctttgggaattttgtgcactgtattttgatcaaacctatcaccctccaactccaaccatttttttaaaaaaaaaaacaagcctcaagtttattttaatttcctatttattaatggtgtgatgatggataaaagtacctatataatgttagagatggctggagagatggcttagtggataaaagaactgactgctcttccgggggatccaggttctatatctagcacccacaggatgcacaggattgtgcacagtcttttctaattctagttccagggtatttgaccctctgttctggactccatgaggactacacacatatagtgcatagccacacaatatacataaagtaaacaaaaaattggatgtggtggcacatgcgtgttacctcagcacttgggaggtattaggcataagaacttcacctttatcattggatgtctagttgaagggtagccttggggacataaaactctgtatttttttaaaaatgagtgtggtgtctagagaatgcctcaggagttaagagcactggctgctcttgcagagaaccagagttcaagtcgcagcatctagtgtaatagctcacaactatctgtaactccagtcccaggggatcagatgcactctttttgcctccacagggtccaggcacacaagtggtacagacatacaggcaggcaaaatcatccatatacatattcttttttactttaagaaattctgttaacctgatctatttgtttttgtcagatgtaagatgatattttttaaatgttaatatttttaaaaagctagatgctttcccatttttctttctctttccctttcttcctccctggtctgttcttattctcctactctctaccttcatttcattcttcctttttttttttttaactttttctatgtctccaaacttttgggaccaattttctaaatgtagacatctttgaagcactcttgctttagtgtgttttatcatttgatttatttaccagttttgttaaatattttattctattcacctcttcccaactttttcataattcctcctctttcatatgctctacacactcccttcaatccttttatcccttttcagtgcacccctgggtcttcctgctctgcaaagtctctcttgggttcctccctcatctaagacctccctcatttgagttttgcccaccttaccttaatatgtactaccttgttctttccttttctagtattctaactactagagtcatttacacacacacacacacacacacacacacacacacacatacacacacacacacgagatctgccacataacaatttacaagcttttcctatatcacacattttgtccctgtttgttttcaatgtgcagatggaccttacacatacttagaagcagtgtgacactgagacacaccactagcatcatcacacttgtaattttgaacaagtgttctttgaggtttaaaaaatgattgttattgttttaggtagcatacaaattatgttttcattgtgacattttccatgaccatcctattataatttgttcaaactacacatgccctttaacctctcttctcctactacccctcccccaagctccctctcacctcctgaagagtcctgcttttgtcttggtctttagggttttggtttgcttttgtttttgttttccgttttctacttcttgaaattcagttctgatctcggagctttcagacactctagtacaaatgagtgcaaatgtattttgtgagcaagagatcataagaaccttctgctccatcagatatttaatatgaactcggaactggcacactattttcagaagcctctattttactttgacatggagtaaaatgacaactctatacatgtgattcttccccatttccttcgagatgtgtgtacaaattccacctttctccagctgttgcttaccagtgacaggtttaaaataaactctcagtaactagaatagtcagagtcgtcatccattagtagtaaataaagttttcagtatgctttgagaattaggtttgctgactttcgtcttcagtgttttttctataaggctttacattagtagaatcagagctttcttctacaaatctgtcctcttttgcctttcccgcctttctaatgaatggtatgctaaaaaatcatacactgcatcagacgtggctattcatagaaacggctttattacttgatagtcacattttgtgcattttctggccagaccctttcatcatgatgttcccaaggaggaaaagtgtattcatggaactcgaaggttgtcaagtaactaggcattttagagaaaatgctatctccaaggaaaatagcttatttgcttctaagaaggtgggaacaatttttaataaattatatgactgagtttctatggtggttacctctcaacagttatcatcaaagaaatgtagggaaataatggtacaaataattcgaaacaaaatgtttatacctggagagacaaaagcccttacacattggtgccaaaatgacttctaataggtacccaggctagaattcatctttcttccatttgaggcacacatttatcttcctaatgttatatgctcaagttattatcaaaatacaattattatggccatttccttcacttgatagttgcttccctttgggggaagcactgtgtgcagtgttacagtgtctgagtttcctcggctacagaatggggattggaattcccttctaggagttattaaggcgagggaatgggttacattttcccttttacaattagtgtctgtttataggagactcaggagtttgagtgacagactgttgttttctggagtgtcttaccatcatttattgatcctagatctgggtcctactacccaaaatgttcctaaggtcaatagatgacaattggtaagctacagtgaagttagtttgcatgctgataaataagatgatttttataattgaaattcaatttatgttcaatttcttgcccaactgaaagtggtctataatgaccctggatttgctgatccttcactgacaacatcaggataacccggtattagtctttggaaagctttcacatcgcacttcacattaaattgaattagataaggtaatgtatgcagtctttagtgaaatgaggagagagatgcccccatacatttggggtccagcagagtctggcaggtattcactctcagtgaagctgtttcatttccctccagaaagttagctaatttaagaagccttatttagattgtatagccaggccgagaacatctgcctgtttccaatagcccccgaagtgagccgtgatgagttctccaggcatagttggtttctgcagaaggcgtttaccattactttgaatgtgtgtgcttctgttgagtgagtcatccgagataaaattgtaaactgggctcaacaggcaaagctgtaatttacttaaagttgctaggcccagtgggcacagaaggggagagccgagcagcatggaaaaggtaactcaaggagacagacaggttttcccactgatggccagagataaagagcacaggcctggtttttcccttttaaagagaatactgacctgcacagggacagcatttatcaaaatgaggtaggacctttggattgtcttcgggctttgctagaaaaccataaatggaactatttcccattaaaagaatttaggagaactgaaataaagtaatataattagaatatataacttctaaacccggaaaaactaatcaagtaaagaaaatcctaccaacccaaatatgcagaaaggataaaaggtacataagtcttagcaaacaagaaacagaaagtaatattgaagaaaaagctcacttgtgtcagtcccattaaatgtaaagtggttattatattcactcattaagagatagtcatgatgtattttaatattaatttttataattaaaaagaatcatacaatgtaattatatcatttctcccttttcatgaaaatcgtgcctgttagacaactaagtagggctagttaagtttggatcttcgaggagaatctcctactatttatttaaccagcacagtccctaactccattctaaatactttgaaataaattaactatgacctttacaaaaatcttaaaatgacacctaaaagtgatgagttggaataagatgtactagacaaatatcaaccaaaaaaaatagtaaggcaacacgaagatcagataacatatgatttaatggaatttagcaagatacagatacttcatattgatgaaagaggaaaattgttaccaagagactaataggcacaggttccaatgtaggtcctcaacagtataggtcttacaaacataaatgaaacaaaacacaatggaattatagagagactggacaaatcctagtaatgaaggtagccctgaaaaatatccttatccgaaagtagttgagtaaagtcagtttcaaagtaatcattaagatctatatcaggtgaaagggagataatctttggttcacgatttctagtgacaaaagtcaattttcaacccccaaagtaatgatttggagacgatttatatcccaaatttctcaattagaaacaatttgaaggtaaatgctataatttaataaaatcacatttcacttacttaaaaaacaacaggaagtctgtggttgcaaggccatctttttatggctactcaagcactgtcttgtcctttgcagtgtgtattgcagctactaacggcagcacctaaatctgaaagtgttcatttgtactccaaaagtcagtcacagtggttcataccctagatcccaacactcaggaggccgagatagaaggattaccattgaattcaagggcagcccgggctgcagagtgagaccttgtcacaaaatatgtccaaattccgctacaggatcaacgtcacgatgaacaatgatggatttttctatcagcttttgtaattttatcatagatagctgtatttcacaacggtaaaagggcatctataaatataaaagcatataattacatgctataaaaatctaatataatttatagcagcctagcacttgagccccaggagagaagtacatttggggatataaaattaaatacagcaccaagtgctcttattctgctcattgtacctccttctcggagactgattgattccacatggaatcaccaaatggagatccattttaaaagtcagaacaagtatagatgactttaaaataagcatccggtaactagccccttcaacgtggttctttagagctattctcttcctctaaaacccatgctagtaatattcaattttaagaagtatatactgcttcatattttaacctcagaaatggaaatgagttgagcctgtctgctgtccaggtggtagtcttgataacctaaccctccttgtgcacacaggcaatgtgaaaatctctaggatcaacgttggcatggtaggcagctggggtgaaaagctccgagatgctggggatggcttattgactcctaggaagcagcgattgtggggagtggagcatatgttgaacagattaattatcagtatcataaaatggggggggggcaaaggaatgctagtttatatttgcaaagttgactaaagagtgcagcaaagtgatttccagacctttaaaaaaaatgctgcttcgtgatgaagaaactcttttgagaagtcacaatacatataagttactcaattttatggagtttgattaatatttcattctatatggaagctttggttttaagtgggggcactaggtggggttttgcctcagttttgatggctagatgatcatctatatttttcggctcaactggtctacgtactcatcttattcagatcaatggtctgacctcacctgctactggtaagaatatttatttttaatctgttatcaaaaatgaaagaataacagcaacagggacctaacactgaaaccttagctttgatatttgaacaaaataactccattctctagattaaagaatagttttgtaatattttaaatgcaatgtctattttgttcacctttccattcatttttttgatgattgcctctctttttggaaaaatgtaaaataatttaaacagcatactgtgtagatgtataattattattatggaaaatactatgagggtatatgtatgtgtctgtgtgcgtgtacacatgcatgaatggcttttgtagccaaggacttttaaaaatctgtctaaagtcttttgtatacactttgcttttagtaacaacaatgcataataaaaacacgtgaagttctgtaaagaaggagtaggaggagaaacggcacatcagtcaggcatggtggtccacatttttaatcccaatattatggagccaggggaggaggattttaagttcaaagccagcctgggctacatagtgacagcctatttcacgatgtgatgagaaatgagagaagaaaggaggaaagagggagagacaaagaagactggagggacatagagaggggaaggacgagaagagagaatatacataaattaatattttcaacagtgctgcttgtgacagtaccaggagatttgagatgaaagtaggattattattattatcatctatgtggtttcataagctttttggctttacctttcttttccctcattttctttcctctccttttcctctccctctcccactttccttattctctccctcctcctctttcttctcttctgctctttggaagcaaggtctcactatgtagaccaggctggtgttgaacttaggataatcctgactctaacaccagatttctgggactacaggcatgtgctaccatgcctgaatttttatttagtgactatgtgtttgattaaaaaaaattgaaaagagctttttgaaaaagtacaaaagttaactaactaaaagtatgacgggttggtgtttggcttttttttttctttctttctttttatccttcctcagtggcatgtaaaataatgggactcttagtttcaatggagtatttttaagcctgattacttacttaaaactgccttttatagctattgtataaaagcagatttttaggcacaccccactcttactcgactgagataagattataaacacacaatgaccttcccctagcacttgaagatgctttatgtattgtctttcaatatttattcttgataatgaaacacctcgtgtcagtctggctgttgctgaagtagataagtcacttttctattaagtttcagagtgtacttaattttctagcatctcaggatatcatgtatgaatgtgtgtgtgtgtgtgactgtatgtgaaagtgtgtgtgttggaagaaagttgcttgctcatacttagctgccatttgaatctgaagaatcgcttttctttacttctacttgacacgtatattaatgccatgaatattgtcttagccattctgttttattccttctatatttcctgtgtgaccccttgacataagtgtgtgtagcccttttcccgatcttttcatttctctctcatttcctatcaccctgtagtctgacagtcttttgctatttttcttgtccagctcagtgacttcatcttctcttcagccatgtgtagttattatttaaatctatcttttgaaatgtttttactgctggggatcaagcctagggtgttgtgcaatgttaggctagatctcttgagcaaacagtctagcgtccatttcttgaatgccttccgtgtttttttcacattccttccttctatggacactctcttactcgggctctttgtatgtaatcaacacatttttatactttcttctgattactgtattgtctcacttccattggaagagcgttctctcattttacggccgaaagactgttaacttgggtgtcctgtgacttgactttatattcattagtctttggggcctttaaaaacatgtcatttaggaagtgaggaccttgctgctgagtgagagcaggagcaaattgcccgggaccctgaatgtttctttctgtgtctgtctctggttctctgtctctctgtgtgtctctttctgtgtctcaatcaagaggaggtgattccattttggattccatccaaaacactcactatgaagtctcattgtggcctgtaattctttttcccagtcactcttctactcctcttagggtctggagtcagtagcaggtttaatttaggaggagctgctctaccctccaagtagttccacttgcagctccgcaggggcaccattcctcccttcacctacagggtggctttcctttttactacagctggttctcatttcgagatactgtcccagccattttccaccatcctgtacccagctacatagacagcaggattgtgccacgagcactctcatgccctgccttagtagtaactgcatgtccttcgggtgagaacaaaacagcttgcggttcttgtcatggctgtgtccggttcatctttagaaagcaagtgtaaggttagagagtagacggagggacatttgaaattgtgccactcgctcccaagacagtcttagaaagtgacattctctcacataggaggcatggaatgctttgacttctgtgctgcaggacccctggatttattgtgagccaaagaagtgttctgagttttaagcatagatcttgctgcaatgaagctacttacgcgccatctctctaaagagaaagccttatcgtcattataatgaccctgtttgtgcagatcttccctcttgaatttcagaattaatgccttttttttttttttttgaggcagcatctcttgttgtgtctctggctggcctgggactgtactaattcatttgcctcaggctttttgaaggcatgagcctctctgcctgaatgagtttgggggagacactcatttagtgtcttctaggcaaatgtggttggatttatatcgcttagtagttacctgatgcctgctggaagctggggtatgttccctgcaattctccttgatcctgttatagtaaagtcaccttttcttaggactactggaaatgcaggagcattttgtcataggtcatgaaatactatacacaagaaattctatcaaggggatgcttcttgtgatctgtgattttctttctaaaactaaaacttgctttttaaaaataaacttcaagctgggcagtggtggcatacacctttaatcccagcacttaggaggcagaggcaggcggatttctgagttcgaggcccagcctggtctacaaagtgagttccaggacagccagggctatacagagaaaccctgtctcgaaaaaccaaagtaataataataataataataataataataataataataataataataataaataaaccagaaagtttatgtgtaaggcttatgatctgccaaaattaacattttatgaattactttttttttagatagggtcttgttatatagcccttgttaagctgacttgaaactcaccgtataagctaggttgcctcctgaatgttggaattgcaggcatatgtcaacacaccctgcttctaaagtactcatgaaaacactgtagtatattcttcccaaaatactatgtctagtactggcatcttacatatgtacatgagatgtcattttgtaaatacctccttctgtcactgcaaggatatcttcctcagtttgcctttttatagaggcatctacttttttcctgctccaactcactaagtctaataatcaccaacctgttctatattaatgattgtcatttcaaaatggttatggttttaaatctttggcagtatacaaaattatatacattaagctacatagtatatcatccttcgggagtaacttattttacttattagaataattccctgtttgttctgtacatcaaatctttggttctttatcttgtttttttgtttttgttttttgctgcatactattccatcatgggaatgcattgcaatttaactatttgctcgttgctacacagtagttgagactgggtaacttacagtgaatgctttccgactgcggccctgtatctgacaaagactttcatgctgtgacatcccagagcaaaagtcacagtactggacatgagacagatagaagagcatcaagctcattttgtcttaatggacactttcttagaaaatatagcattaagccagtcataaggacaaatgtaatgatatagtgaaggggccaacacttggtttgtatcaggagcattcaaatggtaaaatccctcttttgctattacaaataaagcttttatgaatactttagtacatttttcaaacataaaccttcatttctctgggacaaatgcccagcaatgtaattgctgggtcatatggttttataagaaactgccaaacgatttcaggttggccgtgccattttgcatactcaccaacaatatgtgcgggatccagtctctctgcatcctcactatcatttggtgttatctttctttttaaattttattcccttgcagataatgataccagattgtgcctttaatttgcaatttccctgatggctaatgatgttgaatatcttttccaatgctaatgtctcatctatatatcttgtctatggatgccttccttcagccagaaaacaaaacaacaacaaaaaaaaacaatgtattgttacatggatacttttatataggagcttggctgttagcataatgtgattttacaagacggaagtgctgctgttcaatgggatttttaatttttattatttacttgtttgtttgcttgcttatgtgtgcacatgcacatacactgcgtgcatctgtgagtgtgtgcatgtaggtgtgtgatatgcgtatgcacacgcttgtctgtgacagtctacgtgtggtccagtgtgtatagaagtcacagtacaacttcaagtgtgtttccttccaccctgcttagaggcaatgctgcatatgctatttctagctggcctgcaagcttctgatcaattctccctgtgcagtctcacttaggagtactacaattacagagactcaccatgcggttgtctcttacttggtgtctggagatggacattcaggtcattaggcctatgaaatgtaaccagcactgggacccactgaggtggccccttctgctttagattttattgatgtattttaacaaatcagaactttatagcactggttttcttttcctgtcccttttgtgtttaatgtcattgatttctgccctgtgttttcttctgcttgccttgggtttgttttgacatttcttgacttggaaacgtatactattgattatgcttttctttcttttaatgtccacattttacaccgcaaatttgtctgccaggtagctttgttttccctgaattttcatagggtgtattttaattttcattcaattcagcacatttttaaatttcttcctcccggaaccaccaattatttaaaatgtgcttggtttccaagtgtttgggaaatttcgttatctttttgttattgattactttcagttttaagttttattggtttttttagaattagcatgcaaagtactgagtttcattatagcgttttccaaacatactttgttcttgttaatcctcctcttaccctgtcctctcctgccctcctgcccctcctgaaggtccacttcctcctcccaaaggccccctctctgctttcctgctatatctgttcctctaacctcttcctccccaataagatctctttttatggtttcctttctagtttcctgacctatatgcctagtttgactggattgccgttggacaactctctctctgtctctctctgtctctctctctatgtctctgtctctgtctctctgtctctgtctctgtctctctctctctctctctctctctgtgtgtgtgtgtgtgtgtgtgtgttgttttcaccttgacaattgaaaagaatgtgtaccattttggggcaaagttttttgtttttgtttttgttttttctttgctttgttttgttttacaaacatcacttgcaaattggtggttaatgattttttttttaattcttttgtatctttgctaacactctgactagttctatgatttggtaagagggaggtgctgaaatctgcacgtagatagacattttctcctgctgccttttccatgtctaccttttgtgttttgaagctccattattcggtgcattgacagaactgctagatgccacacaggattgacccttaattattgtgtaaccttccattctttctctggtaatttcatttaatctgaagtctacttatctaataataataaactgaatctttctgtctgttgattaatgtagcatgggacacatcttttcatctctttattcttagcctgccattgtaattgtttttgaaatgaatttcttatacactatagacatggtccttcatggcttttaaatccctctatcgggctcccttttgattggtatacacagatcacttaacatgttctgtaattattgttctagtagggttgaaatctgacatttccattttttttattatttgcttttgaagtaggaccttgatttgtaggccaggctgaagtggaattcataattctgcttccgtgctaggatgaaagctgtgtgctaccgtacctgcctcgtcgtcgtttctttctttttcttttattttgttctctgtgattttgttttatattcatttttctttcctttcctttcttttctttctttctttttttaaaaaatagtctcatgtatccaaggctggccttgagttcgtgatgtggctgagcctgaccttgaacgcttgatcttcctgcctccatctcccaagtgctgggatcacagatgtgtgccagcacactttcttttttcatttgttctgctttccatgtctgttttttcccaccccctccctttcccatttactagtttgggtgttttaaaaattgatttttgctttcctatattacttttgttttaaacatgaaacaaaacatgaattatcagcttatctgaaaatgacagcatctttaggcagttgcttccccccctttatttacttattcactttacatcccaattgcagcagcccttgcttcagtcatctcctctaagtcccaccctcacacctccttccccccactgcctcttccccttctcctctgagaaggaaagtcccacatgggtaccaaccctcctggcttagcttgtactttgacaatttcatacctctatcacttctgattatgttctccctagcctttcttatctccttcctgttacaaccaacccttcctcccagctaccagtctccttttcagattcatggcttttaatttggtctgtgatccatttgctttcatcaggattatctgtgtgggattagaactgttaactggaacctgctggggttaccagtgggtacacaactaaagacggtgactatcccctccgtccctggatctcccagggacagatagctgtgcagtaagggttaaggtctcttgagtgcctcctccatccttcctgacatgtcatgggtccattcttgtgtagatccagtgcacagatccacacctgttgggcactcctgattgcaatggctgtgtcttgcatagaagatagcatttagcaacattttctctgttttctggtgttcttactcttttttttttttaattctgtctctacttctgagctttactatctggtttcaggctgagcattcatctgtcacttagtctgcataccttgtgcagctatgatgaagctttgttcattttgtttctggtgaactgatgctcaccagaaagagaggcttggctaaggctgagagaaaggtttgtctatgagtataaacagatatttagaaggcagtgtgatgctatgtcaatttagctaaacaacagtatcccctcccctagggactgttatccccctaagctacgagggttgaccacatttttcatttgatgcagaggctttttaaaataatatatatatttaaaagaattttgtccacatatacaatgtattttgaggatagccacttaccatttctcccctccacatttccctggaccccgccaacaggaccccttctcaactctctctctctctttctctctctctctctctctctctctctctctctctcttttatgtctgggtgacctcgttcagtataacttatccagtactatccatttctctgtaagtttcatacttttaatatttttatatctaactcatattccatcgtgtatactgcattttccttatccatttgtcagttgatgtggtactttgaatgaaaatggcccccatattctcatagagagcagcactattaggaggtgtggccttgtgggaggaagtgtgtcactggggcccagttttaaggcttcagatgctcaagccaggcccaggatcattctctctttttgctgcctgctgatggagatatagagctcttggcttcttctacagcaccatatctgcctgcatgccaccatgattcccaccatgacaatagactaaaccttagaattgaaagccagccccaattaaatgtcttcatttataagagttgccatggttgtggtgtgtcttcacagcaatagaaaccttaaccaagacaatggatatctatattcagtttcctatcttgtgaatagagcagcagtaaacatggatgtggaagtagcgctgtagtaggacataaagtccttggagtggcatgtattgagtagagctcgtttaacgtccttccttgacaaaatataatcagatgcaaaatatcaatagtgccaagtgaagaaatcctatttatgattaaggaaaagaaggttttgtttcttaaacccctttctattctagagtaagattcatttaacttaaaactaagtcatattaaatggtatttgcttccttagctatcttcgggtatgtgatttaaggacaggcactgaaattatgccagtattggagataaatgatcaggattttaaaaatatgggcataaatcaagtagaaaattaattagagctagtgagggggtttcagtaatacagccatttacaaaataaataatataaaaaatcaatagtttcactatgtttaggcagtagttgttgggaaatacagcccattaacaattcaaccaaaattacaaaatatctaggaataaacttttgaaaatatgcatgccttagatggaaaaaaacccacacatttttactgaaacctataaaagatacattgactaatgaacaggaccagtgtattcagagactcagtaatatcaaaacaaaatttacgttcaaattaatctgtaaatctaatgcaattctggttgaaccatggttttcctttggggggaaggtaaggaacaaagaacttggaaggattctaaaattcaagtggaggaataaatgcatgtgacgggccatccctgatgggttaggcgggtaaggatgggatgctttgggaaaacgattatcaaaatgcatacgttaatgctgttcctctaagtttaacatgttatgtaatgtaaaaataaataatttgagggctataatcagtgagattctatcctataactggcccaggaagtaataatcagtgaaatattttaaggcagagaaacaaacccgtgcgtacaaagctgacatttcaaatccgtaaggggggaggctaaaataatgaataaatgaattgtaatagctgggtaactgttgtttgcctaaaatattaatcataagaaatattgcatgaattacaggtggaaaataggatgtataaatattttaaaggcgtaggtgaatatgaaactgtgaaagtaatgtttcccacactggctacaagaacatgtacttatttctaattcgtaaataatataggctaatggtctcaaaataaaactataaattctataaatagatgtactatgcttccatgcactgcacccctctctgttttccatacccagctgctaaccactgtcactgtgttcctccttcagagccttttcagtgacaaaatctttgttcttagccttccacctttacaaattatgattattatagttattattcacatgtgtacatgagagagagagagagagagagagagagagaggagagaaataggtagatagaaagacagatgggcttgtcacacaagtcatggcttacatataaagttcagagggcaacttttcttgaatcagttatctctttctgcctttaagtggattccagggacagagctcaggttgtcaggcttgcgttgtcttgtgacactgagccatcccaggggtcccaaacttccatctattttagacatagataatatagtctagttaccagtgtgtatcttgctttttcaacttgtaagttttatactatacttatttgaaatcttttgcattattgagaaattctttagtatctttctcatattattatagtattccatattctggatgtactataatttgtatatctacccccttggcatttgatatattagcttcctctttttgctgatactaacagtaatgtagtggataccattttgttgcatttatttatttgtgtgtatatatgtgcatcatagtacctgtgtaaagataagtggacattctgtcctaccaaatgccccaccccaccatgtggatcctggatatggaactcagatgtttatggttggtgcctaacatcttctccagcttaaccacctctccagccttggatatcattttctgtggtatttcacaaggacacaagaacatcttacatatttactgtggtaaactatacattaaaaaaattagcatgggcggtgatagcacacacctttaatctcaggaggcagggacaggtggatctctgagtttgagaccagcctagtctacagggtgagttccaggacagccaaggctccacagagaaattctggctctgaaagaacaaaaatacccaaaacaagaacaaaacctaaacaaacaaacaaaaagaataaactcttggtcactttaagtatgcagttgtccacttctaggtatatagttctgtgacatacagtgcattctttgtggctacacctccacaagtatttgcatctcagatggtagttacctttgtcatatttaaaacgttgaccacctctcttccatagaagccatgctacttcatggattagggatccatgaagctggttggttttgttttgttttgttttcttgatgtccttaatataatgtgttagtagtttttgagttcttgtcatctgctatgtgaaatttctctgaaagtaggtacagtttgtagttttcttttaaaaattagattgaccactctatcgtgtttaaaagggaaggtcttttaaaatatggtatgagtcctagattagaccataaagggaaaaaaatgacacaacgatttggccacttattaacatagtaagaaaattaaaagtcattgacaaactggagtaggagagtatttacaacaaacatataacagaataaatagcctcgctatttcatgttattaaaaatcattagtaagagctgaggatgttctcgttgctttctggttcgttaagtgtttttatcatgaaagggcactgcatttttgtcaaatgctgttttttccttctcctgagatgataatgtgttttttaataacagtataattgacatataattcacatcttgcaattcactcttttgaaattgttcgattcagtggtttttaatatagccacagagtatacaaccatcaccagcatgtaacttgaggacattttcattccccctaaaagaaaccctggacccagttagtggtcaccctccattaaccccaaccccttccaccctgcagctcctgccaaccactaacacactttctgtcaaaggctttgcctactgtggctatttcatatgatttaaattatagaacacattgccttctgtgtctgttttcttcatttagcttactagtcccaaaatttgttcatgctatagctagatcagtgcttaattcttccttattatctctgggagactgaaggagtgagacaacttcttgttatcataaagctacctgataccttttaattgcttacctcccaatcttcatcttataaaagggaatccttcaaccgaaactacttcacgatctgttttacataaaggcatttctttgtgggacagttggggagctctctgttcttaggagcagctgttagctctggggcaaaaatctttcattgatggggactttcggtgctgggcagtagtaacagcctgttgatcttgaccgcctcttcacttggggaaacttaaaactgcatagaagtttaggcaagggaatcagagtgcgatgactggatccctactattctcaaccctctgtatcctggagttcctagcctaggaatgggaattggctaaaagaaacaagctcccaaagctttggctgtcctcgccaggaattctgcccttcccatcagtgttggaggtggtgagaatgctggctgctggctttctcatggaaagcctgtgtccctgacacagtcagagccagagggcatccagtcttctaagccactcttatctggggtgttacttgtacaaagacaagcaaggggatgggaggaagggcagtgagttctggctcatatgccatatgcagagcatcactgtgggatccctggacttagtagatgttcctgaagaagtatttcctcactcactgtacacgcttagggcaatttccagcagtttacaatttttaaaaaccacgttcaccagcttcaaaccatttcacagaagttcttatactgaactttcagggaggggttgcttctcatctatttactttttcagtcgatgtcatagaaggctcgtagcaggcagcactgaggagcattttcaaaataaggctcttgccaggaccaggaagcaggagtgggtgggttggggagcagggccagggaggggggaaggagggcataggggacttttggagaggaaactgggaaagaggataacatctgaaatgtaaatgaagaaaatatctaataaaaaaattaaccccgccccaaaaaaccccaaataaggctttgactattttttttccttttagacgtttcattcgtagttcttgccttttccattctctgtttttcttccccccatgtcaatgaatcttgtactggtgttttacttttggagagttatatttttcttgttactctgacttttaggtctacttcaggatctactctgtggataccactgagactttgaggactaagatgtttccttcaatgccgtatgttcctgcctccatggcttctcaggaactctcatgtaagttctactcattttaaagaaattactgttattttccatgagtccacttatcttactataccaagaaaagctataggttccctgtatcttataaataatcactatatttgaattcatctaccactgttgagatcagtaatagctttgcataaagctcattattatggctttagctatgatgtttattattattattattatcaatatcttaattacctttaaattgctgtggtaagaaactatttccaaggcaccttatagaaatgaaagtctcaaatagcacacacacacacacacacacacacacatacacacacacacacacatacacacacacacacatacacacacacacatatacacatacacacacacaaacacacacacacacacacacacacacacacacacacacacacagagtatttagcaaaagagaaaacaaatcaaacagaaaaagagtctgttagggtttacttagattttcagaggcctagagtccatgagcatcgtggcagggagcatggtagcaggcaggcaatcatgacactggcacagtggctgggagcttacaaatgatttacagccacaaggcagagagaacaccaactgagaatcatatggccgtttgaaaacctcaaagcccacccccagtgacacacctctccaactaggccacacctcttaattcttttcaaactattccaccaaccaagaatcaagtagtcagtcataggagcctatagaggctaatctcattcagaccagcacagtaaatatagcttataatgacacattttagcatcgatttaactaacactgtggtgttttaagataactataaagaatgagaaaggaagctctccaagtatacctgaatagaagaaatccttactgtgtttgtgacaaatttaaaagcataataaatgttagaatcttcctatagtgtattgttatgcacatgctcagctgatgttttgtctattagaagtctgaaattcgccaggcagtggtggcgcacccctttaatcccagcgcactcgggaggcagaggcaggaggatttctgagttcgaggccagcctggtttctagagtgagttccaggacagcccgggctacacagaaaaaccctgtcccgaaaaccacaaaaaaaagaagaagaagaagaagaagaagaagaagaagaagaagtctgaaattcattacttcttttggtactaactgtagtactactgctattcaaatatgacagaactagtatatgcctttaaaaatagcatgggaaattaattaaaaatattgtacaaaaagttatgaaaaagtaatcctcgcattataataatattcaagattcctttccatttcagttggcagctattacttctgtaaggtatcattcatcagatattttgcttttttctagttattcatgttttggcaaatgctgaagatggttgcttttttattataaaaatcatatatgtctgtacacatgcatgcatatacatacatataacaaatccttaggaagacaattttggcttttttttcttccagacttaatcccatacatataaaacatatattaagttatctgctttctgtaagaaggagaccattttatctgttctagtttgctttctatatcactgtgacaaaacacagacccatagcaagttggggaaggaaaagctttgtttacagaagctcaaggcagaacctggaagtaggaactgaagcagaactactgtttactcagttgctctcagtctcctgtcgagacccacctgctgagggatggcactttccactctgcgctaggccctccttcatcatttaccaataatgaaaatgctgacgcggacatacttgtaggccatcctgatggaggcggtccctcagttgtggcttcctcttctcagatagctctgctttaagttgacaaaaacaaacaaacaaacaaacaaacagacagacacaacaacaacaaaacctgccaagcttcactttcagccatgaaatttatcatccctcttaggtctctctctgtgtttatctgtccaggtcagaaattcaagttactgtattagaagatctcttctggacaagatctcctctttccctaggaatcattttacttttctttcttggatatataattactagtcttttcaagaagaaaatgatgctatctggctatccagaacaccacctgggatcctatctgcaagctcccagtattattggtactaaccccaagaatcctttgtgatgagacacagccttctgtgtgttgctcatttctctctcacaagggctaataaaagggatgcagtattaccataaggttccttcagcccaaaggaatactgagttttaggaaaatttcatgcaggctttgtgtggtgctgttacctcagtgaaagtagaacttaagaaatgttcacactgcatccttgggggttgcctccatcaagtattgcatgcactttattcagtggttctcctttgatctagatttttttttcaagtttctcactggtttctctcccgctttttctgactttgtgttttgtcttgttcctaattttgacatgtttgtgacccctttattctaggttatgttcttcagctgtcagacttctcccctcctcctgcttaaagttgttttgtttttcttccatttttgacatatgattcactttctgtttatgtttcatctggttccatgtttctgtatgtgttcctatatttctacacagagtttgattctttcatgtcactcaactgttgactatgagattctgatctatcctatgtctaactggagctttattattattattattaattattattattattatttcattgggtcctctcttaagctagtggcatatggggcagcttcctgtacttcacaccctcattgctggccagatgtactatgaacaaggagcaacagacagagtttcctggaataaagcagggctgtcttaagcttgttcccgcagcaggaatggaatggactgggctctcttagactagtgtgtgcatttagcagacaccatgatttctgtggttatatggtacagccattaacctgaacatattgctaattcggaaagcttggaaagctagactaacataaaccattgtgtataagtaatatttattacaattttggggggttacactagaatcattcaattgccaagaacatttgaaaactacagagtattaaaaagaagaaaataatacattcccaatccccaccagccataattttcttgcattgttctttatatgcttggcatagagtatggatcaatagtgctattaaagttatggaaattatgagtagatgtcagcaacaaacataggaaacataggacttaagctaggatgtttattcagatttagtctatgagagggcaaggcactctagacagaattcaacaacaaagttataaaagaactcttggatgtaaggaaaacttcaagaggctttgtgttgatgaggttggcaaagatacatgcctagtgtaaactaagatgtagacaatcgggtacttacttttccctatcaatgagaccccagtttcttcaaaatcattttggtggagttctttcacaacatacattaagatttaaagcataccagatttagcaattttacttgtacaaattaatttctcaaatacactcatgttattatgcaaaacatgtacagagatttttttgtgtacattgcaattatttttcttctttgaaagtttagtaaaacttaccagtgaggccatctgggtctggagttttcaatatttatgggaagaattttgaaaattgattgaattcccttaatggttatagagctccttaagttgttttatattttaatgaatctctccaggagttttaattttcagcactgaggttaatttacatgcctgacgtgcagtatatcactcatattacaacaatgttgggttcaaatccatggctttgatttcaaattctcattaacaagggctcctcccccccccctttttaaaatcttgaatgactgaggcaaatttctcattccttactaacactatacattctcaccaacactattttattttctagccacaacctcaacgactaccactactacggttaccaccaacaccactaccacgattacaagtggcttcaacctgtatgtgagaccacctgcatcaccttggctgaataacactggcttgatcaatgtggcttctatgccttctaccatgactgtgaagtaagcttgtctatttgaaattttctgttgtattttatcacttcataggcataattgcatgggtagctttaaactagtattttataaatcagttgaagggacagggaaggattttcttttaaatgtagctctggaaagtgaacagtcaacttgcttctgtaataccgttacaatatagtcattactagtactactaatagctataatttattgtgcaactctgcatgtttagcaagatgacaatgctttaaaaccatcatatcatttaatactcataattatcctatgaaatagatactattttgaggtcctgttttatagaagactgaaacacattgagatcaggtaatcctttaatggtcgcacactttgcaatgtgtgtgccaaaaatattcaagcagttgaactgtagaacttaaataaacttgcatgttatatgaaacatcctgtgtgccctttgcacagtcactacaatgacagaatcttgtattactatagggtagaactagctagaatattgacattgattcagtcaagatacaacatagggaggtggagagaaagttcagcagctaagaagactcgctgctaaaatctgcaggactaatgtttgaacctcagcatccatgttaggctgttcagaattgcctagagctccagctccagggtttccaacaccctcttctgatctccatgggcaccggtacacctgtacacacattcacgcagatacatgtgcataaaaaagtaaaagtaaatataaacataattttaaaaatatacaatataataaaaatataaatatttttatttatagtaagtaaaataagtaaaagtaaattcaaaacatagttctgtcaccacaaggattccacatggtgcccttttataagtatatctctcctttcattaactgggtagtaattaatctgttcttcattaacatatttataatattttttaaaatgctaaataggtgagccacggcatatatgtcttctaagaattggccttttgttttcattaaacatattccttcagtttcacataaaagtttgttcttagccaggcgtggtggcgcacgcctttaatcccaacactcaggaggcagaggcaggcagatttctgagttcgaggccagcctggtctacaaagtgagctccagggcagccagggctatacagagaaaccctgtctcgaaaaaaccaaaaaaaaaaaaaaagtttattcttttttttctgagtggtattacatgctgggtataatgaagtttatttgcgcatagatgtgttgataggcatctaggttaattccatgtttggggctattggtatgaacatttgtgtacatgttcctttatgaacctaagtcctttgtaccttgggtaaatatctaggcatgtaggtgcttgtcagtgtgacatttgtgtatttattatttttaggtgcctgacactttcccaaagtggtcatgtcattctgctatacttaccagtagtgtgtcagttacccaaacggtccatttttacttgctcagtagtggcaatgtgacactgtttactaccgatcttagagatgtgaagtggtcttattgtggtttgaactctaatgtctattgatgttgtacatcgttattttttctctgttctttgagaatgtaatacagtgtgctttcatccatattcaccctctcctccagctcctcccagatccacccgagtcctactcacccgacttttggttctccttgctttgcttttaacgcccattaagaagtccaatctatcctgactatatattattggatgtgtgggttttcttcagctacactcttgaagaaaacttactgggtttctccccacagcctagataagggtgggacttcatgcctacctcccctttctatgctgaggtttggactggtttgggcttgctcaggccttgtgtatgctgtcataactgctgggagtcgctatgtgcagctaccctgctatgaccttatagtcatataaggttatatgttatatgttactgctgtcccttacactctccatcctggctggctctgatacaatgatatctattttacatatttttgtatttttatatatgtatttgtatgtatgcatgtggatttggatttttactcttaagtttcgataacagaataatagcattcaatgaatcagtaccaactttccaacctataaaatgctctgggaggtgttcttacttctgtttttctcaaagaaatggtcaagtcggtgctgactcattaaatgttgctttaatgaaaacttctgtgcccagatacatcgcatgcagactcctttaaattaaaaatcaacttatttaatggatccagaatcagccagactgtctagttcacgtttttttttctagttcatctttaatgagcttcagcagtgtgtgattttaaaggaacaagtccagaattcatgaacatccagttgcctgtgctcacctcccttattgtctttgttacgttggagagatgttcttgtttcatttctgatacgggtgacctgtgtctttttttatgaattttttattgatgtttctctaaagaaccagcgtttgtttcattgattaatctgtaaaacttgcctgtttctaggttcactgttacccactgctgattcttttctcctgattgtattgggttcattttcttttgctagtttcttaacggctgatcttagactattgatttgaggcgttttcttctcatgccagcctgcactgctataaatagcctctgcgctgcttttcctgcggcccacatctttcattatgctctgatttcattttgagcagtggattatttggaagcatgttgcttaatttccacgtgttctgagattatcttcctttcttcttgaattaattatagtcagtgaacatgctccctatgattttagctagtttatatttgtttacagtttttttcttgtgtgcgaaggaatggtcttgtgttacagactggtcaacggaaacataaatattctgttttcttttatcttatcaagggtctgttctatgtatttccattattatatgtaaagattttggaggtttgccttagtctagtagttcctttggttgttggaaagtagccttttgaagttctcaaccaaataattttggatctatcttattttctctctttagttttatcagtttttcttttgagaaaattctagtgccctttattgttatttttttaagtattaccacacaaagaaacagtcatcactgaaacatttccatacacacacatcatcccagttttcttcccccctcccacatttcttgttagttgtcccttcctccccctgaacagttccctcttctcttttccaattctatgccgtatctttttcttactggctcggaggccttactgtttggctgcatatacatttggattggcagctctctccttgtaccttgatttctttattagtctgtcacttcccttgtctttgcatatggtaattttttgttgttctgtaatggaacctatactataggaacataatcttttcttttaaaaaaatagtaaatacttttgcaccttcaatcttttacctttatattttccatatttttggagtgattccatgtaggccatatattgttggatgttttcaaactgcagtatcaatccctgtattggatttgctatagttagcccatttagagctaaagtgattattgactatcagagcttgactctgatgtttggttatttcattgttagttttgacttgtgttctgtttctccttgtttttaatctaactgtgattaatggaaaattttagggacttttaccttgttatatatatggtgtttttaaaacttattccatataaattgttactggttgctgtggatattaacatatgcataaataacttaaaacagtctattcatattgactttttaccactttggctcaagtagagaaacctgtaacttacttttcctaatttttttttatcttgttgtgttgttgttgcaagtatttattccgtgcacgttgaacacaacaccacagaaggctgtgtttttcattcccacagacaaatagagtctaagaaatctactgaatggtgcttcaccatttcaaggcgaccttctaagacttgccatttcctttctgcggagttaatcttcaagggtagatttgtgtgcaatgccttaccttagttgttcacttgtgtaagatatctttatttcttcttcatttgtgaagctacgaaagtcatgatgagcacattttttcctccttcattactttgcaagtgtgaaacttcttcctaacctataaatttcagatgagaagccagccagctagcattcaatcgctcttctatttgaagcacatttttttgtttctgtctagtttttttttttgcttccccaattttaagtgtgtgtgtgtgtgtgtgtgtgtgtgttgacctttcagaagtccaattactctgtgtctcacggtggatttttctagagccctttccataccatagtggctatcccaactgtctaacaccatggatttttgtgagccatcctagttcggtttgtttaccctcttaaattggcatgcttatgtcttttcctgaattcaggatgtttgcaactttccttcccaataatttttcaggcccattctcttcttctggaacttgcatatacttttatctcatttcttactgccttcctgggccctggaggattgctttcatttgtctgccttctctttgaatgttctgtacatttaaattacctgccagtaagtttactctagtgtcaaacccttcaggagggcttattattccagttatttaattttcagttgtatattttctacttgattttttaataatccccatttctttgttttttttattttttaatttcaagaggattaaaaattgccctcttcagacattttttagtggctgctttaatattcctttcagacagttcccaacatctgatatctcttaatgcttttatctgcgttcctagcctcttctctttggagtggtgattttcctagttcttgatatggatcatttttattgtgtcatgagcatttatcaattattttaggagtgtttgggtcctatttgtagcttcttcattttcattagatagcccctctgttgagatgtagtgtgaagagtgagtgagcttttatgtttggcttcccattgaaccttgcccccagcaacctagcaaaaatggaaccctgagtcatactgcgtcactgcacacaggttgtgtggaagttcaactctgagctctgctgagtcattccccatgaaagtgggacagtgtatcacaccaagtcactagctcttgtaggaatgtaagcccagcatgcagatggggccaggagcactagaggaagagacaagtgatgagctcactcaatacttagttgatataggggcaggcaaagtttcaactacttgtaccatgctgacagaggatgcaaaataccaactactttacttttatgctacttgtttggcctcaagaatactctgttgtataatggtggcttggccctctactgggccttgttgacacaagacttgtggaagaaagaggatagtccttctttggttggcctccacttttggttttgcccactggcaagcaggttaaactccccaccaagtcttaattgacttccagagcagaggaaatgggagaccttaataatctgaatttgtcttagagtgttcagtctttagaggttagattccctactgggtccctgtgataccagagcaaatggagaggcctaccgatttactcactcttactaaatcttgtggcttctgagagaggattcagctttaccctgacattatatgtccccattagtaccccagtaggaaattagactgctacatgcatctgccagtaaagtattagcctattacttcccccattgagctccactgatactgtccctgccagagtaagactttgcccaagttgtcctgatcacagaatatggaagatcaacttttaatacaatcagcaggggaggttccttgtggctaagggatgccttgtcttttgtgagtaatacccagaagcacacgttgacttagatgggtagtttctggagcctccatcacgctgtgctgacagcccagaaagcaaaagcagactgtggccctggcttagctctttatattttgatttaatagccatcttaagaaatattcatttgctctagtttgcttaggataattttcagataattcaactggatgttttaaaatcatctttccatgttataatttacagcagattggagaatctccccacaggcttttctcccctagtcttcctgtaaggcttgtttaaaaatatgactatactttaataaatatgatcgtatttttataaaattttttagctcaatagtaactcctgtgatgacatatggtcctctggagagtatggcgaacaattggcactatcagctacaagaacaagaaaaacactatttttatcaggccaaccaattcaatctttggaaccaagcactgattgagtctggtaatgaggtaagaagatattctcattaatctccctgtattgtacaagaactttcagataagcacatgagaatagacttgagtttcctgttgcaatattgatgagtaccttaaaaatattttcctgaattaatatgctctctgaattagaaagtaagtgtttggtagttgagtgatgtttgagaaaatgtatattgttctaaaatttcttcaaaaaattaaatatcaacataattttgtttctatttctctttaaagattgctcttttgtacaacgaagtggaaagagtgaaaattgatcagagcaggtaagacccttcatatctttgattgaaaaactcaagatacttttgttctgtttttttttcccttgctatttattggcatttaatttgttacccaaaattgcttgtattcgcccttctgttggcttgttttattcaggttggaacaagaattggatattatcctgttccagcagaaggaactggaacaaatgttgactcctatagaggagcttttgaaggagcagaatggtcctcttaatatgatgtatgtgaataaggagtatgagatgatgtaagtaactacataaagatggaagagttgggcagaaggagggagaacttgaatcacaaagcagaaaataaatattggtagaaaagggcaagttctagttggtatttatcagcttgtttgactgtagcatgtttatctttaacgtatgcttgcaaatgaagaaatcattctggcagctttgttttatagcgtttcattcactattattaatctcaagctcatgcttgtcgactataaagtttttgtatttgtcaagtatattctcaaagtggaaatacaaagcttacttgtgatgtcatagtattatgggatatttctggcctcatattggcacagataaacctaatattcatacagtggttttaggcatacattacttggtttttcaaagacagactggtaatttgaggatgaactatggctttcaaaaaatggagtgatttttgtcagggtttcaggctaggtatgttttatttgtgtactgttcagtttttactttgtgtctgttcgctgtcagggttcccatggtaactctgtccctggacctgtgatttgataatcaggccactttagaaagcattaagagacgttgtgtgaccatactacataatctaaattgcgagtaacttgggctcactttgtcagtggcttgttagtgaattgagatggggcctttatgctttggactttttttttcttggtttttaagacaggttcttagcggttttgcccaggcttatgtcaaacttctgggttaaagtgattctgtcaccttatcattgtgagtagcaggagctgcaggcacacatcacagtgcccagctgagcctttgcaggcactctgctgaacttatttgttataaggcttgcacttgacgtttttgtaagaattttaaatgtgggtaagtatggctaatctgtactgacctcaattttatttctagtcctgtttctgtgtttcctttttctttccttttttcacgtctttctttgctttattctttggcattgtttctgcgaaacacacatgcacgcgcacacatacacacacacacacattgtttctttgtctaagataggttctggctatgtatccatgggtggctttgaactctttatgtagaccaaggttggccaaggatttcctacatagacaaggctgtccttgaactcatacagatccacccgcctcctcctcttgagcgctgggattgtagatttgcaccacgacacctgacacatactatatttttatcacctgttcttggaggtctcatctagcacaaactgtgtaacagccaaggccggcctgaaaagcttcatcgtcctatcaatactttgcaagtgctatgattacaaggaatgtatcaccgcgttcaactttattctatagtgttttttttaaaccatgtgtttagaatatattaactgtagatttggggaagaaaaccttagaaatatgaactcctttccaatggctcctttgtactctactacattcaccaggattttcaacagttaggcaaccagttacataggaatgatttgacacagaaagcaatcgatagttaccaaggaatctgaatgagcgttttaattttatagataaggttgagaaatcttctctttgcttttaattcttataaacatatcaatagagcagactaaagcaagcaagcaagcaagcaagcaacctttctccatcactcccctgctccttgctttgtctatctcataaacagtttgggtagagtatttgagaattcaggccactgattagtttgcaactaaacttagatgtatctactaggttttattgttgtgaagcttctttctcaaaatatctgttgttacttgtataccatgtaaggctttactatgaaactttatgtattctcaatcattgaagaaatctcaacatttactaactattgctaaacaatagtcttctagctatctaaatgtcctatgcatgtattctggttccaccacagggttcctttgctgtaacactcatcagaaatttagccagaggctaaagcctttgcccttgcagtctcaggttatgctggtaacattgaatttgtgagactgtatgtccttggccataactggaaactaatgtaggggagtcgagacatatctagttgacaatttcatctctatacgtcagtaacagtagacatgagaaaacatctcttgttactctctttcacttccctttgcagttacagattggcagaaattatagatgctgagctgaaaaggatgtctcaggatctcaaggacatcgttgtttacctgaattcactggctcatcctgctgatgctactgaacaggtatggtccctgctcttttgatttagacagccaagatttcataggaaattagccctctgtggctcttttaattagtcacattctcctgttctccagagtactccttatctgccctctagagatatgaagtccttaggcatgattagtgggacagtaaatatttagtaaatatttacagttctgaggttttttgtggttattcccaggagggtaaaataaatgactctcaatgttattcagggcttaatttctacataattaaacagatcctggtactttgttttcactcttataaatatgaacagatatgtctaggtctgttagacatatttaggcactctaatttatgtctttaaaatatagtaacttaactattaagacaacattttcccatagaaattgtttctgttaaatgtcattatgtttctaactgcttcatagcatcctacttagttcatagagcaaatacattatattatgagaatgtatgactgaggatcctgttagaattgagattctgtgaatcaatttggcagtaagaaagaagtaggggggttctttttcaattttctatactccaattataaagagcgtatttcccctatcttttcccattgtccagaagcctaaatgaagtcctctttcccccactcccactcaatgggactaaagctaagaggaatctcccattgtaggagcttctattgtgctttttctcattaattataagtagatgtgaggctagatctggatagatgaaaatgaataacatatacataagtggcgattattctctaggaagctctttgtccagttagatgcagacagttctttctgtgcaaacatattattaccgaattttttaattatgaaaagacagccagttatagttgagaaactattagaattttgacacatgatctccttgggtctctgctccttctttgcaaaatgtcaaggatagaataaatgatctgcaagtccctttcagccataaaccagagctattctcttcttagcatcagtctaaaatcgaacaacgacaaatataaattagtctgcaattaccaatgctaccatctgccctgtgttcacaaagatgatcacgagttgacaaagtacatttctattagattctgaatgtaattctaaggtttaaaattgttttttgttatgataggtttctgatgcatagataaatataagcagatttagacaccgcacagaactgatgtctagtcctggagtgctgaattaatttgagaagtgttgtcaacagagttagtaaaatctatctttgtcattttctcaacttggcccacgattattttgtttcattggtgactaggaaacggtcttttgttttcatttttcctggtagggataatggagatgtttaagatgagtgagttaagggtaattactgtgtgataggaggataaaggaagcgagagatcatctcttttttcagataacataaattattgaacagaaaaaaaatcacacctactgaatgataatgttcctatggataatgtgatgatcattacaatcacggtacaaaaaaaaaggagctatgtatgtgttccagcattcacagtgctgggatttaatgactttcgttactcttgtgtgtgggtttgtgtgtgtgtgttgatgaataggagagatcacagaatacttacactttcctcaaacatattatatctattacccaattatattttttacaaaatccataaggaaaattaaatcatcagtattaccaatccttcccctttatattgatgtatttcttctagtctttttacactgctgacacacacacaaaagttcttctatttaaacaaaatcagaaacataaatatattgacttttaccttctgtttccatggtcttttctgaaatttttcgtcattctttgacaatgtgagttttaatgctgccaaaatatttcactggagatgaatttcataatatatttagcatttttattgttagagattatttccaaatttggggctaatatagccttgtaatgaccaattacacttagagttgggtaggttcctgaaaggagaatatactgtgtaaaatgctataaatattttaaaacttttgatagatgacatgaaaatttacatgtggaaatttgggcctatttacatgactgtttagtgtatattagcatgcggacttttttcctacttgcaaattgagtgttttttaatctgcagtggtgaaattttaaatacttcaaaatctagaactctttcagtgaaaaaatgatgcacaagtggaaaagtctacacccatgaaatgtgtcattatcaaaagatatgggtgtagctggacttgggtgtagctcagtggtcaaagtagcacatgagaaacaaacaaatgatcaaacaaacaaatcaacatacacacaaaactataggtatgatacaaatattatataacatcaccttgagtctatatgtacaaggtatgtatggcacaaattccatgtttaatcttgttttccaaatctggaatatttcattatatataatgcaatgttccaaaatttgaaaagaaaatctaaaacaattatattccaagcatttgagtaaggaataatcaatgtatacttaactattgaatgctatcattttttaaaataataaatttgaggtgccatgcatgttaccatatcacccaggaggctgaggaaggacctgggctacattattaagttccaggccagtctgtactacataacaagctagtgttccccaaaaatatgcagatttgattgacaaatttgatgttattaattttaaatggatttatttatttgctttcttttgaaacatttcctagtatcctttatttttatattgtgcttgtcagtttttttaattgatttgtaggaatctaactcttgacagttaccaaatgaatagatggaactaatgcataaaattagtgtataagtatgaaatagcaaagcaccattaatatgtagttcattgtcaatgcgccacttaccagaacaaaattaaatgttgtttcctaatttcaatttcctgtgttgttttctttttcgtttactacattacaataatcataatctaaaagtctttggtgtattttcagctggagcagatctgcaaaattctgaatgctcatatggaatccctgcagtggattaaccttaattcaggtaggagtttgttttatacataatgttgtaggtacgaaaatgtatgacacacattgtgctttcagtgaccacactgactcaagggttgttcagggtatgcccacatgagctctgaagagattctacaatttaactagaaattaatgaaaacacggaatggggacaggtacggtattggcaatatcaatgaagcaggacttttaaatttatcttttatatgcaattttgatcttggtaaaacatgtatgttttatatactcagaattggacccaaaatggaaagacaaatactgaagccttcctcacccccaaatcagcaaaatttatcagtgtagataactattgaattcaacattcttttttgaatgttttgtgtttgaatatatatattcatgtgtgtttaggtcacatgtgtgcatgcttgcagagactgggcaaaccaaagttggatatcttcgtctgtgcctctctgccttatttttgacagtctctaagcctggagctcattgatcttgtgatactagcagcaagcactttaccaactgagccatctcctgcatcccagagtgtggtgtttttggtagtgcattcttattaggtgaaaaaaattaaatataagaatgagtaaactttttaatacttttattgttagcttcagaattataaaacaagtatcatgaccactttatagatatagcaaaataaaccaaatgaatacatatattactgtcaatagaagttaggatttgtattgagaaatgagatacaagtcatttttcttatatatccatgtaaatttaaaattcaaatgctagtaatgaacttagatttcttttctgtgtgcatgtaaagggtttagagacacggacagataaatgaacaggtctagcactaaagtcttggtttctatagataattcctatgaaaagaaagtgattcttcttggaggtctctgatctcaggactgaaggagagaaatacatggagacttgggatgtgcaagaaagcaaacattgttgtaatattaataatgttttaacagaagtaaaggcataatgttatcgtgtactgtgtaaagattatccccagattattcaaatgctgatttctgtgcccccatatctggttgcaaaactttaccccccagttattccctgattggtcaataaagaagctgatcagccagtaaccgaccaggggtaagaatagggctacacatcctcctagccaggggacagagggaggacaggaagaaagcagggatttgccctagggagagagttcaagagagaccatggaaaaacaccgggaagagagaaacccataaagtgcaggtagcttgggaatttgggttgggaaatagccagataagcataaaggattaaaatagagtaatactgcttagtttttgtgccttaaagctgtaaaataaatatgattgtccagtcttaattatttgggagcttagctgggttaagagagaaacagcaacacacttataaaaagccactagcacataagattactgcatgggactcgcactattaggatgctttgaacataaaaataatagcaataatagattataatactttaaaggcaaaacctcatgaagtcacatttacacctcttaaaagaaaattgagaaatgtaaggggacaaatcttagcagaattatgccaacaaataattgtagaaagtgatagaattaggaaactataattacaagctctccatgggatgtgtttaagttcatctttatcttgaatacccttctttgtttataaactctttcaactaatagtcatttcttggcagaaaaatatgccagcacaaaatgaaccaaataatgactgcaaatgattctgttaactttctagaaatagtcttattggggtataacttacagaccatgacattcaccacgttagttgtttaagtcaatagggaaattatgattgtgcatttgcattatatagtagctgatttgggcaagggtcatccaaaaatggtaaaaactataatgttttaagatgtttaagatcagccaggcggtggtggcgcacacctttaatcccagcactcgggagtcagaggcaggcggatttctgagttcgaggccagcctgatctaccaagtgatttccaggacagccagggctatacagagaagccctgtctcaaaaaaaaaaaaaaaaaaaaacctaaaaaaaaaaagatgtttaagatcattgaggaataagatatttgtgtactcctaaaatttatcactccatgtattgattaataacacacacaattaaggtcaagttattacctctttttagcctacacttagtctcttggagcctttatcctcattctcaaaaacaaaagatagataatacgtacccttaatattttagaagattaaaagaaagcagtgtatagctttctttgaatactgcctaatccatagttggtagtcagtaaacgatagtgggaagaactagttactggttgttaaaatttgtgctgtttttgtatgggggtggagatcagaaaggtcatgggattcaaaggtagctattaaattggatctaaagaagttagttccaggtaggttctcattaagtaccatttacattgagaagttgatagagtagctaagaagtagggaaatgttaataaccatacaatgacaaggaatgagattattcaaagttatcctgtgtgtggcttatttttctacagtgaacactacttttggggtggagttgaaggggtgttacaaggtaatttaggttctaaagaaaaattgcagtgatttttctcttggcggggatcctctttgtcataaatgaaactgcaaggctcccagccagtgtttcctttataaaattaaagttgttactgttgcaagggatttactttatataaatgaagaaattgtgacccagaaaggtttaatggcttctttagaacacacagctaagaccagtcatagaagaattgggatcaggatccagattgccttatgtgaaaaacagtatttttaattctggtgtgctttctgaacaatgtaggtatcattagatataaaaccaaattttaaccatgtacaaaacagtagaggacagggttgtcaaaatatgataatctttcgagtgggatgttaaatttcggtgttggataaagctctccatcagaattggtagcaagaatcaggcagtagagtgatgattaatgagaggtccttttttgctagagtcatcggaactgaagaagcagagcagtgttgtagagcagccgttcccagcctgtgtgtcgtgacccttttggcaaacctctaactccaaaagtatttatattccaattcgtaacagcagccaaattatttatgaagtaacataattttatggttgggggtcaccacaaataaggaactgcattaaagggttgcagcattaggaagggtgagaatccctgggctagagggtttcatttgagacaggctctgctgaagaatgggaaaaacctgttatttcttgatagcgagcgcaagcttctttttgccgtcctcactcaacaagctcttccttttcatatcaggaaatgaggtgatcaggaaggcagcatggcagcagggtttaattatgttgtccaggagaggatttttttctttttgttttattttcccttttaatagctaattgggtcatgtctgttgaaacggtctgtggactgaaagtttaagattaaattagcccagtttttcactttcagagagcagttatagaaaaataaatgagtgtgttcttctggcaatacaaatattatattttactaaaaagaaatcattaactcatataaaaatcaaatctttcttttaaaaggtttccgggaaatgtttttgtgacttaaaatctgtaatattggcacagaaattttccatcataaaacatggcagctgttacatgaaaaagatcacacatttaactgaaaaatcatttctttaaaagtgattttgatgaatattattaaccgagaagagctaaaatgaaaagactatatactgtgtgattccaaatatatgacattctgcaaaaggcaaaactgtaaagatagttaaacaaacaaacaaaaaaagatcagtagtgggagtggtgatgaataggcagtcacagagctgtaaaaatattttctgtggttctttaatgatggatacctactagtatacttttgctaaaacctgtaggatgaacaaagcggctcatgagcctgtgtgtaaaggacaggccttgggtggtattggtagtttatcagtgataatgagtgcactgctttgatgtgggatgttggtagctggggatgcttgtgagggtagagcgtttgagtatattgactatatggggactctttatctgagcaatattttccatgaatttaaagttactctgaaggatccattgtatttgaaaagaaaaataaatgaaataaatcaagaagaactggaaattgaacatcagatacactttaagtatgttagcctagtacattcgttcttcaatgaacttttcaacaaccacaaaggtgtggcaagccaggctcctttagatctctaactcctacaatagtccagaaagatagggcagaaataaaagggcatcagagaccatcaaattaagggaagtctgaacacatgcaaggtctaaaatgtgaggcttatttactgttacattatctttgggtttctttttttcagccgacaagtataattgagagtggatggtagccacaaatgcaaatctgtgctccctctcatcttccttttttaaaacaaaacaaaacaaaactgtagagcattatttcaaggttggcttgatgatagtgctgtagtctcacatctgtcttctgagttggcagccactgaagctgcagcaagtctagctcttctgggaccacttacaacagaactggcaatccatctgaagtcatttattatttgttttaagtatgtggagctacttgtggcaggggagggaggtgggataagggatccgtgtttcccgttgttttgtataccaccaagtcatcgccatgtatattagtaatcaccaaatagcacaataataaaggacaggctgtgaaaaacactgtattacttgaaacttcagcagtatcctggcatttggcttctttcatgaggtgtcccaaggttctaagactaaatctatttttatctgtaactgtctcaggcgcctaaagagtagcactgcatagttatgctatggattcccacgtttacattgttatttagagcagcaagaaccactgcttgcagtagttaaaatggccaaactatagtcccatgtctgtgactatcttactttctatgctaagtcttcttagtcaccaatcacatttaactctcgaataaaatgcttttagggtcatcttagaataactattttgcataatgtgttataattatgctttagttttgcccaatattaatagttacgattggaggtgacagtttcaaattaaacttttttttagtgttagattttttaaagtggttttcattcagccagtaaatggttttaaaactatttttattaaccagccatggtggtatacacctttaataccatcagttgggagacagaggtaggtggctctcttgtgagttctagaatggcctgatatacacagtgaataccaggtcaagggagtctaatagtgacaccttgtttcaaataattttttttaaattaaagctagacatagtggtacaaacatataatccaggcacctttggggtaaagacagaagaatcaggagttcaaggtcatctttcagtactcattgagtacattaatgctaacctgtgttgtgtcaaaacgaacaaacaggaaaaaccagtatattttattagttatttcaactctcttctttgaagagcatcaatgctgaagtgccaaaagacggagtcctcttcctctttcaacttgtgggactaggctccaactcagattcacagattgagggcgttccttttgccgctgcctttccttacattctttgagcaatcttggtgacactggtggattggtaaggtcatctcttatgttttggaattgaacattccacttcagatacttgaaaattgaatgtcttctgcttgctctgtgacagcagctgcacaaagccacccaagtggactttgctcatgtagaatgtgtattttaaactccacggggacacttaagtcttcccattgcacttagctgaacagtattttgtgtctttccactatttaaatgatccacttgatcatctctgctattctttataggcaaaacagatgtttcccttaattccaaagaatgtcctgtactttagattaggggactaacattagaattaagcaaatcttcagttcctgttaagaaatagtgtatggtggttaacgttctctgagttgaattctccgaattctttttctatatgtaaatccagatttgacataccctcaatacacctgcaagattagatttctcactaatcctacttatgtacgttttgtgcccaagtgaatttcctcaagctggagagcttccccacgtgaattatatgcaacataatttaaatcactcacaaataccagaatttatattgtttgtgagaaagataggggtttttcctccaaagcagttttcctcctagtgactaaatacatacatgcatgcatacacacacacacacatacacacacacacacacacacacacacacacacacacacacacacacactggaaactcgtgataatgctgttttggagcccatgctcaagagacaactcaaatatgaaataacgtgatggcttttcttcagttaagcctcccagcctcccatatagtatttagatagatggccctcatgttaagcatgccagtgtttgaaggaaaacaaataccattatggtaccagttatagctcagcacagtgcttattttattttaactttatttttgagacattatctgcctttgtagctcagcctgcctttgaattcatggtgctcctcctgcctcagcctcttaagtgctaagactacaagccttccaccgtgcttcgctcaggtcagggcttagtttagctgcttttaaattgctattattaatttggaggggctctgtgtattccacggtgactctgtgaaattcaaagggcaacttgtgggaggaagtcagctcgctctgggaatctaaattatgtcattagtcttggtggcaagttctttgtatctgccaggccatcttgctgggctagcatttagtttattttaattaatatgtatccattatacatatcaatgaagttcagtgtgatatttcaatatatgcatggattatacactgtttattcaaaaatttcacagcatttgacaagcaggtacattaataggaaaacacactgttagagagagtcagctatacagggccaactgaattctcataagctttagcttctgagaagttatttaaaccttcctacattttcacttaccgtcacagaatattatgagactcgaaatagcatccacgggcattagaaatcacacgtgctggggctgggcaatgattcagtgggtatgagtgcttgctgtgccgtcttgtggacctgagttcaaagtcccagcactgatactatgcttctagtgtcttctcatcactttaatatttactatagcaccgagatggggtgggggttatacttccagaaatactttttctattcagaagcatataacaagaacagacgtatagtcagtcggctgttacttgaattttagtaaactgaatatcttaaaagtagctatgactagtcagaggataatgtcctatcccctcttcccccttccccctcattctcttcactttccttttctgaataacaaggaaagattatattaaattcctaaatgtcaaagttattgtcaaaagcaacctaacgtcatatataggatatgttctgcaatagctaaaaccttaacatgtggcatatctagggaggctaaagtaggagagccatgaggttgtccaggccagcttaaactatagagaaaaaaacctgtttcaacagcaataacataatagcttacgcatatgtgtggggctttttgtttctgaaattggtttgaggtcaactcaggttcacagagttgtaagaaataatatagaaaccttacttattattaccttatttttttctcagttataacatcttacaaaactgtagtataataataccataatcaggatattgacatttaacccagtctgtcccatattttgatgataagcaatttgtcggtgttttggtttagcttttattatctgtatcccaaagatttttctctcatttttttgaaggttgtggtgcattttggtgttgtttttgtataataaataggtttagatcaatggctttttgtttgttgaattttgcctgcactcagttgatccagtacgattgtaaaagctatccttggtcaaatgagtttattttcttttgttattatgtttgtttgtttgtattgtgtgtgttcacacacacacacatgccacaacacacaaagtcagaagacaacatgctggagtcagttctctctggcaagcactcttacctgctgagtcatcttgtagtctaaattgctttccttctgaaagaagggctctgacaccttaacccaagttgacctctaactcacagcaatcctcctgcttcagcctccttaaacctgagattgcagacatgaaccaccacatttggcccttgaatttactttcaagccttatcaaaaatcagtttggggtaagcttgaattttttttcctgaagtctttattttgtggatttttgtgtctttccccttaaatatcacagggccctaagtttaataattgctttcatttctgatcatacatgcaaagcattcactatttcatcttaagatattagctataggtttttggtgggtgctccttatcaaactcatatttctcatctattcctaattagctgactttttaaaaatcataagcaggtactggatttcatcaaatgcttttttggttattaattgttacaagagcttttgatttaatttttaatttgtttgcatactgaactcattgttattttttaaatagagtgtcagccatacatagtgtggaataaaagtcgaccctttttggatctatttttcttttcttttttttttttttttgatctatttttctaatactctgctacaagcttatatatatatgagacatttgaggtattctgcagattgaagttgtctgtagttttctcttggtgttgtgctgtctttgcctggtttggtatcaaccctgtcttctagttcttacgatttgtggggaaatggtattacttctttgaatgtttgatagatcttcagtgaaactgtttgagcctgggtattttcgtagggagaaagtttcatttgtttctaaaactattctgattgtatattttaccttggctgcattgtaaaagcttttctgtttctcaaagaatcagtgtgtttctattaagctgttgagttgtaagtgcaaaatagttttgtagggttttttgtagggtttgtttttgtttttatttttgttttgcactgctatgtcctgtttctttttgagcctgatgatttgtggtttctgtgcttaaatttctccctcttgcctgaagtttattaattttattgacttttttttctctcgaagaattctcgttttaactcattgatttttctcgatggtgattcggtttgcaatcctactgctcttagctggtgtctttactgcttcctccctttgcttgctttctgttgactttgtccttcctctagttttctaaggtaggcacgtagactatttacttgagacctctccttgatttgaatggtattcttttaaaagggcatttctcctaaatagcagtatgtttgaccccagctgtcatctccagccataatttcacaaatgattatttttattttcactgtcaaaattctacattgagaaacattcatacacagatatgccagaggtacctcaaattaaattaatttggtcaaaaactatttatgtcctagtttcctatattaagtctctctaccaacttgcaatgcacaaatatcataaatttcactttgaccattgttattttaattatgatcatgcaggtgctgttcacagcctaacacactctattttctttctttttacaagtttttgtctacttttgaattttattttttgcttagttttctgtatagttatcagtaaagtcattatccaaatcactgcctttaatttaaattatctaattcaacttccaaaacttgtctcttccatagtcctgtaatctctactgtctgttttctgtgctgtttatttggttggtggtggtgttcctggggttggactagaacgtatgcatgctaagcagatgctctaccactgagctatcccttcagtcctcgtcttgtaccttctgaaattgttgctgacttgacttcaagttaagtcccccctttcaggactgttatcagcacttctgtggctctgatttctgatcccctgattctcttggttccaatatagcacatatttcctcgcccccaacttccagagagagtatacagcatatattttgatactgtgcacttctgaaaagatatgcatcccaacaactcacttggttgataatattaggtattagatgataacatgaaaataatttttcccgggacttttgaagaaaccaatctgttgtcttccaactctgagggacattttgattcggaaccttttctgaagttcttcattttgtttttttcccctattgaaaattttaagctctttctcagaatacttacatttagggtgatcggctttgatgtgaatctgtttcatctactgagcctgatattaatgagtcaagcaactcagttctttgtgtttgaggctgtgctcttaaatgagctttctgctaatttctttgcttatgttatcttgttccactttctggaaatatacttaatctaatgcttgcttcccagaactgatctacatttttattctttcctagtggctctatggttttagttaatttttctgactctgcactctacttcttattccaaacttttgttgatctttactttctgcagataacctttacgttgcacgagcttgctgtcatatggcaagcgtacctgcccaaagttagtagccttcactcatgcttttagattcagtatcatccctgagtgggttaaattttttcaaaaaactattttgctcttcctaatttgttgctttcatctttccattttgtttcacactctcagattgtttttctcaattatacttaagaaagcgacacaaaacattttgtagctgggtttgctaacttgctgtgggatagataatatgattagattcttctcttttcccatcactgaaggacttctagccactatctttagactttctgtctagggggtcaaagtctctggagaagaattttgcagtttctggctgtagattagttaggccactgctacaccagcattctcagagccagagaacaggaagcagacactccatgctcctttgtggccgcatacttaagctcttggagacttctgtttaatccctactttcaatacagaaggcctgtccttgacttgatctgatatctctgatctagagcttagcttgttcagtcgtcaaaggcaaatcttctgcagggcttgaatagggagcattacccagaggtaagatacagaggagaggaatggtcagcttctgagtcatacatcctgttttctgctccactttgaacaccatttggaatgatctagtccaaccaagtccatatttggcgcaaaactcattggaattttgaaagtgttcctcgcccttctttgtacacttaatggcttcgtgctttgcacttctacctctttgcaactattttacagatgtgggagcttagtctgcagaaaccttcgtgatctcctccccctttctcttctcacccttcttcagtttgtttccacattactgtcacaaagatccttcttggcatgatatacaaagtacagttttttaacttcttcgtagagattatacattaatttttcagtatttttgaaatgtagctctgatcttagattttgagttagtttagggtataataaacagttacagtttatttgtcccctgccatgtaaccagaacagtatattcaacttattgttactgtttcggggaggctatgggtgagagtgtgtgtgtgtttaaggggaaatacacaaagatccacaaaataaagacctcaggaacaaaaatttaagcttaccccacactgatttttgataaagcacaaaagtaaattcaaatgtggtgcttcatgtctgcaattccaggtttaagaaggctgaagcaggagaatggctatgtttatgaaaacagattgttgtggtttcaatacataatacatagtcaattgccattgactatttagataagtctgtagagatgtacagacaccaatatcatctcaatttttgaacatttcctttgctctcaaatttcctattggcctattagtagttaccatccattcctatcccaagcaagtctcgggaaaccttgaatctacttcttgtctttgtagatagctcacattttgtttagtgatagaatttttatttttgtatgtagagtgtctttttaataatgcaaaaaatgaatggtatatttccttccaagtgactaccactgaaattctatttctactatgatatattaacttaatatattgacagtaaccaatcaatgatgctggtcttgggaccagaattctgagcagtaagtaccatgtgaattgtttgctcttaatgaatgaagggcctcagacatttcaagtgagttaattcagaactagtcctgagaagtcaattagaagacatgacaagctgtttatagtaagcctctcttcataatgatgacttgtgtttcttgacatcttattgatttttaagattgttataaatgtactcctttgcatttagtatgtatcaatcagcaaattagtaaattgtgcttatgttgacatagtctctagtctgcagttaatggctcgaactgctcatttatgcttccatccaagtaaaacagttatttaaagggggaaatctgcaccctgcagttcgttattacaacaaaaagaagagatttattttgtcaagctcattattcattgctgttctggcccttcagcagataaccatgatttaaattagccactcttagagtatgatcttgcagattgtatgtattttatatgataaaatgaggcattatgcattttaaaaactgggtaaacattaaggctgttctggatggctgaaagaaatgaagtagaccaattaagttttagtttttattttgcaaaactttcctttcctttgggggtgccaactattatttatcccctgctaaacactaatgaacaattctatttgtgcatttttgtagaaaatctctgattaacatacttccctcaacagtttattttgcctggcagaaaagtgctatttgatatggtaactagtaatgccattttgcagtacactgcccctgagcaaacttaagaaccaccaaggtaaataaataatcaggaaagaatagaaatgtagatattctccaatacttgttgtgccttataggtagctcagacctaccaaaatctatacattcaatctattgagcaccctgaatggtccttttgcacattaatgagtaaaaacagctaatactcccttcaataaaacacaaatttaaggtggactgttattgacccaaagttaaagacaacaaataaagattagtctcatccactatttttatagtttccaaactgatggattttctctctcagattttctaaaatgtaaccctattaaaattgtgatttaaggttgcatatgccataattgaggggaggatgtgttactgcgtccacagaatgcgacgttgactaatgattgtatgcctttcccactctaggcgtaatgcagaagaaggtggaagaggttgcaaatgcagttgaggagtaccgtcgcaaggagcaagaagccatgaaggctgcctttgaataactatcactccaaattgctccttttggattactcattaaccctgagttctgatgatattaaatagagtagtattttcagttactacttaatttttgattggaataatttgtgcatgcatttatttttcatttaaatactgtgaagaaaagtatacttgtttttttgtttcagaacggaataaaatctggacacaccggtaataatgcttacccagagtcaagtaaccccattgcccaggcagttgctcactggtgttcattttgtgtgtataatctctgtcttacttagattctacatatgatcaccagtatgcaccaacttcttactgcagcttaattgtgggcagttgtttgccaaaatgaacgttacccagtctttactgggtttttgtggccattcacagaaattgctgggtcctataaagtctccagtggaatttactatctactctgagagaaaattttacctgttaagggcaatatgggcaatgaaaaccaagtgtaccataaatgacagcaagtgtctttcaggaattcacagaatgtaatacgttttttacagattagagatttaattggggcttttatttttcttatggtactagagatcaaaccatgtgccacactcttggataatatatccagcactgaattatgggtaaggtccagtgattcatttacttttgacaatatacagatacctcagtgcatttgtttttaaatcaagatctctctgtagcctatgctggcttggaacttacaacccgcctgcctcagtttttcaaatgccaccatccctacatgttctgttgattgctatcacttgttttgttttagcctatgatttagacctgtttggtgtagttttctgtctttaaagaaaaaagcccttttagctcttcatttcttgtatttcatccaagttgctgatatgatatcctaaaaatgaaaataaactgattaaaagattt

SEQ ID NO: 681 - DNA, 55908 bp, mus musculus; identical to SEQ ID NO: 680

SEQ ID NO: 682 - DNA, 308683 bp, mus musculus
cctccattccttcctccctgggctcatggaactatctcctgagtgctagaagttgtagcgggcaccactgcgtgtgttttcctttggggcactttttttttctagcggctgattttagtttcttccaaattaagccacttcgccccccttccccacactgtcctgaataaggaacaaactgccaagcatcaacggagcccagatgagcccgcgccgcggagcagcttagcagtctcctgggacccagctccggagcagccacaagcatgcaccctgggtgagctgctgctgctcagaatccccctcctctttccaactttggactgctttcccaagccaggactatacttgcacttctgtcactgcggaaaaagtgggagtaggcatcaaaagggagcccgggggaacactttctcactcaggaccctgtagtccagagagcccatgtttctcaccctccctctcctttcagattgtggctgttcctggtttccttatgcttgaccaaagaactggcagaatcggtaaggcttcaaaagaccccctttttccccctcttcctcttgtgtttctgttgggggtaacagagggttgcaccaaatggagcctttctaataggacttaatggggttcctggagaggaatagcaagtataacattagcctaatgctctccggactcagcatttttcttgtcctaaaacatccctgtaggtttagagaacaaaaattagaggtagacaatgcaaggtgcacacatttgtgaatgtcttcaggacaatttcaggtgactggcctctgatgcccttttttgcaccaataggcagacctgcaaagctgaagaaacatagctttccctaactgtaagaaggtggattgacgcataaagtttgagagtggaaagagagtataaaggactgagatttgaatgtagcagcagtaagatggaaagtaaagtttataatttgtttgtaggtcctttcatacatcaaaaagtttaatgcttagaaatgcagataagctttctaaaacttaaccttttgtagactgtttggtattatctatgaactcatagagactccaggcaaaggaattcgggctaagagaagtttaatggaactcagaaagtagagaaccatctactgcaattagtaggataatttcacaaaggtgacgtgactaactgatcagatatgctatgtttccagttcagctagttagttatctggcaaaaataaacttagcttgtaggttcaaatactacattgtttaaaaaacaacctctttataaaagtccaagtcacaatacaatcaataaatacacattttgaattgtttattttgtggattgtaattattttaactgattggctcttttaaagtgtcttaaatacaattttagagccatgcttatttcagtcagtaaggtcaccaatacactttgtcctaacataaagtctggaaaaacaaacaaacagggaagtgaaatgatttcttataaacaaagaaaaatactggaagactgaattcaaaaattgtgtgaccctttacctctgaatttcagctcttaaatatgtgtctgctaagctttgaatgaagaaatattgatctcagattcttgttcacttttctaccctattcttccactatgtaagcttacatgtgagtttcttcagaggtttatactgtatttattgaaaatgccagcctttgatttctttgtccagaagtcttgtgttgttgttgttgttgttgtttttaatactactactatagtaaaactttaatttttcagtctctgactggtggtgtttgtttgtttgtttgtttggttggttggttgtttttttgttcctttttttttctaaaaaggaaaagcatttgataattgtagatggacatgtatttctaggataccatatcttcatttgttatggtggagaagaaagttttcagtctttccgagcattgaagtgggtctctagatctgggttgtatacttttgtctcattgttctacaaggtagccttgccaataaccatggtaagaatggaatgaaccttgaggtccattgacaatacttattctgttgctgtaagtccagaattgctgtattcggtcttctttacttgttcacagcatctttggtattggaaagtcttttttttttatgacaaagagaaaaagaggtgagtcacaaaatactttttcagaagatactattactggggatttttttttctcaatgtccttgcattctgtttcatctagtctcaactcaagtctattctctgtatttgtgctgtcttctgcttttcagatggttgtaggcatttgaattagaagtacttttagtgataccaatgcaaatagcttatgaatgcatcaataaaagctctgttatacttcattatgagaaagcatcttcatgctgtgagaattaacttgccagtaattgaatattggtaagcaattaaagagagagttatgtagttacttttgagcattttctttataagaatttgcaaagcaattcaatataagaaatggaatgctaaatgttaaaatccattacatttgtttttcaggtgaactatctgctaggttttacttagtgagacagaacctaggattgcaaaacaccaggaatcctttagttaagtgctcaagtccacaagggtctgctgtagattcaacaaggcatgcagaatttttttaaaaaataaaaaacatagctacctacgctctagaaattttttttgcctatataattctgctcattatgttccttgataaagactgctttaaattatcttcatgtattgtatactattagaaaactctagtcaaaactacaaatctcatcctagactgtctaggagataaaatgtaccctacagtattgtgaattcttatgcttttttctcattctatctctacccaagagtacattcataaaagtcttcaatacatccgagtatacaggaagttaaaagactaatgggacacttatttgggaggggaggagaataaagaataagaacatgcttgtcatctatattcaagtaaagacctgattgtaatgctagcctctttctttccaaagcatgcccaggttggttcttcacattgtcactggcccagtcattatagcaggcatcaaaggatgaatgctgttttaatgttcagcagcccagttggtggctgcaggaggaagtgtcagttttcctctggatctgccctctgtaggttttacatgctccagtggccctacaatcacccgcataccggtagtgctaagtggactcagcaggttaaagaaacagaaggatccatgaagtttgggggtgaagtggtgatggagtatgagaagaggaggaagggaggagatggggatgaatttgataaaaccacattgtaggcatgtatgaaatgatcaaaaagtaagttaagatatataattttaagagaaagaaattgataaaattccttcctcctttattttttaggtgtctgtatatgtagtttttctttaaaaattttccatacaatctactctaatcatattccctccccttccccccaatgccacacctccttacttactgaacttcatgttcttcctatctttctctcaaaaaaaaacctcaacctcaaaacaaatgagcaaataaataaataaagcaccaaaataaaacataacaaaaagtacacatacacaaagaaatatggagtctattttatataactacagggtaggtctcgacctacagggtttttttttataccaagtattgatgtctcctacattttaaagacaaatgaaaatccataatcaaacccagaaatggaaaaatatataatttaattttcttctgtaagtataaccttctcaatgcaattgaatcaaatttctcttttattttattctcctctgtattacagtccagactgagtctgcaccatttgaatggggttcttccagctaataatgcctgcttaactaccaagcaaaatgagtgcattccagtctctattctgtctttcctactttcagtttcccattttttaattctactgaaatcctttttctgattttcagaatactgtagcttattagtcaatggttctttgatatttcaaaaatgttatgcgctcagtgggtatttattgagagacctttttattggaattaatgtgttcagccctaatattccagtggtgagcaagataagcatcatctttagtagggaacttagaatcttgataggttcatgtcctaaaattgtgacagatttattctcagtgaagctgtctctctgagctccaaccctatatttccaactgcctcctaatccttgtctctcacttaaaaccagtgcctggagtttagtataaacactcacctaaagccatctattacttcttttgctccaaacacagtatgtctaaagaaaaaactttttttctagtctttccctgtatacttcaagtgaaaccttttttttttttttcttccctttttgctttcttcaccatccattcagtttcaggaacaaactacagaatcaatcacaactctcccagttaatatcatcaacttctaccaatattatcaagaatctgtaggctgatacttcgatccacacacactccattgattctaaacccactcaccctatatctacagcttctgaactgacgtttctacttcaagacatttgttagaatttctataatgccacaaaagttagttttactaacaaaaaatttcaaggatgttatctctaggtataaaacctctgttcatctcccatttcttccataagaaaatgcacacatgcttggtttggaaaattgaagactttcaattctttcttcacatatctttccaggattgtggctttgtgtttctctttcctacactctaaaactacattttccaccactctcataccatgcttccttacctttctttgctcttgggtatgctgtcatctatgtctagtatatgcccctctgtatttatacctttgctcctatcccatgaactctttcctggccctccatacctacatcaaatgtcattttcttaatgaaataatttcagacctcttcaacttggtactccaaatgactatgacactaccagacacgttatttgtggttagtagataactttctagtgaatatacaagtttctggcctgcagaaattgttttttctttgtatatcttaaagttactaatccaatatagatcatttaatgaaacaaataacaatgctgtgttcaatgagaaggctcagtaagtgacaagtttgatccccagagcaaacttaagatgaagataactcactccacaaaattgtcctctgacatcaacatgtgtatgttctccctacacatatcacacacacacacacacacacacacacacacacactgataataatataattttaaaaaactctgttcaatgatgaaatctctaaaagatgatagaaaatggttttgctaaatgcttcctctatccacagttcctagttgtatgatttaatttaccttcctgtgacttagtttttcaccgccagaaaaggaaataatgtcttactccttaggtattattgtcctttgcaaagttaaatgagatcatgggaacccgctgtctacaaagaaagtctcatattctcatcccacctctgacaattatcctctatttattgctatgtcaggggaaaattaaaactaaagtcccaattttgacaaatggcacatagatgagcaaagtggagatatcagagaagatcctcttgtttctagagtctgtctgctgccatggtcatgttttaatattgtcctcattgttttccccatgtctagtgcaatgacaaacatcttgcagtgtttccagtttacaaagtgttctctcattatttcataaatggctccaggctatcctgtgaagtaatctagggcaagtattctcatgtcaggatatttaggatttatccaagttcacagatctaagaaaagacagaattaggtaaaagcacagcctagagtgctgtctccgattgaggctttttatcatctcttatctggagtctctacaaacaaactgagctgttctggcttcagtcctcttctgctgctccaccccctttgctgatagccttcctctccaaaagccatggtgcttattctaaaacaaacaggatcatgatcacggaaccccttagtaccatcctaccccctctcctcttgtaccatggaactcaagtttgcatcccagctatccttctgatgttggctcaatttgccaagcttattttttatgcctatcttttccttttcttcaaatcttcagccttccttctgtgtctagttatggctgtgttcttattcccttaaagcttagtttaataatagatttttccctaattttcctttctgttttcttatgactgacactgttctttgcccttcactgttctggttttccttcagtgaaaagttttctagagcctactatgtgccagacattatggttaacaatgggaagagaaatgccaactcctaacctgatgtcctgatgtgacctaatacattttgagaaaatagctagaggaaatatatatacatatatatatatatatatatatatatatatattagatattttcttcatttacatttcaagtgctattcccaaaggcccctataccctccataccctccccctgccctgatccccaacccacccactcctgcttcctggccctggcattcccctgaactggggcatatgatcttcacaagaccaaggcctctcctcccattgatggccgactaggccatcctctgctacatatgcaactagagacacagctctggggggtactggttagttcatattgttgttcctcctatagggttgcagacccctttagctccttgggtactttctctagctccttcattaggggccctgtgttccatccaatagatgactgtgagcatccacttctgtatttgccaggcacccatatacaactaccaaatccaggcactattgcatatgccagaaagattttgctgacaggaccctgatatagctctctcttagaggaatattaaaacctaaactcttgcctgtttgtctatatgagtttgtaaattgtaatagcaatgaagttaatcacagtagtgaattatttattcatggaggactcattcctgcaaagtagatctctcttctccagatttacaaagtttaggcaatctgaagctatctaaacagaaacaaggatattctaaagagggacatttgttcttctctctttgactatcagtctactaaaacaatgaactcaaaggcaatggaatttccccaggcatctcatattgggagaaggaaaagaactgaatgaagcttggtgctagccagaagaggaagttgtctctcaggaagagatttcacacagttctgacaacttatcagatcacctttcaggacagcctggagcctacaaggatgaaggctcagtgctgaataagattacaacaggaccagaactgctgaattaaagcatacctcttgctctatgtgtaaagctaaaactcatgtcaggatcttggtgtcaagtgcaaaggaaattccattaaacgcacgttgcaaaggtctgagggagtgatttaaagtataagaaatgcttcagatttctttccctcttgatttgctatcattatatcaagtctttaaaagttcagaattttaacatattaatcaatatagttttctttagatctgacatttggaagatgcacctgggagacactggactttgttccttttccctaagtggccacatttattaaaccttttcctgctttcatgattacttatatctttaatattgcgttggtaggaagctatacctaccttactgaggttgctgaagttcaggctttaaacgtaaggacttctggtaacaaagccttaatgcatacccctcttctcaggcttcttatgggtttcatatgccactctgctggtcattttctggattttagtttgttatagaatgattcaaaacaaagcactttatgtttggagacaaatacacctacattcaaatacaaaccccattataaactatggtcttaggaaatttaaatgactatttctgtcattcttttctactcactggaattgacactttcctgaaaatacaaaatacttgattatttgttagatacgggtttcaagcttcctatgagagaaaaagctttaagtttgttattaaacttgttccagattacccaaagctgtttcacctttccagtcctccctttgggacttcctctggagatcctggtctccactaaagattctttttaaagaatcgcacctcaccccaggcatctttgaaatccctgtccttttgttaaacatccatgaggctggttagtttgactttatctttcaatctgctttccttgttttaaggggaacctttgctcccctacaaacttctttgactatttcgtagatgctaggctttcctggaatatactggcctgggtcttttgaagacaaaactggtcttcaaaacacacaaaggccttttctttctggagggaataaagattaagtgacattttctgcatcctttaagcattgagtgagcattattttttctgtgactccttaattctgcttgtgaatatagaagttcccttaaagtcaatgagacagtacaaagtagtccacattgaatcatgataaaattgcataaattcctttcagtgcctagcttgagagaccacagtattcttttggataataatgtttaatgaaaaagaaagaatttattacaaaaattttaagaattctacagcagtatgtatacttccttcccaaaaaaatcacatacaatccccaaaatacaaaaaaagagtaaaataagtattttgttaataagccaataataaggaagaaactgaaaaaaaaaaaaacctgaacttacaccaaagacagtttagttcccagcaatctctgttttattttggttatataatgttgagaaaattctgatgtactctaataatgcatcttatcaggtaaagggtttttggattaatactttgcattgccatctcaagaaaaaacccagttaaacagaaacttgtatttcccagtcaatttcccacaactctctatctttttcagtcaccacccctctcactcattatacatacacacacaaataaactttgtactatatactaacatgatagtgatgtttcccaatatttaaatatatggaatctaacacatctgcatagtgaatactttgttttactactttttaaattttaagatatatttgtagtgaaacttaagtctgatagtgtagaattgttgaactaccttttcaaccatcattaaaagtcataggacagtatgaactgctatagacggttgaaagaagaggtcaataaacactatagttactgaaggcttcacaaatgtactacctaacctggttctcaaagagacagtaaacaaaatatgaaacaattcttctctctccattttctggaagatcccagacttcaagttttcttctctggatctctatggatatacatgtatttctgcctgaatttatgttttacattaatattataattatattagatggctctaatgaaagcatggagatagaatcagtgttccatcaaccatataatgtctatgaggaaactaaaaggacattcttttttaaaaagaaaaaaatcattttattcgtttacatttcaaatgatatcccccttcccagttacccctccacaactccccctccaattccccttctccctattcccctttgcctctatgagggtgcttccctacccacttacccactcctgccttacccctctagtatccccctacgatggggcatcaagcctccctcccctcccactgatgtcagataggaccattctcggctacatatgtatccagagtattagctctcttcatatacactctttggttggtggtttagtccctgggagctctgggtggtccagttagttgatattgttctccttatggggctgcaatccccttcagctcctttagtccttcccctagctcttccattggagtctcagggctcagtctgatggttggttgtaggtatctgcatctgtattggtcaggtgctggtagaacctctcagggaacaggcatatcaggctcctgtcagcaagttctccttggcatcaacgatagtgtgggggtctggtgtttgcagataggatggatctgtaggtgaggtggtctctgggtggtctttcctttagtgtttgttccattttttgaccctgtcattcctttggacaggaacatttctaggtttaaaattttgtgggttttttttttcaaatctttattagatattttctttatttacatttcaaatgctatcccaaaagtccccgatatcctaactccaccgtgctcccctacccacccactcctggatggccctatccttcaactggtggggccatactatctattggaggtcctctctacaggttgtctctcccttttgttaggtattttgggtaaagtcattgtcattggctcctaggagcctttgacttccctggggtctgggacattctagtggctactcccagattcccattctaaaaagggcattcttaatcaggcatggtggaacatgcctttactcttatcattcaggagacacgtgcaagaagatctctgtaagataaagtccagactggtctccatagttagttctgggctagccagggttgtctcccaatatatttttaatctaaaaaggcacctttcccactaagcaaatatagctctgctctagtctacacttctatttgagtataaagcaggctctatatttgacccccagttgacctcagtcaaatttggttttgcagtgaacactgaataaccacctagtgcagctatagcaagtataaatatggttacgtgtgacatgtataactaaatcacaggatgatttttgtggagcaaagggaaataactgtacagagttgaaacagggtcaagttatggggggccttaacatcaaaaccaagatgaattcggcttgtattgagtggacatgctgctgttgagcaggggaaggggtaaaagaaataatttgggaggctaacacaaagaaagagcctagaggcaaagatgaatggatggataaatgagtagatggggtcatagtaaggatataggatacataccatcaaatgttcaaacaacgattaggtataagaagaacagggaaaacttaatgaccatcttactattttccccgaatagcagttattgaaatgctttgtaggtatagataccacggatatgtgtatttgatactgatataattcataacaggagattccattggacagatattgctacagacaagggatggaattaaatttttcatcaaatttcatctgcaatatcttgggtttttttttctacttgagaaaatcatttaacatatttgtgtctcagtgttctatgtgtgaaacaacagcatccaattcattggattactgaggtagataaagagaaaatatctataacacttttcatgtctctcctggtaaccagccaattcccttccattggaggcacattctttcatttcactagtcaattatgaagtcactttcaagactttcaagtcacactgccttcgctcttattaaatattatttagcatgtttttaccatttgtataatttcttttctgtaaagaaagcttaacacatagaatttggaatttataactatcaaatttagtgggcttttcatttttgttgttgctgctgttgtttaacctcacatttaaggcaaaagaaaagacctaggagaaattgggggagggaaagaatgtgatcaaaatatattgtatgaaaaatctttttttaattgggtatttatttcatttacacttccaatgctatcccaaaagtccccgacacactcccccacccactcccacttcttggccttggctttcccctgtactgaggcatataaagtttgcacgaccaatgggcctctctttccactgatggccgactaggccatcttctgattcatatccagctagagacacgagctccggggggggggggtattggttagttcatattgttgttccacctatagggttgcagacacctttagctccttgggtactttctctagttcctccattgggggccctgtgatccatccaatacctgactgtgagcatccacttctgtgtttgccaggccccggcatagtctcacaagagacagccatatctgggtcctttcagcaaaatcttgctagtgtatgcaatggtgtcagcgtttggaagctgattatgggatggatccccagatatggcactctctagttggtccatccttttgtctcagctccaaactttgtctctaaatcttataaaggaaaaatagaaagagaactgctcactaacacacgtgggtgcgggcatatttctttctccctcttctccctcttcttcctccccccaccccctgtgcatgtgctcatgatggatcccaggaaaacattctttgctaaataaatggtgtactcttgacctacctttccagccctcatttttctgagttttatgtctcagtggaatgatgagaacaaagcagtagtatattatgtgacaagagcttgtcgctgcaaccctttcatccccacattctcctgtttctccctcctgttagatctgcctcttagtcctttacacccctaggttatgctcataactgaaggacagtagtcatgctggaagacttgctctgaaatccagcaattgctttgaacccctcagcttgaatttgccaagtcactaaagtcccaaggttcccagctttcctcaatggctgctgttggtgaaagtcttaggactgataaacgcttttctctttactaactcctcattttcagtaattttaaaatataaaacatagtgcttccaagcgaaattgagtctaattcccttctgtggtttgaaagattcatatacaagcatttatctgtaaatctagttatgctcactctgtaagctaacagagtatgcctttgagggcttttatggcactatatttgaaaattttctgtaatttttgtgctgcaataaatatggctgtacctgctgaaccctatattggttccactttgccttcaatcctttcccttggcctttatacctccttagtattcctcagtctctttatgtggaaaatttaaaagctagctcatatagttgggaggattagttagaatcttcctaacatccttaattactatatatgctcagtaaattgtagctgccacagacagtgaattgtcatgctgctgggctgtggctcatcattttctaatcccctctacaatatgtttctagtagacagagatcttgccaagaagacaaccaacaattactgccttaactttctgtgacggtgctcttcattaaactagtaatagccctatatctattagtagagcttgttaggggaggatttgtgttcctctgagacttagggataaattaacttaaagattagttagctagctttaaaggtgtgtatctctctctctctctctctctctctctctctctctctctgtgtgtgtgtgtgtgtgtgtgtgtgtgtgtgtgtgtgtgaaatttcatcccccagttcataacactattcttagcctggttatccttaagggccttaggggataaaaaaaaagatatttcctccttctcctcctccttgtttgtacagcttttatcacattcttctgctaaaaagactgacaggtagaggtgccaactcttttagaaaggatacctgctaatgtcatactggcctggggctacttattctggatgagccattgaagaaccacatgactttcagtcactatttacttggaagagaatgagaggaaggatttatatcaagttaccagtcccctgagcctgtcctgtcctgcctgagctgtcctctttatttttttttttcatgtccactattaactgcaagtagcaatgacatgcttctgctcatattcataataaaatcgaataacatttaaagtataagcctttgagaaataccaaggctcttccagaagctctgtgcccagagaaaagcagctaaactaactgcccactgtttggtaggtcacttgaccttatgaatggcattccttctcctaggatagaatacattgcattgctacagctcagttctacagttcagttacatgaaataaccacagttcattccttgtttatatatacagcatggccactgtggtcactgtggaagcaatacctgtttctcaggttaggacccaaatggagaagatataatctgacatactgcttgttgaagcaagacaaagagagctttggaggacttttactgtgttagtaatcgaatattatttacaggtgggatgtgtgtcccttttttctcacatgcatcgatcagccctgatgggaatcaagaaaaaagtcctagcatgtgtcttgaagaaggagggcaggaaatattcagtgaacggcagtaatgaccttcccacatcattgtttacttaaccgtgtaaaaagatgttgctgatctgtctgcaaatatttttctgggtccttgcctctgcagaacctgaacaatatttatctgtttgatgacttcgaggatactgcaggttttgctgttcagtgtgtgtgtgtgtgtgtgtgtgtgtgtgtgtgtgtgcacgcatgtgtacaaacacaagattggaatttcttttaccatttggtgttgtggcttttgtacctcccagtgataaacagatacattagctcagaaaatgtagtgtcaaggaagtcgtcttcctttgatcctcacttgcctcctaccgtttactgctgtggtgaaggaataactattattctctgatcctttgaccataaagatgggattaaattatttgcccaagggcatgtgactaattgttcctgcattagaggaagctgaactggaactcaggattgtccttttactgtgtcaggtcctactataaagagccttgtctaactgattgctgtgatttactccctaaaacaagtggtaacaacagaaactggccctttaatcttgaacaggcgaaaatttacatctgaatgccttcttttaagtattttgatgaattgaattccaggtcataaaattagattcccagaattcttatttcaacaaacctttctccaagcaaacaaataacaggccccatgtgggtcagccacaggagcctgacttgactgaaacaaagaattcatgctacctttcctgcatttcaatgtaaaacaagctactgtatatatacttttattctaggttggttttctgctaatagttgggatgtcagataatgaccaggagtaaaacttgtaaatagagttggtggccttttgaaaacatcatgtaagcatcattgtactgtcttgttgtgtcaattaggagttacactgggtgtgacaggctgttgtatatatcatgaagtccttcaaagatgccaccaccttaaccagattgtttcttgatggcttaataaaaggtcccagctgaataggctactcctaaatatcgtagatgaggggacatcgcaattataacattccattacacaggcacaagattcttgttagaacacatgacaaatgtggtccagaatacctatagaaatagtttgagcaactccaatccaaaatccagtatctaaagtgctccaaaacctaaagtattttgtgtgccagcatgaacccatgaggacaaaattctaaactatgaaacttttgtttcatatataaaattattaatgaaattacctttaggttatgggtttaggaagtatatgaatgacacatgagcttggtgtttagacttgagtgctatccctaaaatatttcattatatgcatataaatattccgtgtcacccgcttaaaataaagcataaatacttcttttgctaaacatttcaggtaagaaccagtcagtgtgtcttactcaggatgtagacgaggaatttgagttttatatggtttataacttgtaggctagggacctgtcaaaaacatgtcacaaggaaatcatttgaatattgccctaatattttacaagactcatcctctggtgccagttgatcttgtaactcttcacactgaaagtggcgttattcatgtagaatcacaaggccatcagtgcaatggcagttttgttcatcacatgtgtgtggtaatggcgctctctttcacattttctcacagagtcttttattatattcattaagtaataaggtcagggttttatttttttagaaaatttcatacataaagcagagagaacagtacaatatgatcccgtgttcctgttacccatcttcaactgtctccaactctctgccaatctgccatgacctttgtgaacattatcataatcatttgcattttgtagccatggcttgtctttttgtgcccttttactttctacagtaactatgggtttaaatgttaggccttcacagaatcgaggaaaatttatccaaacgacttaaaaatcgtctccaaaataggcacatcattagaatagctacattattagtgctataagcaatttttgtgaactactgagaggtgagtgagctagcgttgttctattagacttacttgtatcaaataatttaagagctggaaaagcattttgcttcttattacttgagtctcacatgtagatgtgtttatggggatccaccaatttttaactttaagaaacattgttgtaatatcaaaccaatataacacacatacaccaacacaaacacatgcagagagaaaggcagacaaacacagagagggggaggaagggaggagagagagagagagagagagagagagagagagagagagagagagagagagagagagatgcagagacagaaagggaaagggaaagggtcattcttttttgggggggttcaaaacagggtttctctgtgtagccctagctgtcctggaactcactttgtagaccaggctggcctcgaactcagaaatccgcctgcctctcccgagtgctgggattaaaggcgtgcgccaccactgcccagagaaagggtcattcttaagttcatgaattaaaaaaataaactaaattttaagtcacttttaccattgtttaatattagtccattcattaatcttaagagctcttcactatacaagtgtcctactttcacattaccctgaatttgcagcaaaaatacaagtaatttgtacaccattactaatatctttctttctctgtttctttcttttgttcattctgctttgtgctaagaatttgtatagaatagttttgaaacataatgaataaccgtaaaggctgagtcactgaggatatttgtaaaggaaggttgtaaacaatatctattatgtatttcaacaataataatgaatattcttacagtaatgtgtgtctgactctatgccataaataccgttattaactccattttacaaatgagaaacctgacactcagaaaagttacatggatggctttctgagaatcatgggctaccaagtgaagaaagcgaaatttgtgacaatatctaactagactctaattggtgattcgtcattaccatgcacccttttatcactaaatgtaaggaagggcaaacaggaagaatggaaaaggatgcaaaattctatgcatgccaaatatatacttaggtctctaaaaaaaatggtgaatctgtgggtttaaattcaacagcagacattctagcatgattttccttttctgactaccactcttgcattcaaaactactgtccacttcacctttgccaatacttagttacctttcttgattctcaatgttattcctcaggcagaggatgaatattatagtcagatttccttcagatgtcttatctccagtatgcagcccaatatgcactatttaaaaattctctaatagcgccagacaaggtagcactcttacccatagcacgtaggaggcagaggcaggtggatctctgtgactttccagctagtcgtgattatacagttaaacctgtctcaaaaatagaaaacaaaaaagaaagaaagaaaaagaagaagaagaaaaggaaaaaggaaagaaagcagaaattctttttaggctaggcttctaaaagtaataatatataatgagaactattttttgcaactaatgaattaaaatgagtactattcttttagagggaatattaagcaagcttcaaagactgaaatgatgaatataataatgatgatgatactaccatcacaaatctggttaaagagcactcttttatctgatttgaactaggagtgggttacaataaccattttgtatatgaaagagaccaagtcttaataataagtgatcatctatacgacagacagaacaccatttacacagccacaaattgaattggtcagtttccctacaatcctatatttcttgttattctagccgttttgtgacccaatacaatcccacctgagaaaaaggactcctattctactaaaagcttcctctgggccagccacttttaaccttttaataccttggttgagaactgtatgattgaactctcaaaggaaaatataaaataatccaataatatctttattaacatttattaattatacataataatagttttgactgtggtatatggaagtgtaggtatatttcgattaaaaaatcattgtgttttaagtaagattatatatatacatatatatgtatatatgtatgtatgtatatatatatatatatatatataaactgctaggctgcatttatagcaattctggaactgtaggttgggcatatttgggagacattaagctcgaatatatttggttggagtgactaagggaagaacctatttgggaccactgtacttagaaaagttttcttagcaggatttatgttttgtttgcagcatgaaagaatgattttgcagctttgctcttccatttatagatcttatgcacaggaaaaaaatgtcttcccttgattctgaattgagatctggagagttaggtaggtgctgtacgagaggagtttgtgctgtggactttttgtggtaaattttatagtcctttaaaaatcatgtttacatgaaatcaattagctggaaagaagacaaatcgtactcatttgctaaggttcattgaagtagtgctgcctccagagcataagcacggactattctggtatacttccattaatcccttttctctgaaatcctctccaattggtcatctagactggagttagaaagtgctgagcaatggtccaaatctgctttagagacatgtttgtttttatcactgctcattttttgtgagggcagagtttcaatggcttcatggaaagagcaggactcagagcccataagcttgcctaagtgcccgttaacatgctccatgtgtgctactgtcatgaaatgccagggtgttagaagattgtgtttttcccaagtgtgatgagttgagtaagataagtttcttcttcctccatgttgatggagagtgagccttaggaatggccttagcattaatatcttaaccaattacagagaaaatttagaagatagcattgagatttcttggacattagatccctgtcctgttatatttcattcttccttagagcattttctcttgaaactgatcattcttgtagttcatagcaaattgaatataatcttttcctcctccacctattagtcactgactacagagcataatttggagcagttttgttagagtcccattcagaacacactgaaagttttatgtctatgaattccctgtgctctctgttcagtgagcatagatttaatcctcaactcaggctctttgtcacaaattacatgagagaatagaatctttaattaatgtaccaagaggatgtgatgcttctgaaactctctatacagataaaaactagtagccattacccacactgcccctgaaaaatagcagcaattgacttttagcccctacttgaccattagcttttgccatgggaaaccactggactgtttagaagacagataaggctgatgtttcctgtttccagcaaaatagtggaaactcatggctacaagcattgagatgcctatctattccgatgcctaccgtctcatcttttcatccagaacatttattatagactctgctccatagcctgtaggtagagtggaatgaccccaacaattccccccacccctggatgtcatgattaactccataagccagactctccattgaataaactcaatcatcttatttctttttttattagatattttctttatttacatttcaaatgctatcccgaaagttccctataccctccccctgccctgctcacctatccacccactcccacttcttggccctggcattcccctgtattggggcatataaagtttgcaagaccaagggcctcatgtgctctattaaatcaagtaccttcttctacatgaattgtcacattagtactttcatttgggctttacttttttttttaataaaatgatttttaaactaactcttatgtagcccagaatggccctgaattcacaacacaggcaagattaaccttgaactccttcctgatcttcctgtcaggataacagttatacaaacacttttgtagcattgctgctagctgttctgttgcatgaagaactccaaataaaacttcaacaacaaacccttgcttttagttggcataacaactgtaataagaaagaattacaagaatggcaagggtttgtctaatattggccctacattaaacccttaacagcacaaaacaagaatcctaactatttaaggtatacattctcttcaaagttctgcagtaaggtacaattgaccttctactttcttcaaccaggaataaatgaatcaaatgctctagactgtgcagcagtgactaataatcctttcaatagaaagttgcctcctcagccttgattctctggcatgaaaacagcaaatttattggtcaggcctccaggctgtgcagatttctttttatattacaccagaaacgtgttaactgtaatgggaaattccgggcactgcctcccaattcctttgttatgcagtggttagttgatcaacagctgtgtgcccacttgattcattataaactggctgtcgaaacccactttcctatgtcaccacagtctccgtttccatatactgggaatgggggtgtgagtttgtgtttgacaattagaatgtcacagcggagctcaaagcatataaggctcttgtcaaattggtgaggtggtagtagaatacagagatagctccacagatctaactggcatgtcaaggtcatgcatccttcttcttcacttctgcttcacactctttctgcatttttggctgtactgtatctacttgaatgctttctaacacgatatgattactcacagcaagctagaggctatttctatccatagtcttgatgggaaagggatacagaatctctggccagtgtgctgtcctctatctgcaacaatgtaaatcagtgtcctagtgctgtgcatagttataagcttgcgttacataccactcttgttttaggaaagctagttatgccttcaaatttactgacaccatcaatcactcacagagcaacctttttggataagttcagaccacatttcctgagttttctttaaaacaaacactaatgcttttattctgaggcttttttttctttctgataaggattatctcttccctgttttcattgagattcatattcgcttttgtgaaaatgcctgggtttgccaataaaattcagcacaccccccccccaacaaacacacacacacacacaagagccacccctgtggcctttctttcatagtctccataaatctcgtttctccctttgatcccatctctaccctcaacatggaacaggctcttcctctgaatagcactagaaggggcaaacgaagctaaggagatgatgcacttgaaatgccttcaggatctgcaataaagcttaatgttctaagcattaattttggcacacacaggcacctggattttcaagtctcagataattgcaattccaagtagttgaagtaaatatctcattgtgtttttcctacagttatattagaacattgtgaatcacgtaaattaacagatgacctaatattcttatctaaccctctacttcagtgggttgagattaatggaaactcagtaccaattggggcaaacctttgactctgccactctgacccttaggcacttaacttcatctctctctaagttgcttcatttctacctgctgtgctcattgttaggcctctagccaagtttccacataataatggatgagtatacaagaccctagacattttcatagtctttatttaagacttctcccttctatgtctcaagaaggacaaatttacctagctattttatcacctggaatcttgaaattaaagggtagacttattaacatgatcatcaatcttgttttttgtttcctcatattttaagacactttgccaaatgaaacagagctcctcaaaaagatgttatgaccctggcatgtaattatgatttactggtaagatttttaaaaggagacattaactgctgcctaccttggtccacctctgagcttatcttccctgcacattaatcgccacatttgagtgcaatttgtttatatttttcatttacctctcctgtgccctaatttttcatctctgcagatgttgatcattttaccctctgacagatttctctgcattctccttatgagttgatgtctagacagataactgttattaaaagtttaggggaaattgttgttttggaataaacagtctctgtttaagctttaaaaagtcaactcatttgtcattcatacaagatgaacattgagttttttgtaccagtgtcacttggtaacacagaaataggaactagactgttataaataattagatatttgctatctagtgcaagttaaagcccagttcaccataaaagagtgacactatattattaaagatgcatatactgagaggatatatgaatgacacacttataggcaaacattctgagatggcacaattattttaaaattacaacataaatcctttctgaaagaattttggtgcatacagaatgtggattatcttctaaccatgatatctctcaattctttcatgtttaatttttaaaactctatggaaaaacaggaaatttagtttctttaaactaaaagtcaatatttttcttaagaactctaaggtagcatctactctaaatatctgaatccctttctccttactgaacacttcttcgagtctctgaactgttttactgtgttcttaccaacacacaaaataaaatgcttttgctcagaataagtgttcaattaatgttacatcaacaggtcattcaagattacggaagtccaaaattatggagggtcatcaactgaatggctatggatcatggtttcttctggcttccctgttgtaaagccctctctacaagaggttgaaagcattccatgggctccactttgaattctacccctgagataggatcttcagaaaacatactgatccctcctctaaaattctttgtcctgctgtttgccaaccactctctggacttccatccttcaaaactcagtttcttgctatctctggggggtgttttcttctgaaattcaaaaaggaaaatcctggggaagacctcaaaggatgcaactggaatgagccacttgagataaacaaacacattggcgctcccagcttagggaaaacattggagacagtctcattcatcattccttgggagaactggatcatcctcacctttgatctcacagtgtcactgttgttcttgataggagcacagccttcaacacaaaatttgatatctgatctactcccagcctaacgccttacctactgtctttgaagggctagaataaaaatgaacagtacactggagcttttagttagtgaactgttgaggatttctctctcccgtagtacttagacgcacaaaaggtagtgttagactcagatccactctagctttcccacttcctagcagtgagaccttgcaaaggtaactttagtcctttgaactgatccaagcctgaaattagggcactggtaagataagattctctatctcacagaattgtgaagaataaatgagctgctgctgcatattatttagtgtactaactgaatgctgccgagagttgttcccaccaccaagtgttgtgataactgttatcgtatcaaataacttgggtttctatctgtgtggctattacagtaagtctctgggatgctgtattggccacagtttagggagagcaatttactagacatgtttcctcatatttttagacccacttattttgcccaaagttactgtgtcttttgtaaacatagcctgcttaaaagttaggcacagcacatgcaaacttcttaactaatagagactgaactactaatcatgtcgctaatctcagtagacattttcccttaataactgcaagagtccactcctcaagtggtccacagctgagatttgaatggaaatctcccctttgttacctactgaaacaatacataaaaccataatatataaagattatagaagcagagtttcattagcatgacatttttcataagttcatgtatgcagtatttttatgacactctctacccaaaaaaaagaaaacaaatgaaactaggtgaaaagaacacttggcttttatcgacatttgtaattcaatttgttcttcatttttctaaatgcaagtgaaaaaattaaatttcatatagatgtagtaagtacaaatggctacagaatcagtcttctgagaaatcagacttctcagggcttatggtctcataaataaagaatttaaaaatgaactcaaatggaaacttaaggacatttttattacagtttaaaagaaaaacatcatagagcaggcaagctgtaaatatttgcagctgccaggaggagaaaaatggatgctatttgagcttgcatgacagcagtgtaccacatggtcggagtggggcttttagagaaatagtgacacccaaagtgttagggaaaaatatatttagccaggcttatagcaagccaacttaagaagctgctgcactgtaggcttataagctatagtggtggttatgtgggggcaggaattttggaaaggacaagtataaagtatagtgtctctttaaaggattaattagtcaacctatctctttagcatagattaagaccatcccaccttcctagaggtagtaccacctaattgatgttggatctctatccaggccagagattttattctctttaccagttttccctgaataagcctttatttttactaaacagtttcattgtctgaataagtgaaccacaaacttaaaatgatatgaagtatgtagctcagtgataagagtacttagactcctagaatccatgaagctctgtatctatgaacttctgcacctcaaactacagaggagtagggtcttagatatgccatttcacttcctcaagacttccctgattgtaaaagaaaggtcatagaccacttaccctctcagaggtttgtggcaatcaaataaatcattgttatgttctttgaagaacatggtagactggccagtgtgctatgtacaagcaatcataaaatgctaatctgtaacattgtgttgagcaaccatctaaaagtcatgagcaatcacagcaaagccattctatagcaatttgctttcacagttaataattcccatagcgaaactccagatgtaattaagaccatgagagtaagatatggatatacaaccttacattctagtatgtaagattaaatggctttttcttaaacactccgagaacacttgcctatttccttccctccctctccctatctttttccttcctcccctccttccttctacaaaaattccagcaccatcagattttttttcctaaagaacttaatttctaagggaaggcaagcacacaaaaattctctccacataattagatgacattacagagtaacatgaaacttattataaaatctcagcacagaagcacttaaggcagtcccagtaggacagacggggttagtgtacagaggaaaagaaagtgaccatgtcaggtccaagtggctgcacggagcctatagttagagtgactaacaacactggcatatatgaggaatacaaacaaatcggtgtttgtaagccaacaagtgccagatagaaatcacaccatggagaagctcggataacatgaagtcagtcttttagcatataagtgagagtgttctagcagattctcatctaaggctgaagactaggagctgaacagaatagctaaatgaattttttcctaattccttcagagtaaacaggagattaagataaggcaggagctatggcatgtagaagttaagtgggaaagcacacttgaaatatttatgagataaaattgtcaaaatttcatgatttagtacatttgtggtaagggcagaggttggtatcaaggacaactctcatcctgggtttctagctatgtgatgtcaatgactaatatgaataaaaatgggaagacttagaagacattatacaggctcagtttattgatacaagttggatatgtccactgtctgttggcttatacaaggtgaaataactgtagaggtattagaattcgtaattttttggtagagatttagactacatatagataccagaatgtcaggcaaattggcagtagttgaaactaggagtggatgcatttactcaagcaaaatacatggtattaaaatggaagagagttaaatttaggatataacaccaatatttaacatgtacttccagaatattatgctaaatattagaggtctcagaccttaatattcaactaagtgtcttacaccttagttaaagatggtaatgaatttgaaatgattcttttatgtgcaatgcttttgagatgctgtagataacagggatgaagctaagtaggcttttattcatgctttaattaaaacagtctcctctctctctctctctctctctctctctctctctctctctctctctctgtgtgtgtgtgtgttttattttattttactattgtaggcttggatggtgggagtgtgggtgagagtgcttttattttaaaagacatgattaccaaccattggtctaaaagactagcattacacatagtaaactctagtaaagtagcagaccactcagaatggattcacggtgtgagctatacttcaggtaagaacacaatgggaacctgtaaggaaaaacatgtaaaagtataagacagagacaggaaaatgaacagttgaaatattttttaaagaagtggagagtatagtatgtgaatattttaactcatactagttagagcttccagagtggggaggagggaagagttgaggaaaagttctagttgtaaacataattcttgagcatttatcatcagaacaagcaaaagatgtgaaaataatatcttgtaaaatagggttaaagagagagcacgcacactctgaaaacattatattgaattctacagacatcatcaacaaaagaatagactccataagcagagatggatcaaatacaaaagattgtcaaccacaataacatattaaaattcaaagtaatatgaaaagacaatcctacagcttccttcttataagtgtattttaaaacatctccttcaattattgatacttcaaatatatggaaaggcagcagaaatgttgcatatttaagcaacccagcaattacagaatatgtattattgttaagcagccatagagcatacataaaaataagtgtagtgtatgttactctaaaacaatgacaacagaattcaaagaaattgtatccacagagcatgttgtctaatcacactgaaattatatgaaatggtttttctttgttttgttttgttgtttgtttgtttattggaggggtggttttctttcgttctgtttttttttttccaattttttgagacagggtttctttgtgtggttctggctgtcttagaactcacactgtagaccagggtggcctcgaattcagagatccacctgtccctgttttccaagtgctgggattatccaaaagatgattgtcaaaatgcctgtgtggtgcatttacatactaaaccatatagaactgtcaagaagactaaactctagaactaagcaatggaaatacataagaaaacttgtgacatgaagtaaaaatgcagacgtatagaggaaatatgtaatatccaaagtttatattaaaaagaaaactatgcacatagatattcagctactataagaaaaataaaaagaaaggtaagaagagtaactaatgaaataagaaacatctgaattggagaaaaccatgcacttaaaagttgattcttctttggaaagtgtaattaaagcaaaaaaaaaaagaaaaagaaaaagaaaaagaaaaagaaaaaagaaaaaaaagaaaaacctggcaaattaaaaagaggcctcgaatagtcaatattataattaaagagaacatactgcaaatgttccagttattaaaaacataataagagaatattgtgaaaactttgtgccagcaaattttaattcaaataaaatgaacaattttcaagaataattatgaaagaaatatttctccagcaaatgttaccagagttttataaaaaaaaaaggttatccaagtctggatataaatttatatataatagttatctaagaatatggaaaaggaatgtctccgctgcttcattctacatgatcaaaatgatatcattcagaggatgggcatggggagctaatggtaaaaagagaaaggacaccaaagctcaggttatttataattatcttaaataaaatgttaggaacctaaatccaacaggatataaaaaaaggaaaatctatccccaaaagcaacagctttgtcaaaacacatattaatataatattaatagattaagtggagaaatatggtcactaaagagattttaccacaatactgaagtcataattcctgatgactcatttcaccttctcggagaatgcaaactccacagagtttttaaagcagcaaaggtttcaaagtagttatttactcttattttttaattaagattctttcatacaatctattttgatcatattttttctcttctcccgattctgccctgatactcctcacccacttccccatctaacttttatgtactctttctttctctacataaagcaagaaacaagaaacagaaacaaagaaataagaaacaaaaccaccaaaaagtaaacaaacaggcaaaagataataagacaaaaaatgtgctgaaatgaatcaaagcaaaaaaaaaatcagcaaaattacaatttagttcagtttgtaccatgaaatggttaatacccactagtaggactccactggagaaaactgatttttttttcctttcctagtaggtatcaatagcacatagattcttgctcatgaggacggctccttatccacgtgcctctctcaatgatggacctcaactgtcttgatcctgtgcatatcttgtttctgttgctacaatctctgtgaattcagtcctggtgtgtctggaagatgccatttctttgatgtcacccaacacttctggctcttactatctttctgacacctcttcatcatagctccctcagcattgtggggaggagtttgatgaagaaatcccatttaggactgagtactccgaagtctctcattcgctgcacattttccagataggtgtctctttgttaattcctatctaaaggaagaacattctctgatggaggttgagtgctgcaactctgtgtacctgcccagtgtagctactgggagtcctagttagaaagtatttttgcaggtcagggcactgacaaaacaggctgagaggcttcatggaaatgagctgggggggggggctccagtggttaaagggttttatcctattttaattgagttattgcctactaccaagtgaatgtcatgaattttatttacttaaaaaaatcttctctggtgggttttgttggtgctgctggtgtttttttgttaaggcttggtttggtttttttgtttgttttggtaatgaagttgcttttgagtcatctgaacttctttaagttacccctcacccacactcctgtgcataaccccagcaaactcataagttggcaaagtaagtagagacatttcctgattacaaaaagtacgtcttaattgcagaaagcacaaagaagaaaaataagcttgcccattatttaatgatggttattttttttggcacgtgtagttgtgtgtgaacttaaaaacataattatactgtatatataatactctgataactttcacacatcaatataaaaatgtatccatctcatctcttatttgtttatgtagtatactattactaagtagttttgtgttttcattatagaattttataaataatgctacaaaaagcatcatattcctgaatctttatatttattagatcttccatataatttgtaaccacaagtgagagtactcttgaaaatgtgtgtgtttctaaagactcaggacattactaaaaatgaacatattttattgccttttgatctattttcaaacacatttatttttaactttatatcttataatatgtgtatgaatgttttcctgcgcgcgcgcgtgtgtctgtgtgtgtgtgtgtgtgtgtgtgtgtgtgtgtgtgtgtgtctgatgcctgggaactgggattgcagatgatattgagctaccatgtgagttcagttctctttaaccactcactgagccatctctccagtccttcagatatatttctaagtacacatatgcactcaagataaagtgaattgccatctcaaattatagcttaggagagagttggttattagtttttataaaaccaaaaccatattccataagataacccagaatatatgccaagtatcataaattttaagtgtaacaaagagaaattacaaaaaaaaatctaggaaaaactttagcagatagtattctcctgattgtagtataggaaacaactttctaaatatatgcaaacatctggatgcataaaggaaatatcactatattggaccattttttaaacctgttctcaaaaaaatacaccatagaatgtttagaagagaaatattacatttagggaaatatatatcacatgtgaaagaaaggcttaatttattactatctgagaaggttatgactaattatcatttatgtgtgtatatgtgcttaaatacagacacacatacacacacacacacacacacacacacacacacacacacacacacacaccagcctttaaaaaatagaattcaaagctttatcttttggccctttcagggttggaatttgaaagggttcttttctgaaaacggactgtaaattgcaaaaggctttttactctgacgttcagatgagatgaggcagagcaatttcacatagttacatttggacaccagatagaaggtacattcctttcatcattgctcagagagatagctctagtttccagttaagggcaaaataagtgggctatgaaaatcttgtggtgactattaaaatgctgaaaatgtatttcatgttaaaatgagtaatgagttggtgctatctatgtatgatttatgaccaaagtcttgaacatcacagtaaagaacccctgcattttaagagaccctggaaatgaatgggaagaagaaagggggtgatgggatcagcgaggaagatgcaaaattgaactatgaaccaaagaacttctatttccagggttaatgtcagaaaaatattagctcaccagtaaactgaactatgaaaccacttcttggaagattttcatagacacattttcctaacaaatgtgaaacttcactgacttccattttataataaagaaggcttagaattggtcttcagaaaagaagatgttttattggcagccacatagtctaggtagtatgtcttctagaaataataaggcatgccttgactggtagttatgatggcaaagacagaatagctttaagccctaaggaaaccaaatacatgcatgcacgcgcgcgcgcgcgcgaacacacacacacacacacacacacacacacacacacacacacatgagtaaactcctcgaaatctgccttctccactgtttgtcactgtgaaaatgtcactccctagcttacaactttgggtgaccatcacattacacaactggcatgaaaactgactgggaattcgaaagcttctctctctattatcttcatttataatttggatggctttttccatggtcccttttcattatcacactttcaaactgttgaataaggaaagatgagtcatcatgttattcaatgcttattaaagtctgaggctttctctgagtgtctcatcctccttccagccccaagctttctatgtgttcaaaagaatggtgcctggagggatagcacttggaaaaacagtacacttggaaatagttcaattgaaaactttgagacatgtttgtgacccaaataggaacatatcttattgtccttttgctcctgatttgcttgatttgaaatagctagagttttttggtttttgataaacaacagtctattgcatcccaatccacaatgtaaaaattatttagcaattcttaaagccattaactagcaaacagtatataacacatttaactggtaaatgtttaaaagtgtttgttatagctcttaacatagtattttttcttactattttttacagtgtgtgtgtgtgtgtgtgtgtgtgtgtgtgtgtgtgtgttccttacatggaaaccagagaacaatttgcagaggtcaatccattctttcctctatgtgggtttctggggttaaattcaggtcaccaagtgttggtggcaagcatctttacttcctgagccagctcactggactgtttatcttcaagaaaaccaaaatcaaaatctggagtggtgttctattaataagaaaccaagtaattttcttcctttttttgatacccagaaatacttactaatctgtttcctactcattaatgtcccttagtcacgtgctcaagtagatatagtgcctccccagagctttgctgtgtactaacaaaaggatgctcccctgttaaatgacttaaagattccatttcattgttacaatataaaattcacattcttctaattcttctctaacactctagctcccaaatatttattcacattgttctgttttgactttccttctcatttttttctttgtgaagtgtcatatacttactggcatattttaggctcatcagtcttctttggtcagtcagattatttgttcatccaagcaaagagatcctgtctcatacttttctgaacatcttatcttacctttttctttttttacgctcttaatatctggaggagttaatttaccagtctatgacaagaattgtcttccttctttcctttttctttttcttttccttttttttttcaagataggatttctctgtgtagctcttgctatcttagaattcactcagtagaccaggctggtcaactcagagattttcctggcttctgcctccccagtgctgggattaaaggcttgcacaaccacatctggcattagaatttcatttcaatgtagtagattccatgtgcaatcttacgattcttatctaatttttgaaccttaaatcttaaacatgtagctccaaagtgtttcattagatgcatctaagtacagctaaaaatcacccgcaaataatggtcaaaactatcaacatcaccctagaaagcaaagctaaacagataatgcttagcttgacttctaacaggatatattggtttttcttgttcatgacctttcagtattcataattactgtaaagagtttaaaaacattattctcagaaggtgttcaaaactttcactgccaaatgagtcagagacagaggggacaaaggaggccagtgtcagggacagtctcagcttgatgattttaaagagtctattctttacatagaacaaggggaaatttgcagaaggaattgcaaaagtaaagtgactcataatctgataatgcctaaaatagatgggcagcgccaagggcttgaaaagattgattcagcattagtcagttcttgctatgagggcagggtggggagagttcccacttagcttagccaagtgagctttatttaactttgaaaaaatactgttcacggttgtgtggtttgtttggtttcttcatttgcaatatttctatgaattactgctttgtaaatgaaacttttatataatctagtacagggtcgtgtgtgtataagaattgcaataaataatatgcttatcatgtaggggcttgttaactattttaaaacaaaatatcagataactattccttttcaagggacacatttttttgtctgattgaataaccaggtaaaatgaagtttgtttactttgtgccacttgcccaaagatgtgttaccctgagggtagtcagcacaagttctgtaaatacaggcagagactgatctacttaattgggaataaatgcaaatgaacactgtttccctacagtgtttttctgatataagtacatgagtatgccttttcatagtttttatttgagaacttatgtagccccttcttttgtttcttccttttgtttagcatttatgctttcccgaatatttttcattcattcaaattaatcttagtctgccaaatatgcacattgtactccaggactatggcagatgaaagggaacagaagctacaaaaagaaaacagaatatattaatcccaatcacctagtaattctataactagtttaagaaagaacaaaaaagaggggttggagagtcagtggaatgtttgcctcataagtgcaaggccctggattcagttctcatttctggaaataaaataaatatcagaagaaagccgagagagatggtggttcgcaataacccataactccagttcctaagggatcccacaccatcttatgacatcagtgaccactaggcacaaacatagagcagatacactcatgtatgcaaaacactagcaaccataaaataaatggaaataaattaaattcatgtaaatatttgttcaaatttatttaaacatttaatactttattttatattttatttaatatctaataacttaaatatgaaataaatttaaagatctagagaaaaatagcaagaaaaccaaaaaaaggtaaaaatgtaactatatttaataatcaataataaaatgtaaatacaccaaatatttttgagtggtaacagtagcctctgcataaggatgttgaggaaggcacaaaaacagtagattctcactaataatatccttgtaggctttggatattgtgagtagaaaagggtgggagtgaatgtcttatgaggaagtggagttacttcacaactaaacatacacagactacatctttacttatactggacatccaagtatagttggcatctgtctaaatggaaaagacaggtctacttgctcaaggatttagaatctcctgtgtgtgtagaatcattgcggaaattgtgatgtataaagcatttttaaaagaacgttgcattttccttggtaacaatgatatgtataagtacgaaggcatagcaaatggaaagaaggctgagatgtgggctagttgatagagtcaataatcaaaggagaaagagaggttaacattcacctgtttttgctacagaagcttcctgagttgggtaaaactcgagttagatcttgaagaaaactggtaagagatcttgaagaaaactggtaagagaggcagaaagaggcaggagcccaggaaggattacactcattgtcactccctgctttcttcttgcattagttacttttgaattgtcgagacgaaaatacctgatagaaacaccttacgggaggaaaaattacttatagctcagtgttctccgagagcgtgaaagatctgatggagcagccccatttgtggtgacacaaccctaatatggtgactggttagttaatactgtagcagaccaggagacagagaagcagacctgaaaaagggcagagttataatcttccagaagatactgcaaaatagctctaccacacagggtacaattgctcaaaatgtgagtgtgagggagtcagttcaaattcacaccacactggtcaacagacatttttcgtcttgattcactctctgaataacactgccttctaaaaatcttaagtgaattgtaccttggatttgttttcccctgtaagccttattagccaacaagcctatcaaatggtaatttatcattgagaaataatactgggtcatatgttcctgcactgaaagagttaagagggcttctataggtatcttagaaacaggagttcaggctttgggccccagacttgagataagaaaaaaatgcctttgtgccgaagtgctcttaataagagcgaggcacctctgtccagacacattggatgaattcactgggggggagtccaggccaatgcacagacactaagatgggtaaagaagaggctcccttcgccttcttcattccatgggtgtatatttattctttggagccttgagacaggaggatggaaagagaagaaggggaggagggggaatactgggattctgacctgaattccacaagagaggaatgtgtgcagaatgagcagcacaggtacaggctagtgttttcacatacctgggcgaagagctttcacccccctcccatgccttcgccgacagttggcaattggctgcaaagaattaccatttttattttttaaattatttttaagagattgtgttcatttactcgttattaatattcttatttcacggtttgcacaatagaaaaggagagagaaaattaacatcttcaacactgacatactggcaagaggtgagccataatgatgaccatgagaatgacttaattgggcagtggtggcgcacgcctttaatcccagcacttgggaggcagaggcaggcagatttctgagttcaaggccagcctggtctacaaagtgagttccaggacagccagggctacacagagaaaccctgtctcaaagagagagagagagagagagagagagagagagagagagagagagagagagagagaatggcttaattggctaatgctgtcctggatcacacatgtttaaatgagtactatgacaaaggatcacgtttgttctgacaccatggaaaactacaagatggttaactgtagggtaaaatgaggccaacttcgcttattataggaccttttgaaaagtgattgatgtctgtcttggcaagggactctttagacataaattaagttcagaacatgtaagatattagctggcaacaacacagtaaatttgttcatgttgctaggaaagctggaggatcaaatataaaatagagatgggagagatggctcacggggttacagctcttcccaccaagcctggaaacctatgttcagcttcctgggttccacttggtgggggcagaagggagaaaggcagcacatgcaagttgtcctctgaccttcacatgtgggtacacgaaagtaaatacatgtcattttaagagtttcagacagactctctctacatagcctgtgctggcttagaactaactcactatgtaaaccaggctgacattgagctcatggagatctgccaacctctctttcccaagttctgggattaaagagacatactctcatgcccacacataattaacttaaaaaaaaacagaaaacataatttagagcaggtaaagacaagagaacaggttcctctgcttaaattaaagcactcacctactttgtaaactgtgaggctctctaaatatttagagaacaaattaacacaacagtagttacagtatatatttatatagtaataatgataataataataaaaactatagctcacttggtacagtgcttacccatcatgcaccaagctttggattcaatccttagcatctcataaggcaagtatattgttagaaacctgggacctcagcactctaaggaagaagggaaatccaaaggtgaaggtcatcattaagtcacctcacctgtttttgttgttgtctgaacttctttttttttttttttagtagcaaaatatattttaatggaaagtcatctttaagtaattgaataaaaatgtattccaggggctttcccagcagacagcagagtatgtacatctggtgaggatggagtgcgtccgtttaatataaattttatatagaaaatgcaagcatatttaaacaacgcacacatgtaagaaaggacgtcacaaaaaaaatttaacaaaatagatcacaaaattaaaaagtcgacctcaagcttataaaaccaaacaagcctcagcaccgcgttggtctttctcggtgagagtcccaggagctactggaaggagatgatgctgcttagggagagggggtggggcatgagatcaaagcccgcctctccttttcctggagcaatcatgtcctgtccaggctgagagacaatggcatcggtttggtcttatgcatttcccgccatttaagcagggggactgacaagtagctgtatgacagcgggacccagtccagcctgtggggcagtcacactgataaggggccacacagcgcccaccattcaaacagggcagtatgcatattggctcttcgttgtctgaacttctaaaattttattttattttattttattttacttattcactttacatcccactcactgccctcctcccaattacctccaccaacacaaacacacagtctttccctctaccctgtttaacactagactgggatatataagactatgttaaaaataaaatttttttaaaaagtagacacaaaagaatatacgttgttatgattgcattttcatgaattcaagaacagtcaaagttaacttatggtggcaaaaataacgctgttgcaattctgaaaatgctcaaaaataatttatttagttggttatgttacgtatgaagttgaatgattattgtttgtttgcatttaagtgtatcatttgtaaattgaaaatagtaaagaagattcttatatgaatacaggttaggggaggatgacgttgccagcaggactttctctgagagtgcatatttgttgagattgttgagtgacatttcttgttatattaatattaccattctaagtaaacctaaacagatttatcattggcccatgcctttgttattcattctaattccaaaagaaaaataaagacaacaatgcttttccaaagaacattaatgacagtttttatcaaaggctaaacatgtgttactgcatgaccttccataggctatcactggaatattagattctggcaggaagtttaaagtggaaataacatcaattttggttgttctggtccattctctgttgctataaaaatatctgatgtgtggtactgtatgaagaaaagaagtttagttaactcacaatttgtgtggttcaaaggccatggggccagaatcaactcagctctgctggggacctcatagcaaaaggcattataatgatgtgcaaggagtgataacatagtcacagttccactcaagggcagcgtctcctatcacctttgcagggggctttacctcttagagttcccaccacctcagggtcaacacactgaagattaagcctctaatgcagcagccatctggagataaagtatatccaagctattaacaggggctttctcaaaataatctgtaacagctcatcatgtgcgcattatgaaacatgctctgttagctcaaagaatcatttactagttgagaataagagctactcatatttacataaataaatttctctccaaatactgtttgtgctgtatcataaaaaataaaattgtagtggttgtgttagccactttatgttcctatttttctattgcaatattttatcttaaaaattagatggtcttgttttgtctttacttaaaatgtcagtcgtttggactgagttgccttgaaagctgacaatcaaaatttggttctccaatcccatataaaggcaactcggcctatgcttgcagtctcatttctaaggaggctgaaggtagtagatcaatcatgagttcaaggccatattaagctacaatgtggcaatctgtctcagagagagagagagagagagagagagagacagagagagagacagagacagagacagagacagagagacagagagacagagaaaatgcttgagttttccattatcttttccacattagcctttaaacagtaattcttggttgtttttgtttgtttggttggttcagggggattgttgtagagttgtagtgcttgccccccaaatcgcatcccccttcccttctcctctaagagggtagacacacctgccctgggatcccctatcctgggacttcaagtctctgcaagactaggtgctttctcttctactgaggccagacatggcagtccagctagaagaacatatcccacagacagaaaacagctgttccagttgttcaggatccacatgaagaccaggcttcacatcttctacatatgtgtagagagaactaggtccagcccgtgtatgttctttggttggtggttcagactctgagagccccaagagtccaggttatttgattctgttgatcttcctgtggcgttcctatcccctttggggccacaattcttcctcctattcttccataacagtccccaagctccatccactgtttgtctgtgggtgtctgcatcactctgagtcagttgctgggtggagcctctcagaagatagccgtacaggtattctttgtgctcaaaccttcgggattaatgtacaggttaatgtaagcaacaagaagactatagtgaatggtatttccatttatcaatttctatgccaaaaaaaaaaacagtggagattttctacatattgaggtgttttgaatgagagtaaaccccacaggctgatgcatttgaatgcctggtacccagttcgtggaactgtctgagcaggactatgaggtacagatttgccagagaaggcttgtctatagggatgggatgtgaagtttcaatgggtctggctctgctctctttgttctgcttgtggatcaaacatgagttctcagctactgttctaccaccatttctacctacctgctgtcatgcatgcatgttggtaatagactctaaccttctgcccagcatgtagaaaagttcctaagacatattaaatgaaattaaataatataagcaatctttagaacaacccactggaatagatatgagtatgaatagatataaaaagggttcagtaacattccaaatgtcacctattaattaagaagactatctaaggttaaagcctagtagatgtaattgatatgagaaagaaatagtacaatgttgctatggtacattaacagatacctggatggggactagatgtgcatagacttgtatcttagtaccatctctctgactgctggggaagtggaaagtgcaccaaattcatttccacaacagccaggaaagtcaagaaaaatattcaccaaagcaccagtgaaagtgctattgttccacagcaggaaggcgggcgtgggtgggtgggtggcagagcaccctcatagagtcaggggtaagggggtgggataggggatttctggtggggagacctggaatggggataacattttaaatgcaaataaagaaaatattcaataaaagggaaagccacaaacacaaagaaaatgctattgttacagttttctggagaaataattaggacctaagagtcataatagtaatgatagagaagaaaatacctgttcaaaagaaaagtgagtatattgaaaaatcacaataacctgattttaaattagcaatggcaaaaagaaacagggaaagatgtctcttctatgggactaaccagtaccctcagagctccttggaactatagcaccaactaaagaaaacacatggtggaacttgtggctctagctgtatttgtagcagaggaaggcctagtcagtcatcaatgagaggagaggctcttggtcctgtgaaggatctatgccccagtatatgggaatgccagggccaggaagcaggagtgggtgggttggggagcaggggaaggggtatgggaataggggacttttggaggggaaactaggaaaggggataacatttgaaatgtaaatgaagaaaatatctaagaaaaaaagaaaaaaaaagaaaccaggaaagaactgaaagccagtgtttctactttgtgtccagtactatgctatccttagcaaggaggaattaaaatattttttttctaaaaaatcaccaacttcatatggttacaaatgtacattaggctgtatgttcataatatcgatattgatagtaatgctatcattgtcctgtaaatggtactcttgttaccagttcctatttcaatgcttgattgtggccattccaggggtaaccatcttgtagatagtattctaaattttctttatgtatttaccatatttaatcttcatacacttttatgaattaggcactagtatatgcatcttgtaatgtggaacttggggcccaggagggtaaataattgtcccaagccatacagaccactaaatgtgcttgaaaatctagtatggacctattcatgtattttagttaatacatctaatgcttttatgaaaatgctttcaacatgagaaccttaaaagaactcacattttaagaagtaattttaacttacttttagaaaatatgctagaatctggctgtacttggccagctttcctaagtaggaatgttcatttggacttaattggctgtctctttaaacagggagcagcctttcaaggcatatatacccagcttaaatcacttttgttactttacttccctacaaagatgcaaattatgaccattggggtataagatatatccacaattttctgagtatatgcataaagacagacaaaatgataagaaaataataatacctataatctgaatatacatcatgcttgatggtatatcatttcaagagaacattgacaagtggaacatttttaatcagatattttatattttgaaagataacaacaaatagaattctatatatggcattgaaatactttatagtgaataacacagtatattatatatactccctagtgatttacatcaatatatttctttgaatactttcactaaccctgtgaagtagattatcattatcctctttcattacagggaaaaaataaggcaggtgccggcttagcgatttattcaagaacacgcaatatttaatgattcaagaggctggtgtttctaaattctggatcagtgtcctttatagtatagcttcaaaaagtattcaaaattgcacagcctcctgattctttacagagcttttgtaaatgaaccaagtgatagtgttatagagaactcacaattgtgatttgcctcaggtgttctactattgccactaaatttcttcctgggagcttttgaataaaagatgaggcggatcagtagtgttaaaaaaaatcccaaaagttaatcaatccctcagattgttccagattgaaattgatgttattgccatatagagaagctactatgttcaatgtgtatcctgtcccctgacccttacaaggctcagtaaatcacccacaggccaataaaggcttcactttttactctggccagtgcacgatctatgcctccagacctgaagaaaactagttaccaaaaaaagtgaatcagttaaacttttttttcttaaaacgaaattcagccatttgtggactagtttactgagataatcttcttaaggtatagacagcaatttgtacaaaatgaatatgaacaattttctttcttcaaagagataacccttagccttgttaaatttaatctatgttaattaaataaactaagatttattagtttgtgttctttttcattaattcacttatttatcagctttacattttgatcacacctacttcctcccactcccagcctcaccacccctctacacccattaccccttccctttctcagagaaacggaagcctgccatgggtaccaacccattctggcatatcaaatagcaacaggattaagcacctcctcttctgctgaggtccaaccaggcagtccagttaggagtaggggatccaacggccggcaaatagacagacacagtcctcactccagttgttagaggacccacatgaagagcaagttgcaaatctgctataaatgtgtatgatgccaagtccagcccctgcgtgctctctggttggtggttcagtctctgtgagtccccatgagcccagattagttgactctgtaggtcttcttgtggttccttcttgacccctttgttttcttcattccttcctcctactcttgaataaggttccccaatctctgcctaatgtttgtgtggactgacagcaggaaataccctgcttaagaatttcagtaaatgcataaatcttagagagcccatgttgaagctttaacgcattgggttagattgtggattcttgggatcattattaaatcttaagaaaaggggggagttaagactttaaaaaacgtggtacatttattacaaaaaatattctacataagtggtatatacacacatatatatgtatagatgcatacatctatacatatataaaatatctgtttgaaagaagaaaagtcttgtaccaagtcgcagtcttttgatcatttgtaatagtgaatgaagtgacagaagcagaagagacagaataaagtctgtgttccacaacacatggagagattgttctttctttacaatccagtcttgaaaacttcttaaaagtgttaatatggggctgggaatgtagctcaatggtacagcacttgtctcacatggaatctagagttctatcctcaacactgcaagaattgcaaatttaatttgtttaaatgtgaaactaagagaaatctaatatttcttcaccattaaaacaccacaattgcatctccgtaagctatgacatgtgctgtagataacctattaactatatgatatggggctttctttgatgaagatttcttttggagattttcatttttagacacggtcttactgtgactctcaagaaggtcctgaactcttgatacttctcctcaggctgtaagtgctggacttttgggtgaaccacgatgtcgtgtcaatttagagatattcaagaatataaagaaagcatggtccaaggaggttctcagcaggcagcacaaggaacatgcaaaaaaactaaaaataatttaatgaagcaattctgtataaacattgcccctgagcaaacagaaggtgcaaagagtagagaatagaactgcagtgcagacattgtccagtgcacattttaacctgcattagtccaactacagcaataaacaaacccagagtgtggatccacagcaggtacaagtacctttcttctatgctgacattctggtactcaactattgttgtgatttatcaagagtcagtgagcatttgtgtaaagagtaggcaacaaaaatttcgtgggttgtagtggtggttttactaaactgctttgtgctccaggtgggtcactctcccagccaccaggcagagccctttagattcacaaatgaaacacacacacaccaaccaccaccagttaattttaattgccttgattagctcaaaagctgggcaattctaatccttcctcctgctagcaaatactcctctctggtgctcctgagtcaacttctacccaaacacagttgggcaagtggcccatgtggccactttccttgattctcacatgttggcaggcctttaggtctggtatttcttcttcctggtcatggtgatctctgccttccctcttccagttcctagcctgctccaatctcaaggttccccttagtctacctacccaaccattgcccattggttctttattgaacaatcaaaatccaaagagacaaggaccttcagcatttggacagattccaatttgggggaccagattaatgcaaatcattagaaccaatccccaacagtgggtcagcacctgtcacaatttaactcttctgatgagcaaaaagagatcatgcacaacccttaattaagaaactgtaactgtgttccagtaaattttatttacaaaagttggtagaagctgcatctgaaccatgggccatagtctgccagtcctccagcctttcattctcacatgaaaccctttaggtttgaaagcagtttaaaacagtatatggaagactgcgtgaaaagttttttatggttcaatcccatcttgctggtttctgtgttaacacaatctagtgtcacagagagaagggagcctcagttgacaaaatacctcctttctgtacgcaagcctgtagggaagttccttaattaatgattgctgtaggacggcacagcccattgtgagtgaggttctccctggcctaacagtcctggcttctataaagaagtgggccaagcaagctaggagaagcaagccagtaagcagcactcctctataacctctgcatcagctcctgcctccaggttcctgccatgtctgagttccttccctgacctccttaaatgatgaaaagttatatttaaatgcaagtgaaataaactattaattttatgatttgtgtggttggttcttaatttttacatattctagatattaacccacagtttttcaccattctgtaggctgtttcatcactctcatgattatttatttggcaaggcagaagggttttgaacttcatactaccacatttgtcaattcttggggttattcccagaactattcagtgtctttttcagaaagttgttgtctatatctatatttggaaatgttttgtttatgttttcctgtaagttttttttttaaagtttctgatctctcatttaggtctgtgattcagttcgaattgacttttgtgaaaggtggagatatacatctagctttattcttggtggagatatacatctagctttattcttctacatctagaaacctcgctttcctatcactgttgaacagcctatcttttattaatgtttctctttggcttctttattaaataatggctgcaacaatgtgggtttgtttctattccacagatgtacatgtctcttttctgccactaggtctttattcctatggatctgaagtataatttgagaactcatattataatatttttagcattgttctttctgcttagttaacaatataacagctatgaaccagatacattccaaaaagaagaaacaaggaagtttaatttctttgattaaaactctaacattgtggcatgcctaatgtagtggtgcatacctttaatttcagtactgtagacacagaaaggggaagcgctctgaaagtttaatgtcagcctactctacatagtgagttctgaggcagccaggaccatacagtaagaccttgatcagaatcttatggatgtgcagcgtatgtactgcagagatttttcatacaaaatataagttgcaggcattgtgtttaccaaattctctacatagagatccacatgcatattaacacatcaaggcctctaaaatgctcagtagtataaaacaaattaaaatctccaaatggttaaaaataaatagtatttttaccgaagttactgctgttcttgtacattctagcagaagatcaaagggatacagtttacactgtactgaaggaataattatcccaagttttatgcataagttatttcctaagaacaaaagtcataaggttgcaagtttgtggtataataatgagcatagctacctttcaaaacacagttacaaagcagtacatgtaattttgtaatacaatgaaaattgtgccattcttttgaatccacctctatggcctgcaccaaaagattgtttactttattcaatatattgtctgtgtgtgtctattgttatactgtgcttcattgtgtctcttaatgatgctgcacactgtccaccatgcctaattcacctttccattttcaatcacctttttagtctctctgatctctacccctctttattttgctctatgcctgtggtagatggtctcaaagctgactcacagtgacttactccactctaagtatttaaatccctttgtggtctcagcccactttgactcaggactcatttatataaccaataaaatgtggcagaaatatgtatgtgatatttgctaaggtctgaaaaacattgcacttcaatatgactgtgagcactcaagaggccatatgtagaggccttcatggaagaagagatgagatctgttaacagtcactatcagattatgtgattcagctgccttagaaatagttctttctatgaagattactatcctttgacctttgtactgtgtttacatatattgaaacagtgcattgcagcctcgaaatgtgtaaattaatatatcaattaagaaacaattagatactcgagccttaggcaaactttcaaatgactgaagacctagctaataccttaaccacggccaaggtctaaaacatcaagataagccttttcaaaatctttaattctaagaaactgtaacacatacacacacacacacacacacacacacacatacacacacacaagttttaatttggagaattgtatctggatttcacacatgctaggaaaatactctaccagagagttttaaaatttcagtacagaatgttgctatttttccaaggccttaaacttgtgatcctcttggctcacagactatctgagattacaggcatttctagcaatgtatactatgttatatgctccacaagccctaacaaataaaatatatttaataaacgcatatatgtgtatttctaaattatatctgtaaccctccagtcctacacatactgatatactcagctaagtggacttggagactcaagcaatacgagcaattcacaatggggtaaggaatccattcttagtgaacataaaaggtgatgactaagtctttcttagactaacagcactctggaccgaactttatgtctggacaaaagttattacattttaagattacatctcagaaatctgactaagctgcactgtctcctcatgctaactagggtgcccggcacaaaagtgatacttgttagagctttgtgaattgaactgaatagaggagtactcatattataagaattggagtacagacatacagttagactaggaagggcagtgattcataagtggcattaactatagagagttaaattggggttctttaaatgctcccctccccctctgtggtttagatttaacctagagcttagagcatgattgaagctgcaggtgggaagcaaataactatataagtgcagactgcaaatgctacaaatcaggtagaggcctgactcacatgttaagatgccctgagtaaaggtagcattgtaatctgcaaaggtacccgaatacaaaggaagatgttaaaagtaagaggctaacaacatttctcaagattctcaaaggctgtgtacagtttctaaactctcactgattctgattatgaagtgtctcttccacagacagcccagaaaaaaaagtaatattttagcataataccatttccttgcatcttccaacagtttcaatacagattctggagactcacaatttgcagtccttgagatgttatgaagcatacttatcagcataaaaatgattactgcgcagacccagagaggccagtgtctttcattaaataacaagttttggagggaaaaaaaaaaaaaacggaacaccctaattcttgcgacaagcaccatcaaaatgactgaaaaatctacagttcaaatcacctcctactcccaagagatgtttttcccttcaacctagctgagtgaagaaggcacttccctggagatggcaattagattagaaagcctggagccttccccttgatgacttaaaatgatcctaagttcctgagctaacttagatggatggtaatggtttccaggagacagacaacgcggaaaagacaactgcatggcactttctgttctgtttactcacttaattctttgcaaattctttcgtaaattttattaaagagactgcaaacctttctttttttttaatgaatcagtgtgctctctccccatttcaaatagctgaacgaaatcctgccagaagctggtagccatgatccttctgtatcatggatggtcaagccttactctaatccttaaagtaagtgtgaagtctaatcagtataatgaatgaagtagtcattaacatttttgagagaaaaaagccaacaacctaaattactgtacttccctgattatacctggggattctagctctttttcttggtcaggcttcttgtcaagggactgtgtgattaaaaaggaagcaggctatttacccaaatggataaatgagagacttggttaccaaaagactagcccactgctgaaattattacttatatgttgaaaataagaattgatttataccttcatgttgtattagggatgtaacacaggtcttctatgaactaggagagtgatctatcatgaagcttcaggcaatctcatccccacataccttttgaagttattctagaagactaaattgtcaggaatacttgtgttgaaggttaactcttccagtgctttatgagcattaataggaaaaccatttgacatctctgtgcattggatacccacgtgtcacctgcctggcagtattactttcctggttttccagtggaggtaccaatattttccaatatcaaagttgtgacttgagaattaagtattaaacatttagtgggttactatgagaatgatttgccaagtttcctggacctttcactcagttttattcggttgctatagcagtcactgtaatgaagaagattatatgtgtgagatgggctggtgggggaaggtaaggagttgtaaggtgctttatggagagagtttaatctgaaacagtagtggaaaataaggagagagaggctttagggaagagtgttgagctgggttcatgctatctggctttagtcctgatacaaacttcatcctttggtagttctttgacaatatgtgtgcatgtaatgtagtataaaaatgtgtttggtcttcatgtgagtatattcttaacaaaagttgctgaacatattttcctagttctctgcctttggtttatgtagtgcttgtgattaattagcattattagttaatcagtcttaatgtcagcctttgttaagggctaattaactagtgtgtactttgtcaaattgtaatgagaactgataaggagtctttttaccttttgtgctttattggggggggggaagacatattgttttagcaaacattggggttttttaaggagatgatactttttaatttaaccagtgtttactagacaaattgacggccactggtgcagagaaaagaatataaagaaaaaaatgtaaagcagcttatttgcctgaggcacacaagctagtcataaaaatctgtaaaccacaaacaacatgcacatgtgtggagtgtcactcgaggaaatgaacaatgacgttgactgaagttgacagccttgactgttgtagaagctttgcttaggatagtaatgaagaagatgatgtgtggaggatggacttggggtgggccaatgtattatttaatcttaggaggtagtgggaaagaatgagagggaggctccaaggaaaagcatgttgatccggagtccaggctacctggctttaatcccgataaaaaaatctcaccacttggtagcttagaccttagacttgtcacttcttagatatgaactttaggaatccccagtgcaggactcaggagattccaaccagggaaatctagactttgaaaacttttttgagagacatgaattctaaatcttaaagcttgcccatcttttaagttttcaacaggccaagaatgaacagaaagagaaaagattagaggaaaggaaaataaacttatattcatgaagacctagaacgagaataaggaaaagtcttacaggacaaaacatatatgagatagaaaactctgtgtcatgttttaaatagcttcctggagagatgggacaggtttagcatttgtaatcatcaaatctaaaacccaaaaggctccctaatcaaaactgttttgagtactgacatgatgtcacaaatggaaaattctgcacttgagtccatgtgatgagtgaaattcaaaacattagatacattgaaaatatatacaattatcttcagtacatttatataaactatacatgaaacataaatgaatcttgtgtttacacttctgtcagctattccattaggagtatataaatatactaaaatgagaataaatgaaaaaaaaacccaaacacctctcggcataagcacttactaataagatatattcaacctgtgtcatgtggtagaaagttcttaaccttagtaattgaatagccaagattttaatctcatttacccatttagttataatttcaggcaagtcccttagcatctcagggtcagaattttctaaggcatactttatttgttgtgcttcattttcttagactagtgtgagaaccctgaatcagtcaagcctgttgacaacattttctcaagaacactatgtttctgtatctcatgccttaagctttttaaaaaaaatatttcatattcagtatggtaggatgtaatctttgattttctagataatcagtgcaattgatttgatgtgccacaaaccacacccttattagaatgtaagctttaatattaattgacaaatactgtgtgttctgactgctccacctactggttgcttcccagtcttccctattgctgaatcaaggctatcaactttgccatgcccttcaattgttcaagtaaaatgaagacttaaatcctctaactttaaatcaaaagctagaaaagaataagcatagtgaagaaggcactggaaagatgtgacagtctgaaaactggactacttcttacccaatcatcaaagtgtgaagtttttgagggaaaaaaatgctattccattgaacataagaataagaaaatgtaacagcctcatttgcatagatggacacattttaatggcccattgtaggagaccaaactagccacaacattatcttaagataaaccattattcagaacaagacagcccaattctgtgaaggctgaaggaagtaaggatacttagaaaatatttaaagctaaccaaggtctgttcacaatgtttttaaaatattattatgtatataggtattttgcatgcatatttgtgcaccatgtacatgccaggggcccccagacaccagaaaatggtgtcaaatccaatgaaactagagttacagatttttgtgtgttgcaatgtggaagctaagtattgaacctgggttctctggaaaaatcagcttgtgctctcaactgccaagccatttctctagcccctggttcagaggatctaaggtaagaaagtgattctaagtccctgcaaggtagagcatcatatgattgtgcagacagtccagccattatatagaagatctagtatgatagacaaggatagtcatactaaataacaactttccagtgtatatgagacagcttgattgtagtaaaagacactacctaggactttcacagcaaaagaggaaaagaatccagtgctgagtttcaaatcctccaaattccagaggctttccttgttaaggaataattcacaatagatgacttttagaggtaaccaatactcatcttcttagttactgttctattgctaggaacagactatgtaggcataaatttgtcccaacctactttaataaaatttcaacctctattctagtccaccacccaccagatgtagtggaaaagaaagttcttaggacatgggggaagtagacctgtctagaaatagttctttgggggcaagtccaatcatcattgtcaggatatcagcagttcaatccagtagcaaacaccaaatatgaatcagcagctgaagtccaatcctctcagcaaacaccacatacaaaccagcagctgcagtccagtccacttggtagtcattacacacaaaccagcaagggcagttccatccagaagaaactacaagatttgccaaccagcctgaggtcatggaagctgcaagcaggaacaggaatctcacaagaaggcgtttggcaagtttctctctagaacatcaccacaagtggagctcagcaatgcaatgtaaggcaaacacagtgcgtgtgtgtcattagagaagaatagcaaggcagagcaaagcaaaccaacgctggagctcccactgtctgtggggtcatatttatattccctctaaataccacacatctattcatgtgtaggctgtaataaaagtcctttcatctgtgtctccttcagcaaaatgtccagcaaaaaaccagaagtttccactttgagagacagcataaccaagataattcttattaagaaaacacttaattatgcatgtgtgtgtgtgtgtgtgtgtgtgtgtgtgtgtgaacgcacgcacatgcgtgtgtatgcatgtgcttgtgtgtatgagatgtatgaaagagagagaatactggacttttgaaacctcaaagcttacccccaatgatgacacacttcctccaacaaagccacactctaacaaggccacacttcctaatccttcccaaacagttccaacaactgggaaccaagcattcaagcatattaccctatggagaccattctcattcaaaccaccatatttttaccattccaaaaattctaggatattaagatttacactgaagttactctgacagtgtttttttaagtaaatggaataataatgtatatatgattgcagttctgtttgtgacatggtttagtgaatatttaaagcccacagttgagaccttattcacaatgtgcttattcacaatgtccctggccacctggaagttttaatgggaatgtccaatgagattaatgtacttgtcaatacaacattcataatatagcccatggttcaagaaataattttggctttggggttttatccctgaaccaatggattctgtaaggctacagctgacatagaaagagatcccactgatgtgtatgtgaaaagtagaatgaaaaatcttgaggatagccatagttgttatagatgtcttcaagaacatttaaattcatggatgggatcaaaatgaatgtcaccaggaatatggtacaaatattgccaggccttgtaagtgacattgagaggtttaagatttagaaggaaaatgtagctgaagataatggtacaaatcacagccaagacagaaactgcgactgagctgttgaaatatcacaataaaacgttaacagacaaggactcacttcttgtcttttttttttttttttttttttttaattatatgtgagtacattgtagctgtcttcagacactccagaagagggtgtcagatcttgttacggatggttgtgagccaccatgtggttgctgggatttgaactcaggaccttcagaagagcagtcagtgctcttaaccaccgagccatctcaccagcaaggactcacttcttgtagatgaacaaagagggttacttcttgtaatggaatctgctcttggtgaagaagctatgtacacaattgaaatgacaagaaggcatttagactattaagtaaactaccttggcaaagcacaagcaggtttttatataaccaactccaattttgaaagaagttctattgtgtataaattctggaaaacagtatctcatgctacagagatatatttcatgaaagaaagtgtcatttgttgcaattcactccattgttatcctatttgaaagtattaccaaagccatccaagcttttaacatctactaccctgatcagttcattaccattaaagcaagaccctctaccaccaataagattaaaactttttggaggctcagttgtcatcattttagtaataatgtggcaaaccaaaaatacagtttttaaattgttttgcatacccactggattagtataatttcaacatgatgattatatgttcagtaaacagaaaaattcatatgacttactttgttgtgaggatctgaaactgaactcaaagtatgtctatattaagtatataatatccttgatatggttgtttgaagactaagtgatttatttttaaccatatgtgctacatttcatataaccttcaacaaacacttaatacatggtagctatttataggtccagattgcctggatcctaatttggcttgatggttttgctagataagtcagcatatatgaaagggctgctttagctccactttagagactgagcttttatcatcttcagtcaggggactttggtgttcgtttattccacagcttccttcctaacactatgaaactttctcaaccgttggacaagaaattgaaatttagtgcatctccaaatttcagtttgtcactttctagatctgtctgaccctagtcattctaaatgtagagactgagtctgtatcagtattttccagatgccattatatggatcaaatttaactcctaccagcataaaattttcacagaacaagaaggaagcctttttccaaagccagactccacagtcagtctccctcttcacagctgcttcccaaaagtccctactgtgctaataactacagctcctttatatgttcagcaaaactctgcctcaagattagttttgataagataggaattccaaacaatagaagatgtttatcactctagaggtcgtgggacctgggaggatggaggcaataagtgaagcaaactaaagattcaagaaatacgcagctttattcagagagtcagacaatttatactctgggcgttaagaggagtcacataaatgtgcaattacacagacaagccacatgtagcaaaaccaggtttttttcatagaagcatataaacaaataacaatagcctgttgtaatgaatagtctgaaataagctagatcctatctgatatacctgaggggcaagaaaacacattccaagatcaatttctggttatcaaaaaaactgaggtaaatgaactcttgcccatttttcccccttgggtttttctctaaagcactcagttttcttgacacaactctactcttggattgtgttccaaaagaagactagtgaatttattgcagatactgagattatgagagccaggtactgctttgaaaagatgcccctttgcaaagacagcccattcttttgatgttatgaagcatagaatcccccaaagagaaaaacaattattcacttctttgatgttgccatgtacttaaaagtttttcaatcatctccttagttttatgagttcccatttcaggtaaggggtataattctgtatggcagaagcaacgagattttgtttttccttgtttttccccaatttcagcagcagcttagctgactcagtcctttatcatttttcttccttgttttccttgcctgtctctccctgcatgtaaccctctgtcatgttccacattgtttaaatcccacctcttgtcacagctcttactcataatcgtgtttcttaaatctgtatctgcagctaaccggtgcaggtgattaagtggttactgggtcaaagacaatcatgagctcatttctcccaaggcagaagcagtttcagccagctgtcttacttttggtctcagtgtaacccaaataaaggttaaaaagtcaccatcctaacacaaagcaacaaaaaagccatccaaaggattatgacaacggaatgtgcaacaatgttctctaaagcaggtttgttgtagcaatgggtacaatgaaagaacactttctgagaataggcagatcctttgtagaagatacatgatttggtggataactgaaaaacaacagtccagaaacatgagaagacgatcagctaagcaaggtcaggaaatggggcagaactagctgaattgttgcctcaattctgagtgaactcagctgcctttgtggggtgagtgcattgtttttcttggattcagtatctaacactgcacatgtctactgccccccttactgttctttagatttatggctctaaatagaaaacttgatttttgaatgaacttgtatttgaaaacttctgctttgctgaatcaagttggttgtttaaattctgcaatagatcagagttctccgatctgaaagagtaggaaagcattgaatgcattgaatggaagttaagttccactgctttccttaacaattaaagagttggctagtccaaggtaattgccgaatattgtcaagaatgtgggaaaatggttattcacacacacactactgatgagcacagaaactgatgtggccatttcaaaagaaaatttaataacacatgtcaaaattcacttctttttgacctatcatctctatgtcttgatgaatggctcacaaacataatatttaattgaatttatggtgtatatttattatataaatgaacattgtatgtgtatttgaatatctcagaaattgggatgcatctttgattcaatgaaatatgatattttctcacagtcattagaagaaacttctacagatttgttgtgaaagatttagaaaagcttaatgtgtatagatagaagcccgaatgactaacttatattcatccaaattatatcccatgcaactatgaaaaaggatgagattgtactatgtgtggcgatttgaataaaagtttcatacacacacacacacacacacacacacacacacacacacatatatatatatatatatatatatatgaaacattaagacatataacattaagttttaaaaaatagaaaaattccagtaagacacaatagatacattgtttataatatgtgtgtatacaattttctgttgtaacaggtaaactattgttcaagatttcttctggggtaagggttagctagtgaaagacatttaattttcattttgtatgtttttggacaatttgaattttcctaccatgctcacatattgaatttttctttaaaggccacaagaggtttcttggagataatttgctattcttttcctctttttatgcttttttgtattaaaaatacaataaatgttattttaaaaaggaaatcaataagacaggccctgtctcgggagagtttataatgagcgtgataacccagagaacagatggttttttttagatccaagcataaaggtttgaaccaagtgcttggagtgggaggtgggagatgcatggaagagaaacttactccatctccttagtgtcacaaataaagtgtcagaggagatatcacatttgagttgaggcttggttgagcagagaacattggtgggaagtagtccagagagcacagatagcctgtcagacacagcaatctagaggctataaatgggtcagggaatgtggagggatacaacagggacaggcatattactgtgaggccctgagtgagcatgtgaacagaagtattcatagtacgtactctaatcttggagcatccagctcttcatctctaaccctaaaagcagagttaaggaatcaccagctctaagaaaagcagtaataatagagactagaaatgtctcccagtttgagggttctgcctgattctttcctaaagcagtaaggtggaattctggacacattaagatgcagctagaactcaaacactctggtagctgttaatagtcttatctttagcattcctgtttctggaatttgccaatatagtggcaactaagaaaaatctctgctacagaatgatttgtgaaagatttgctaagatctatgaagatctatgttatgacagagatcatacaccctaattctccacccagcctgttatactatgggatctagaatgcttaaaattcccagagccaggtgatggtggcacatgcctttaattacagcactcaggaggcataggcagatggatctctgtgagttcaagaccagcctggtttacagagagatgtctagggcagctagagctgcagaaagaaaccttgtctcaaataaacaaacaacaaaaactccaggaacctgaaaaaatagagttatgtgttctgtatgtgaaattaattgtctccaaggctttcaaagtacacatatagcagaataaaaaagaaaaaataccaatacatatcaaatataagatgaaaattcttagcttcaataaacgaggcaggtaatattagcaccagaactaaaataggtagacctcaaaacacaaggtgcatgctgccggaaaaatgggaacatcaagtgtcaatcaatttcattatctgtgtgatctaataaaatggtattttctgtgaaatatgaaaactaatgttggattagacttagagtcagcaaagtatagctagatgtacacgtttgcttttcagtcccatgcagggaaagtttgctgtcctctgcataaaactgaagacttaagtgaaggagagaactgactcccagaagctgcacacacaagtgagcatgcacacacacacacacacacacacacacacacacacacacacacaccatagtgtgctcgtgtgtatatatacacatacactaacaaaaatttaaaatggtttactaatatcttacctatgcttattattgataaaacaaaactttatgaaacatttactatatactaagtgatatgaagtttccaaacacaatcctagcacactgtcaataagacaaaaaggcagccaaaagattggggaaagatctttaccaatcccaaatccgataggaggctaatatcatatatatatatatgatatatttatatatatatataaagaactcaagaagttggactacagaaaaccaaataaccctattaaaaatggggtacagagctaaacaaaaatttctcaactgaggaatactgaatggctgagaagcacctaaaaaatgttcaacaaccttaatcatcaaggaaatgcaaatcaaaacaaccctgagattccacctcacaccagtcagaatggctaggatcaaaaaattcaggtgacagcagatgctggcaaggatgtggagaaagaggaacactcctccactgctggtgggattgcaagctggtacaaccactctggaaatcagtctggtggttcctcagaaaactggaaatagtactacctgaggacacagctatataccactcctgggcatatatccagaagatgctccaaagtgtaataagaacacatgctccactatgttcatagcagccttatttataatagccagaagctggaaagaacccagatgtccgtcaccagaggaatggataccgaaaatgtggtatatttatacaatggaatactacacagctattttttgttgttgttgttttttgagacagggtttctctgtatagccctggctgtcctggaactcactttttagaccaggctggcctcgaactcagaaatccaccttcctctgtctcccgagtgctgggactaaaggcgtgcgccaccacacccggctatacacagctattaaaaacaatgaatttatgaaattcttagacaaatggatggatctggaggatatcatcttgagtgagataacccagtcaaaaaagaacacacatgatatgcactcactgatatgtggatagtagcccagaagcacagcatccttcttaaaagggagaactaaatacccatggaaggagttacagagacaaagttcagagcagagtctgaaggaatgaccatccagagactgccccacttggggatacatcccataaaaatacaccaaacctagacactatgacagatgccaacaagagcctgctgacaggagcctgatataactgtctcctgagggactttgccagtgtctggcaaatacagaagtggttgctcacaatcgtctattggacagagcacaaggtccccaatgaaggagctagagaaaggactgaaggtgttgaaggggtctgcagccctatatgatgaacaacaatatgaagtaaccagtacccccagagctccttgggactaaattaccaatcaaagaaaacacatggtgggactggtggctctaactgcgtatgtaacagtcatcaatgggagcagacgtcctaggtcctgtgaaggctctatgcccaagtataggggaatgccaggaccaggaatgggagtaggtgggttggggagcaggaggaagggggaggggataggggatttttagaagggaaactaggaaaggggataacatttgaaatgtaaataaaatatctaaaaaaagaaagaaagaaaaagaacagcatagaaaagcttcaaacctaatacaatattgtttggagcagagcctatagatataaaaataaatgtgctaattccattttaaaaaatacatagaccaaaattgttagtttcagtaaggaatccaggggaaaggacaatgatcatgtgattagatgaaacataataatatgatctcttctggagaagacaagaattgctttcttctttttttgtatttaattttttatttattattttctttatatacatttcaaatgctatcccaaaagttccctatacactcgcccagccctgcacccctacccacccactcctgcttcttagccctggcattcccctgtactggggcatataaagtttgcaagaccaatgggcctctcttcccagtgacggccgactagaccatcttctgctatatatgcagctagagatatgagctctgggggtactgtttagttcatattgttgttccacctatagggttgcagatcccttcagctccttgggtgctttctctggcttccccattgggggccctgtgttccatcttatagatgactgtgagcatccacttctgtattttccaggcactggcatagcctcatacgagacagctataacagggtcccttcaggaaaatctttctggcatatgcaacagtgtctgggtttggtggctgattatgggatggatcaccaggtgggatagtctctggagagtccatccttttgtgttagctccaaattttgtctctgtaactcctttcatgggtattttgttccttattctaaggaggaatgaagtatccatgcattggtcttccctcttgattttcttatgttttgcaaattgtatcttgggtgttctatgtttctgggctaatatccacttaccagtgagtgcatatctaatgaattcttttgtgattgtgttacctcattcaggatgatatcctccacatatatccatttgtccaagaatttcataaatccattgtttttaatagctgagtagtactccattgtgtaaatgtaccacattttctgtatccattcttctgttgaggggcatctgggttctttccaaattctggctattataaataagactgctgtgaacataggggagcatgtgttcttattaccagttagaacctcttctgggtgtatgcccaggagaggtattgcgggatcctccggtagtactatgtccaattttctgaggaactgccagactgattttcagagtggttgtacagcttgctatcccaccagcagtggaagagtgttcctctttctccacatcctcaccagcatctgctgtcacctgaatttttgatcttaacaattctgactggtgtgaggtggaatctcaaggttgttttgatttgcatttccctaatgattaagcatgttgaacattttttcaggtgcttctcagccattcagttttcctcagttgagaattctttgtttagctctgagccccatttttaatagggttatttgattttctggagtccaggttcttgagctctttgtatatattggatattagtcccctatcagatttatgattggtaaaaatgctttcccaatctgttggtggcctttttgtctttgacagtgtcttttgccttacagaagctttgcaattttatgaggtcccatttgtcaattcttgatcttacagcacaagccattgctgttctgtttaggaatttttcccctgtgtccctatcttccaggcttttcccactttctcctctactaattacagtgtctctggtcttatgtggaggtatttgatacacttagatttgagcttcgtacaaggagataagaatggacaaatttgcattcttctacatgataaccaccagttgtgccagcaccaattgttgaaaatgctgccttttttccactggatgattttagctcccttgtcaaagatcaagtaaccataggtgtgtgggttcatttctgggtcttcaattctgttccattgatctacctgtctgtcattgtaccagtaccatgcagtttttaatcacaattgctctgtagtacagcttaatatcaggcatggtgattcgaccagaggttcttttattgttgagaatagtttttgctatcctaggtttttttatttttccaggggaatttgcaaattgccctttctatctcagtgaagaattgagttggaattttgatggggattgcaatgaatctgtggattgcatttggcgggatagtcatttttactatatttaatcctgccaatccatgaacatgggcgaactttccatcttctgagatcttcttcaatttctttcttcagagacttgaagttcttatcatacagatatttcactaccttagttagagtttgtgactattgtgaaggatgttgtttccctaatttctttctcagtccttttatcatttgtgtagagaaagaccattgacttatttgagttaattttatatccagctactgcactgaatctgtttatcaggattaggagttctctggtggaatttttggggtcacttatatatactattatatcatctgcaaataatgatattttgacttcttgctttccaatttgtatccccttgatctccttttgttgtagaattgttctggctagaacttcaagtactatattgaataggtagggagaaagtgggcagccttgtctcgtccctgattttagtgggaatgcttcgagtttctctaaatttagtttgatgctggctactggtttgctgtagattgcttttattatgtttaggtatgggccttgaattcctgatctttccaaatcttttatcatgcaggggtgtttgattttgtcaaatgctttctcagcatctaaggaggtgatcatgtggtttttgtctttgagtttgtttatagagtggatcacattgatggatttccatatattaaaccattcctgcgtccctgggatgaagcctacttggtcatgataaatgattgttttgatgtgttcttggattcagttagcgagaattttattgagtatttttttgcatcaatattcataagggaaattagtctgaagttctctttctttgtttgatcttagtgtagtttaggtatcagagtaattgtggcttcatagaatgaattgggtagagtaccttctgtttctattttgtggaatagtttgagaagttagaattaggtcttttttgaaggtctgatagaactctgcactaaatccatctggtcctgggcatgtttttggttggtagactattaatgagtgcttctatttctttaggggatatgggactgtttatatcattaatcatatcctgatttaactttggtaccttgttatctgtctagaaatttgtgcatttcatccaggttttccagttttgttgagtatagctttttgtagaaggatctgatggtgttttggatttcttcaggatctgttattatgtctccgttttcatttctgattttgttaattaggatgctgtccctgtgccctcttgtgagtctggctaagggtttatctattttgttgactttctcaaagaaccagctcctcgtttggttgataatttgaatagttcttcttgtttccacttggttgaattcgcccttgaatttggttatttcctgccctctactcctcttggttgaatttgcttccttttgttctagagcttctaggtgtgctgtcaggctgctagtgtatgctctctctagtttcattttggaggcactcagagctatgagttttccccttaagactgccttcattgtgtcccataggtttgggtgtgttgtagcttcattttcattaaactctaaaaagtctataatttctttatttcattgttgaacaaggaatcattgagtagagtgttgttcagtttccatgtgaatgttagctttctattatttatattgttattgaagatcagtcttaattcgtagtgatcagataggatgcatgggataatttcaatatttttgtatctgttgaggcctgttttgtgaccaattatatggtcaattttggaggaggtaccatgtggtgctgagaagaaggtatatccttttgttataggatcaaatgttctgtagttatctattatatccattagtttcataacttctgttagttccactgtgtccctgtttagttcctgtttccatgatctgtccataggtgagagtgctgtgttgaactttcccactattattgtgtgaggtgcaatgtgtgctttgagctttactaaagtttctttaatgaatgtggctgcccttgtatttggagcatagatattcagaattgagagatcatcttggtagattttacctttgatgagtatgaagtgcacctccttgtcttttttgataactttgggttggaagtaaattttatttgatattagaatgggtactccagcttgtttctttggaccctttgctttgaaaattgttttccagccttttactctgaggtactgtctgtccttttccctgaggtgggtttcctgtaagcaacaaaatgttggatcctgtttgtgtagccagtcaattagtctatatctttttattggggaattgagtacagtgattttaagagaaattaatgaaaagtaattgttgcttcctgttatttttgttgttaaagttgggattctgttcttgaggctgacttcttttaggtttgttgaaggattactttcttgctttttctagggtgtagtttccatccttgtgttggtgttttcccttttatcctttgacgggctggattcatggaaaaatattgtgtgaatttggttttatcatggaatactttggtttctccatatatggtaattgagagttttgctgggtatagtagcttgggctggcatttgtgttctcttagggtctgcataacatctgtccaggatcttctggcttttatagtctctgatgagaagtctggtgtaattctgataggcctgcctttatatgttacttgaaatttttcccttattgcttttaatattctatctttatttagtgcatttgttgttctgattattatgtgtcaggaggaatttcttttctggtccagtctatttggagttctgtaggcttcttgtatggtcatggacatctctttctttaggtttgggacgttttcttctataattttgttaaagatatctgctggccctttaagttgaaaatcttcattctcattaactcctattatccataggtttggtcttttcattgtgtcctggatttcctggatgttttgagttaggatctttttgcattttgcattttctttgattgttttgctgatgttctctatggaatcttctgcacctgagattctgtcttccatctcttgtattctgttgctgatgctcgtgtctatggttccagatttctttcctagggtttctatctccagcgttgcctcactttgggttttctttattgtgtctacttccctttttagattttggatggttttgttcaattccatcacctgtttggttgttttgtcctgtatttcttcaaggacttatacctcttcagcagtgttctcctatatttctttaagtgagttattaaagcccttcttgatgtcctctaccagcatcatgagatatgattttaaatctgattcttgcttttcgggtgtgttggggtatccaagactggctgagttgggagtgctgggctctgatgatggtgaatggtcatggtttctgttagtatcttaggtttgccttttgccatgtggtaatccctggagttagttgctatagttgtctctgtttagaacttgtacctcctgtgattctgttagcctctgtcagccgacctgggactctagctctttcctgagtctcagtagtcagagtactctctgcaggcaagctctcctcttgcagggaaggtgcacagttatctggttttaggacctgcctcctggctgaagatgaaggcccgaaatagggcctgtcccagaagctgggttgcctctgtagtccgcactttcacctgtgcagactagtctcggagggatccgggaccccagatggctcccccacctgctctggcagagccctccaagatggacacctcaggaagtgctttctaaggaagcatttcagttgaaaattgtaaggattagtagtatccataatttgtgtagctctgcaaagaaatgttccttttcttgattcacagaaatggagtctggagacctacaattcagtgttctacaaacaacagtttaaaaatccctgtttaaacctactggtatagcttttgtccagcattagttttactaatgcaatataaccaactggataaggctgaaatagaatggagtggaattttccaatattattactgagaataattattctgtaaaacaatgcaaagcacatatcttggggctgaagagctagctcagcagttaagagcacttcctgctcttccaaaggtcctgagttcagttcccagcacacacatgacaactcacacttagctgatctcctcttctcatatgcagatgtacgtgcaaagtatccatatacagaaaaatgaataaaaaagataacagctgtgctcactatttcccttcttttaaagatgaaagtcttcctatgtgtcctttaacattcttttcagtaattatgtaagtatgaaagtgtcttcccaccattaactgattgcctacattagagtaggagagtgtacaaagtgccttgtaaacagaatactattcactgtctcagtaaccccatgaggtagaaacaattaatcatcccattgtaggaattggtaagcctgaaatggtacttaagaactttttgggtttttatcacctgtatttgatggtccaagttttgaattgaatccaccttattctagaaaaataattttctcattcctgagcaactgtgtatggacttcaaatcatttaattctgaagtaacaaaacacactgttttcaaatagatatcaaatgatgcctgatgatatatatcatcatcaacctagccatgcagatatgtaaaaaagaaatcaccatagaaggggatttgaagatcaataaactccttgacaacattagccaagagccaagtgatactcctctgtgttggggtatatggtgctcttcaagtaaaaaaagagcaaggcctcagggagtagacaccaatgctgtcagaaagagtcaaactggcctattaaattcccatcaaatgaaataggttagcaggtgcctctgtacatccatattccaattacttcatttttcctctccaaacaatggcaacagatggagtccagggagaaacccttaatgactaaagagtaggaaattaacaatctttgggggtcacagaattaaaacctcaaaggcacattgtacttagccatagaatgaatgagctgtagttaaacaggttgattggaataatgtgaagataatctcacaagtggccttcttaatacccaatggtttaaagtggcaatctgcagggtggtgtgatgaaaaattatttgatggtactaactctgactcaggtttggagaaagaatcttcagttctatgggcctcagtttgccagactataaagtaaaaatggcaaagtcttctcatttattgtccctataaagtaagaaagaagaccttttccagacctactgaatcagctttgcatgtaaccaattaccctgatgattcatctgcatagttccatttgagaaacttgcctaggcagttccagcccacactccatcctcgctcctgtgaacaccttgagcatttaggcttgtaaatcttaccattgaatttcttcccagtttgatcttttgcaaccttgaaaccatagatatttaggcagcaactacacattcaatgatttttatgttataagacctttttaactgtctttatttcacatgggtttattatgattatgcaggcttcaagccactgtgtgtacaaaaaactgagtaatatgtaattcctacccccaaagtgactcaagggatagtagagagaaattacttgctcacttccttctatccattgttcattatttccaaaacattattttgccccagactcttgaatagttgttgagaagatgaaaccccacctgtgatgatatctctcacttttgaacctatggaaatatatttgagcatttaaaaagtagcatcaataaacaatttggtaatgctatactccattagattgggtgtgtattcagagattgtctaattggtaaatgtcgggagtgcacagaaaaggctacagaaagtagttaggtttggatttggaagttgactatgaactcacaagtagagatctcccacagaagggctagcatgagtacatacatattaagtgcatggttttgtttaggagacatcaagtcataagctgtaaatatgtcatgaagatatatatgggtgcatgctatggggctcaaattactatgggagtcatcttaacatacataacatgtatcatgtggaaaattttccctactttcactacacaactgaaagttctcagtggttatctgatatattaactcagaatgtatctggtaaaaccttcttggattgatttgggataaaataaaaccctcttaagaatggaagcaaagtatcctttaatttgctctgggttccaaaatctcagtgaaaatggctactgtgatccaagagtgaaatatacctgattgaagatacagccctatctgactgccaatcacagcacaattttaaagggttggtaaaaaaaaatctaccaaactgcaacgcaaactactgtgctttacaaacctagacagagcatctgatatgaatggataatcatcaaaggtccctacatagatagcaggtgtgcaggtgtttgcaaatgtgaggttcaagtacatgtgtttggccttgagataagctttcagctgaaaaaataaaggctctgtgctttagggttgggacactgagtttctaagcctcttctacttactagcagcgtgcttcggggctgcctgtgcatgggagctaatggcaatatatcttttgatttttatcatgattccgtacttggatgaaaacactacagtggctgcagctttaaactcccactagataactgctgtgactgtatttcactaagcagctttttaggattgtttttatgccaattggatacaagctagagtcatctgagagaaaggaaccacaaatgagaaaatgaatccaaaagatcctgtcacaggtaggtaataacaataagccacatggaatcttactattacctacttaaaaactttaatgcacataactacgtataaacatacaaatatcgttttaatgaactttttacatctgggctgactgtgttccctccaagagccaacgaaatatcacctaacaaaacccaaactgccacacaaatttgaaaccctcttggtatttttaggcaggattatccaagagactcaaaacatacagcctattgctgttgcccatggttaccattcagaggtggaaggtaagtccctattgctgaagacatcatgtactttagaaacaggccctagagacccctgagctgcaactaacctgaattctacctccctgcctagctttcatggaatgagaaggtgccatatatgcttccaaaagagaaaggcaaccaacagtcttatccagttttggtgcctatgaaccacatcaaatatcagcatgacacaataatcctagaaatgcagtaattactgactagccttggtggacttaaaacccactcaacagcaggtagaccatgcctcgtactggctgagttaactactcagtgctagtgtagtcattattattagagatatatacaaccactaatttactaaaccagcatgattcctatcaacaacttataagcatctgtccttatggccacagataagtatagtctttacttctcatcaaggagcttctctttgcaacaaacaaggaccatgacagaaagtcacaaccaatcaaaatgcagagttgtgcagcccagtcctaatggctacatctacaaaacactcttgcatcaaagcctgggtgtttttggaaagagtataagagccagaggatcagagagtttgctgtaagactatgtctcctagtaatatcagaagcaacacctataaagtctcacaaacgtgactgtccaatatgagctgaacaaggatgagaccaatgaacatgttagtctgggtggagaaaatcccatgaggcctcaactctacacaaaaactataggcaactgacaaaagctgtgaataggagaggtcatactaattagggaagagcccaacaattggttgtctagtgtcaaaggatcagcactgaaaacataagtacaggtagcattatttaggaatgtatatgtatatacatatatgcatgtaattacaattactaacaaaaaagaggccataaatttaaaggagaatggataagggtatattagaagacattggagggagaaaaggatagagaaatgttgcaatcaaattataatgtcaaaaattaaaaaaaaaaaatcttctgtaggcaagcctgtatggcacgcttaattagtgataatgcattttaagcatatttcattaatgataatgtgggaggggccagctcattctatatgaaagcacaccgactaagcaatctattaggggaacctgtaagtagcacttcttcatggtttctgtatcagctccctgcctccaggttcctgtcctgtttgaatgagttccttccctgacttccttcagtgaataagcactgacatggaaattccaacaaaattaacccttacctcctcaaattgcttttggccatggtgcttatcacagaggttggaaataagacaaaagatcttttaaagagtttctaattatccagatacagagatgtatgagtgattattggatgttgtctgttaggatcattgatttataaggttcaaaaaggcaactcttaccttaacaactccctctatgagatttctacaaataataaccctgctctttgatttctaataggacagtgcacctctagcctcatatacacagtccactttgtatgtagcttacccagttcttgacagccattctaaatgggtctcagatgattcattgttatgagccacagtaatctcagatcaaataaatttaggtgaatatagcataatttcaattccaggtaccttgattgccatgcatcctcttcctcctcctccttctcctcttcctcctcctcctcctcctcttcctcctcctcctcctcctcctcctctctgcatccccctctccctcctcatcctctttcttcttttttgttaacagcatgcattcactcaggggttcctataacttagtatattccagaaagagctgaagctggagtccaaagaaaagcacaaaaaattagacttgaggcaaatccaggatgcccagatttcaatctaagtgcattttaagcaataatcttattgattatttttaattggatattttatttatttacatttcaaatgttatccccttttccaattcccccaacctccccatcccatccctcctcctcctgcttctatgagggtgtgcccccacccacccactcctgcctccacaccctcacattaccctacactgggggtatctagccttcataggaccaagggcccctcctcccattgataaccaacaaggctattctctgctacttatgaggctgtggctgtggtccctccatgtgtactctttggctggtggtttagaccctgggagctctggttagttgatattgttgtttttcctatggggttgcaaaccccttcagctccttcagtctttactctaactccttcattggggacctcgtgatcagttcaatggttggctgcaagcatccacctctgtatttgtaaggttatggtagggcctctcagaagacagctataccaggatcctgtcagcatgcacttcttggcatccactatagtgttagggtttggtaactgtatatgtgatggatcaccaggtgaggcagtctaggaatacccaagatacaattcacagaccacatgaagctcaagaagaaggaataccaaagtgtgggtgcttcggtccttcatagaaatggtaacaaaatactaatgagggtaaatatggagacaaagagtggagcaaagactgaaggaaaggccatgcattattctatacttataatctcatcacagctcaaaactgtgtggtttagcacataaggaaacaactgagttttgttctaaagacaatggcttaaaatatgtagggtacaagtgaaggaaatgaggctgttagtactatagaggagacttctggctaaatacttgtctttacatatttgaaggctgccatggcagtaatgaataaacttgttctattgtgctacagcaccagaagtttgaacaatagattaaacctataggaaatacaatttcagttcagtatgagaaaaagctgtcaaacaatctgagttatccaatgagcagtagactgctttgcaaagacacactgtcccctgtaagtgtagtcattctaacatagagtgggtgggtttcacatttttcatcaaagcccggtccctcttcatttctttactctttgttcccaggaaactgtgagactatgtagaatcatgtacaaaccactagattaagtgatatttataaccagtttatcccatgtgtccaagttctgccttctttcaaccagttcttcttcatgatgttttattattggtgggaagatccatgcaatgtaggtctccaactggtacttgagtcaaacgacctttgaccaatcctgccaataagaaaaaagagatattgtgcatattcttctctctgtgtctctttctatgtctctgcttctacctttccctctccctatctctctttccacacattcatgcatgcttgcacacacacgaagcacaacacacaactgaaatgaagaaattaagaaccagagatgctaaacccattctcctagaacaacctaagtttcattattccagttatgtcttgactttctatatacactaattactcaattactttatttagaagtgtgttgttatgttataaaacattatcccatattatgacttctttgatctcaagtcaataacatttcactggcctcagatgcttctgtgatcttaatgcaagaggcttaaatgaatgtggctatagctgacattcctgggctctctcctgtgaaaagattctttatacatgctgtctacattttataacttggaagttgcatccagatccctttaaaatcccttggctataatcgaatgctgtcccagggatgacttagtgcactgggcctgagggagagtgtttcgtctcttggagggctgagtagctcctttaatctatttaccacaagtgttcattgctctggggctctgggattcttcaggatgaaagccctctataaatatttgttattgttatgataaccagtatggcttcctgagtgagataaatttgtcctctcgcttctgcttcttgtagcttctcttcctagcttttatttctctctccagataatttttgcgttaaagaaacaatctatttgtgcagttaattaatctgagtacagtgtgatagggcttagtgactttacaggttgtaactgctaagggataaaggcctgagagctgggggttcgtaccataaatatattattttaatcaatcaagggggaaaaaatccttggaaacagaattaaaagtgatagcagcagaataattaaatattgtatggaagggtcatggggactggtttccacaaaattaaaaatggtaaatcaatgtttgcaatatcctgtaggctatcatcaggatagttcttgatttcagccttctataagatgacaggatctttcttcactgagaacgtatgtcctctccggtctatccccagactcattttctagacccatcctgtccttcccttgctaataaaccattcttttcctccttactttcaaagaccactccttcaagaggtcaagtggaaatctcttcctagtactgctctggctatgctaacttcaagacatctctctgctgcacatttctctttgaaatcctgatttttatcccattttcatttgccatgtcacaggtagggcaggaaagtccagtaagcttctaatgtgagttattcttgtctcccaagtattatcagtttgaaagctcataaaagacagagcccactacggtctgaaatgatatgtgttagtgttcctaaatatacaacttcgtagtaggtattagattaattggttcactgacaactatacgtttgaaaagaatcatagttgagtaaaagtggaaacatgaggcaggcagttggatactgatataaattaaaagatgaggggttcttagaaattggaatgaaagaaaacgaaatagatctctagggattgagatttctttagcaattgtgcaagggcagtcaatcctagctatcacccagacacaaaacatctggttacatccaaatatgattgacacagctggtggtatgaggagagatacttctcttctgaagttaatgacttctgcacagctgtgtccagtcttccagcagctgctctgaatatagtctttctggatcgcatctgttgattctacacaagtaagatacatacatgggacttctttatttcaactccaaatatgttgtgcctgtggtattggcctgacctgtacgtccaaaaaggcaaatgatgaccacttctatctttttagcttttcaagccacacaaccatttaaattaaatagaattcatttgtccacctgctcccaccctcatcttctccacttatatactgtttccacttcaagccaggaactcaaattaagcccagaaaaaaaacaaaaaaaaacaaacaaaaaaaaacaacaacaaaaaaaaaaaaaaaaacagaaggggcacatagtaggggcttaataatttttctaagtaaggctgatttaattaaagatctgctaaatagagtctaaatgctaagccatctgtgtttaatttgaagaagaaatgtggctgagcatcatcacaagtctcctggtactaagaaagaggttttgtggatggtatgacagctaccctcagttagacaagacaagataagaagaaatcgcagcttgcttgagttagataaggaggtagctcgagcagagtggttaaaagcaagggatttggcatcaaacagatctggattagaatcacagctctggtccatgagtacctatgtgatttagcataatatatttcatgctctggtactagtcttcccatttctaaaactaatatagtgacattgccaactttgtagctttgatttgatggtcagaggaaataatgctgggtcttgcaagttttacggggtgcataaggagaataaaaaggcaaggattcagaaaaaggagagaacttgttggcacaggtttagggggcataattttttttaatgctgtgaatagatttgctcccacagttagcagttttctctcttttgaaccgtgatgaagccagtcatttctagtggtgatctgtccctagcattctgaaaacttttttagtgtatgccatatccccatgcttcatctcgaatccccacctctggaaactatcaggactctatctttccatttcaccttccttattctaccatgtcttgcgacttctatagtgccagttcatgaagaaaatttgaatcaagtcctttcacttttctgtatctgttgtccaagtcaaaaaagcatattgattaataccacaaccaacagagtcaggtgagaaaagttatcaaaagccattatccactgaatttaggtctgcttagatatagtaggaaaaaccaggtgaagccatattagcccttaaaggaattttgttttgcttggtaattttagctgtcagtgttcatgttcctattaaacaaatatccatcaggagttgtgcttagcattagaaatacagaaaaaaaaacctatttcttctttccctgaagaagctcatatcttgcaaagggagattaagaaagctgatgactaatgcagagttctgaaagctccaacaggtatactgtgagcatccaaggcatcagcaaatattggtagatctagcaggccagactctttaagcaaactgagtgttattaatatatagagataaccttaagtctgtttcatccatttgcaaactttagtatattaacaaatatttgtgatactttagttgcatatagcctgtaggtgactttaacaggtctgtgtaatgttagagttataagatgataaaaatactttgtttgctggtttcctggtcctattaaaatactagcctggactatcatgtacttaactgcagtaattatttccccaatgcctcaaggaaaagctgaaagttggagaatggagacggggagggggtgacacgattgaagtcactataggaagatttaagaatgaaagtgaagtttagtgtatgatttgtcacggtaacgagacatggtggacttcttctaaggacacaagaaaccagacaagaaatgttatcagagtgactatttacttttttgtccttattctatctcagtggtgatcaggtagggaaactgaagtctgtaatgtcatttgaaggccaggcctgagataagtcacttcatcatatttgtattggtaggccacacagcgttgggcttgggactgtgatgcaactgtagaagaggcagatcctctcaggtgctggtgtggggatcttgcgtggagtcactcctagtgttcataatattcaacctatcattgtaagtatgtactacatggattatctacattcatgtgtgtgtgtgttcatgtgtgtgtgtgtgtgtgtgtgtgtgtgtgcatgtgtgtgtgtgtgcatgtgtgttagggagataatgctaagaagtcaaataactaaaggagtggaagatagttcagaaaggagtgctgttaagaatgtgtgcttggaattataaacccttctttttcactttgaaattaatacaaaaggtctctgttatattgtaagaataatgagttagcatttgcaggtattttgagcttttgtattttcagataaagcaggttttgaggtcttcttatagtggataagtattgtacatgaataattccagagaaagaaatgctgattagattgctcaactaactgtctggattggtgacacgttgccagcatcttcacacttatcttgtttaatctgactgcttttcttggagagtttttcaataggtaatagaaacttgggtttatgattattgtttataaagagctactattcctacactctggcatttcctgattcattatgacacttctaattgttatagaaaagcgtacatctaggagctcagagatgactctagggatcaaatttctgtttcaaattttatcaagtatgaaatgagttatttcactgctcagacctccttacttacagtgaacacagtgaagggattagcaaggtccacaacttcctagatatctcttatttctctctttctctgtctctctctgtctcagtctctgactctgtctctctctctctctctttcactcactgtctcagtatgtctctgtctctctctctgtctctctgtgtgtgtctctctccctatgtgtgtgcctgtctgtgtgttgttctgttgtttattcttacaatcctagaaattgaatctaggacctagaacagttgaggcaagtagtctgtcactgagccctttatgtacagaataagaggtttacttatgccattttcatatatacttaaacaccttcacatatcttccctcagcctgcctttgccttagccttccaaatcctttcttttatttttttggggatagaggtatgctctcactaagttaacaaagcaagctttgaactcactttgtagcccagaaagttcttgaatttgtgatcctcctccttcagcctcccaagttactagactatcaagttcgaaacatcaggctggattctggactactttataaaaaaatttcactgcattagataatttccaactatttaggaggggagtgttgagacaggatctcatcatggaattttggctgttctcaatctcacgagatctctgtctgcttctgcttctcatgtgctgaaattaaacaggtgtgtagctccacgtctggtggcagtagcagctgaggtggcttcttgttcttcttctccttcttcttctacttctgtcgtcctcctccttctctccttctttttgtcttcctcttcctcctcctcctcctcctcctcctcctcctcctcctcattctccttcttctgactggagatgaaagtgtgtgtgtgtatgtgtgtgtctgtgtgtatgtataagtcatcaaattataagctccataagacctccccttgctcactacatggatagcatgtgtaagtgttattgggttgagtgaataacaaataaataaattcaattttctgaattaaaaacccacggcatttcttttttcagtgttttatttatttttttattttatttttttattagatattttttaattaggtattttcttcatttacatttaaaatgctatccaaaaagtcccccataccctcccccccccactcccctacccacccactcccacttcttggccctggagttcccctgtactgaggcatataaagtttgcaagaccaatgggcctctctttccaatgatggccgactaggccatcttctgattcatatgcagctagagtcaagagctccggggtactggttagttcataatgttgttccacctatagggttggatacccctttatctccttgggtacttcttttataaatctttatagcaccttctggtacctgaaagctagttctcaggaagggtgctttcaagtcatatctagcttgaggtctctgggtcctctgtccaaaattagtcttcccccagggaaagggtattttgtatttttgacatttttattatgctatctgtagagtacttagcacagcaatgtgcataaagtggctactcaataattgctcactctgtggataaacctgagtcttttagcatcacaacatcattttccggtgcattctgaagaagaaagtgatcacctgcataggaattttaagaggcagggcctatatttgtaggtttgaaaagtggatacattaaaagcagccaaccctcttaataagagattgtttaaccgcacccctagagatttctcaaagagactattgtttggtgatttcaaggtgggctccttctcagacatccacgttgccatggagatagcatgtttttctttctaaatgatatttacttgtactctcagaagtctgttcggcaaattagcacaggtgatttgagagtagaggagttggctctgtcagcttccagatttgctgtgccgtaacggcctgggctgccaaattaatcgaggaaagaaaccttaaagaccattctaaaagaaaggctatttttgagttctttcttatgccctctcatgcgtgagtgagtaagtgagtgaggagttattaatccaagaaaactaggaaagattcctagtcatggtgtccaaaattcaggaccacaactggcctgtaatgggtatggccagagaaaagagcacatgagggtgggggccatggtcatgaattgtatagttgtatagtgtgaatcatatactagaatacttgcagaactgggcgaaagagcatagggatatctcctgatgctgattgatcttagtttacatagtatgagctctatgaagacagtggccacatcttgacttaatctgtctcatccgcaaggtttctctcaattccttgatccctttctagccacttccaacttggagtgtaatcttacacatcttaggcattaccctgtgtttcttgtctatacccactgctgcttcccttagctctttcccaccacctccttcttcactgaatatttgcttccttctctcctgatgcctctttgtcaccctataatcttttgctatcaaaatgcttaccctctattaaggctcattcaaatgctatctcaatgggaaacaatctcttggtgttggcaaatccttgagcctttccccttactcttttatccttttgaggattaacacaaagtttctgagaagatactgaaaatgggaaaaccatagctaaactgttgcttgattcacatttatgtgtaaactgcaaacacaggacttctggccatcttttaaggctggccaagaagtaatctgtatgatgaagcctgttgtattattgttaggcaaaacaaagaagggttatttgagtacaaattgggatattacattgaggcatcaagtctacttgcctcacctttcctctttcgaccacagccctgtgtaactcaacaactacttccaaaagcttttctatgccacttcatgaactcccaaccaatcgctgttatttttgtaatggaagtccaactggtaggagtttgacaatatgataaaaattagaaaatatctattgccttacttaagacattcccaagccacatatgacacacacctggattgccaacatgtgggaaagtgatgccttggtttgtgttatactcaggagtcttttgcacatgagagagagagagagagagagagagagagagagagagagagagagaaacatcaagcttcatggaaccctgaagttctagaagttctagcaagtctagcaacacgcaaaattgcctaacttgctaaaagaactgcattgcacagcaatgcagtaagcatgcaacccttgaagtaactcagtattgtagccaaaagcacccatcatcaacttagttttcatgcttctgctttatctgaaaatccagacttatttcataatcctctccaaataaaattgtatttgctggaatatttaaagtcatatttttgctccagttgatgtttcaaaaccttatcctatggctttcaaggacaatgtgggaccgtcactgtgtgtccaagttgtaccttcaacaggtggtaaagctgaagagaagtagtctatgaagcatggatgggactgactctttgtggataattcctcctcagaggacattcttcaccaagctcattgactccttacttcctgacaaggtgtatgcctatttttgaggtgagcgctttgctgttggcacaggggtactgctaggttgtagtcacattaaacatagttcttgaacttcatcttgtgcattagagatgtccctccctttctatttaggcgcaatggtgtgcttatttcttgctgccttgaccatacagcttcaatggtcttgctttgcctatagtatcaccatccctagatgggaattccttcttgttctgtaattcttggctttctctcttttgttctgctcttctatgagcagagctttctgctgaatctgactttaaagtcaaggttttgaggctgttaccacttctgagctttcaccgaggccagccagccagtaggttacagcaacagggttttatttgctgaatttatgcctgtgaggtcctctccaatctatccttttaacaggcaaacacccttggccgtgctttctgctcataacccaaatcttccaaattaaacaggaaaacatcttacctattgctaaactaattcattttaaaatcagaagacacaagtaattatgaagaggaacaaagagcatctcactccgtggaaatagccaccgccaacatgtctatctttgcagagcataaattcatttaatttcccttcggtaatgaaaaggaaattgttggtagggcacagttctttgggggatggcagtgatgtgacttgaaatgaagcaaagcattcaagattcctgcctacatacctgagatccgactaagaatctctgaggtttagcctggctcaggcagaattcactatggaaagaacacagaattaaatgtcaggacagaagctattttataaagattgcctgtctttgcccacactcggtagcacaagcaaaactgcccctgcttattgctggggaaacctgagttctagctctgaagaaagagtgtccatagtccatactaagtaaggtccttcaaagatcactcaccatttttggaaacaattcttactttccaattataggtgcctgtctggtgaagaaatatgaaggctggtcttctgtaaaatgtagttgttagttatggaaggatgctgagttaagtcttccttgaagtatattcagcaccgcccatgaacatgtcaaggcatgtttacaaagcatttacatagagcattctgtgtagccatctgaatagaatttgactttcatttgttccatctacaactcaacttctcacatgagaatgtacctcaatagcccctgccgggctggagttccaaggggtgcagttctgctaaccagctttctgatacagtaggtctggggtatggggtttgtgaatttgaatttcttccaagatctcagtcatggtgatgatgctggcttgaacatcaggtttctacaggactatctaggaaagataagagccaatcctaaaggtttagggaaaatgaactgaattttctaaaacattttttttattctttaatctttttttttaaacagtcccgactttatctgcttccctgtctgccctctgattgttccccatcccatacctgctcctcctcctctccaccccaaccccagtctccaagaggatgtccccaccccaccccacctaccttcccacttcctggggcttccagtctcgtgagggttaggtgcatcttctctgaatgaacatagactcagaagtcctctactgtatatgtgtagggagcctcatatcagctggtggatgctgtctgtttggtggttcagtgtctgagagatctcaggaatccagattaattgagactgctggtcctcctacagggtcacccttctcctcagcttcttccagcttttccctaattcaaccacaggggtcagtagcttctatccattggttgggtgtaaatatctgcatctgactctttcagctgcttgttgggtctttcagagggtagtcatgacaggttcctttttttgagtactccatagcctcagtaatagtgtcagaccttgggacctccccttgagctggatcccactttgggcctgtcactggactttcttttcctcagactcctctccatttccatccctgttaattctttcaaacaggaacaattatgcgtcagagatgtgactgtgggatggcaatcccatccctttacttgatgccctgtcttcctgctggaggtggactctactccccactgtagggcatttcagctaacttagaaccgatttatgataacttttatagagaagtaccagatttttcaagagcaaccactactttgtgcctattgtaggttttattttacatccacgatactatttttgatccagggttcattttcacctattgattttctgcttgctttttaaatttttgttactcagagggctttcaacatgtagccagaatggtctcgaatttacagtacccttttcttagccagtagaatgctgggattgcagctgtgggccttcccatctggctgtttgcttgctttgttagtttctgttttactatggtcaacagtaaacccaggacatgaaaagcaaagactgagatatactctgaccagcaagtgagtggtttgtttgtttaattggatggtaagataggtttggttttagtttttgggttttgttgtggtgatggttgtggttgttgttttggcttctttgtttgtttgtttttgcaatagtcttagtcttgctctgtagccctagtgtagtaccagtccctctgtaggccagtcagtactcaaactttcagcagtccacttgtctcaggattcctgtgtgtgtgtgtgtgtgtgtgtgtgtgtgtgtgtgtgtgtgtgtgtgtatgtgttccaccaaacccagcttcccaccttttgtttaatcaagtgaatctgaatttttgccacgtttatcttctgaaaaagaaatatcatttcctaatcccctcagtggtgtatggctggtctcttggaaaggacttttggctctgcaaattaacagctgcaggtctttgaacaagttatctaatatctctaatatctctgaaccctgatgtctacatctgtgaaagaaaagaaaaacaaagcaaacacatccaaggaacatccaaggagcatgagaattagacaaaataagaagtgaataaaaggcctggcataggagactggatttcttaagcttcacccaggcccttatattctgtatttatgttgcatgagatgctggtcattgtgtccggtgctagtttagctgcgttagctttaaatgtctccctagcagatcctaggctgtgtcttacagatagatatcatagcaaaccaagtttcacctcatggttctatgacattatgtgtcaagaacaagcaggaacaggtttaataattataacaaacatttattgatgtctggcaccatgattaccaagaatgagctcatctaatcctaatgacagccctataatgaaggtattattactattattttacagatgagtgaatggaggcccagagaggttaggtaactagcctgaggtcacacagatgctcataaatactgagccaagatcgaaagcaaagaagcaaaggctgtcttttctccaccatttaagcccctaacaacacctccctctccagttcagaatgatttgtccctgttctctcataagtagagatgaaagcctgggagtgacattccccggcttgaaaaaaggcaaagccaaaagctaaacttgggctagatccaacctcttcagtttttacagcactacaactttgctttggtacaaatagaacttttccctccctctttcaggcatcagacaatggttctgctgactagaagcagtgggggtggtcaatacttgtatatttaactagcagctctctgtaggaggaaggaaagccttgctttatagccttccttgattagcatggtataaatactccagcctagactgactgtgagctctccatgtgaccacatgggatgctgacttggagctagcctgagaatctctactgctctggtccttgctgagaatgtgactccaaagtaacattctgacagtgaaggaaaaatgaatgcgttagacaccaagattaggactgtcaggacaatcactacaatggacaactcttcttttagcgtttagcaccggctctattaatgatattcagccctgccaagagtctcttagatcttatttatagaatctttgccccctcaatgggtacatgaataggttgtgtcatgctctatctttagaaatgctaatctcttgtctgaaatgatttctttgggcacagatgaactcactcctaaagtatgtttttgttttggtaacataaaatagacaacaaaaaaaaaccctctaaacttgcccaaggatgatgtgtttatttctaaataaaaaaaaataggaaattaagaaacacaagcaaaacagaaaaaacgaaaagaaatagatttttaaggacacttattctttcaagatctagagacaaacatggctgacatttgactatatggtcctctcatatttttttcttcctctatgcagatatcttcttttgaaaaatagctgtctgtgaaggaaatacattttcaaaatgaaaagctatcacagattattatcctctctgtacgggtcctgccactgtatttgtattcacagaaatggtaggttagctatatttatgctgatggtctacatgcatttgaagataataccactaatggggattgttatctatgagtacagatggggcgaaaaagaccaaggaggcagtctcggccctttccactccatagaccactatacatagtctgattttgagttacagttgctgctgtgctgatagggtggctgattaagactctgcttcgaagccctgaggtcaccccagagctcagaaaacaaccacctcctgcattcccttattgctctgggcaggcctgcctgctgtctgtttccctgctgcctgcagcctggccctattgtttgaagtggggcttcagagctgctttaatggattttctttgccctccctgcttggggttacctcaccatacaaggcctgatctggcatcctggggccatccatccttcatacatgtccagcccagtgggaaactgggagaaatggaatttcttcattccctctactcgctctggattttagtggaacaataccagagaaaaatgtggcagtcatagtacaatgcatgatggctgactctgggaaattaatgtttctttttgaacaagacgttccttctgaacctgagaatagtggccaaagctatggtaagcagacagagccctctggaatttttgtttactctctagtgttcatttccttgacaactcatatgcctgacatgtttccagagttctattccttccttggaggccaaatctcaaagatagataacaaacagcatgtctgaagaagtggaattctttataaagactttcttaaaattatagtaaattatgtatgcatacatcaggagtatttggtccattgccactgatagtttttgctagagtgttgtttttgttttggtaagtgtagatcatcaggttccctccagaaaacagaaactttcttgattgagaaaaaaatgtaacaaaagagaacatgggcctctggacagtgcataggagacgggatttgtttgtttattcctttgtttgtgtttgtgctgttgattttgttgctttgcaggaggactcagtccttgcaagtcatctagcctgcccttgtttcagtttcctcctcagtaaaaacaaaccaacaacgtgaggccagcaaggcagccaggcatgtaaagacaacttacttctaagcctgattacctgagtttgatcactgaagcacacactatgggctgactctcacaagtggtcctctgacctccacaaacatgccatggcacatgcatgcaaagcatgagcatgcacaattaaattaaacatgtggacattagcttaaatgaaagtttcccatcttccacttccaccatattccacttccataaagtgaccatattccacttccactagagtcacaagccatctaacaaaaatcccaatcccttctaagtcgttgttcagaaatatctgagagactctaagaacatagtaagttcttgttattgtccttggaagccctgcagagttggaaagtaagtccttattgctgacgacatcatatccttgagacacaatacccagagaatctgaactgaatatgacccaaaagcctctaccctcaggactagcttttatgctaccagaaggccccatgcaagctaccaaagaaagaaagcaaccaacagttttacccagttataacaatgctttagttaatcttctatcactataacaaaacactatgacccaggtcacttatagaagagtatattggcagcttataagggactatggcagaaactaggcaagcattgccctagagtagtagctgagagtttacacctcgagacataagcacaaggtagagagcgctaatttgaaatggcatgggctttttggaacctcaaagcccaactccagtaacttacctcctccaataaggtcatgcttactaatcctttataaagagttctaccaattgggaaccaagtattgcaacatatggacatgggagatacacattctctttccaaataccacaggtgcctataaccacaacatagcctgatatccctaagtgtttaatagtggcccacatacctagacagtaaccaacaataatactctaattggccttaagaccagctcaacccagagaaatgatatctgataatggaaatctagtgaacactctgaggttggagaagtcatggatcttggagataaacctacaggtgccttttttttttaaactaaatcagcttaatccacaactacattttaaatattcatccaataccaagtggtcagacctgagatcatatacatacaagtagcattatatggactgaaaaggttgtatttaagttaaggggaggagagggcaaggaaaatgatgcattcttttttcaaacatagaaactaaagagaataaataaaagtttcattctgtactgtttaaaaataataattgtccctaaatttaggttcaggaaaagaaatgaacaggactggggagttagaagagaccttaaattttaaatttgactttgttgatgaattaactcttggttgaaatggtaagtagtttttactactcagtcgctcagtggatgctcctggagactgactttccagaaagaatgttatccgtctgtgtcttcgtctcccaaattaggatgacaatgaatatagtttgccacgtatttctggcttcaaaggcaaacattttcctgtaaaaatatagacaataaagacaaaggggaaaaaggaactggggaaaagtatgttgatttcaagttaaagacatatactcaacaaccaaaagcgtaccaataaagcagcacagaatagagtcaatatcaaattggttggaaaccctctgccatctatcattaaatgacagggaaaagtacagtggcagaagttgatgctttcttttttatggatgttctctctgtaaaggtctactcttttctgattatagttagtaagtactagcactatctattttctcaaaccccaagaataaaagcaactccactatcaaaagaaatgtttcttgagggctcatatgtgcattcaaaataccaagacaagcttctagtgcctaaagccagtccctaagatcctccagaacattagtttcctctgagaatgtgcttaaaggccgaacttgcttttgccttttgcttcaaggaagctgaataaacctttcaaaagcccttcagatggtaaggtgatgatcccagccaaagaacaaagcaacccaggacatctctcctggccaccaagaataaacaagaaaggaagaacagctttacaaacaaattaaacctcaactattctccccttctgctttcttcatcctacttggcagaatctcagagcttggggaaagattttggaacatagaagatttgtgactgagataaaacttcaattttgcagaggctcagcagttagggcccttccaagaggctgtttggttttttgacatttcaaaaggacacccttttttgagcaactaaagtctcacattaaaagaaatattaccactaatttatttctaatgaacagttcagaaagcttatttcttattgtcattgtccttgtcatcatcgttgttgttgttgttgttatttttgacacaggattttactatgtagtcttggctagctcagaattccctatacagaataggctagcatagaactcatagatacatacctctctctgcctctcaacagaaaaggatgttttaaatttatataatattttatgaacaatcatcacttatttctgattctagttcctttgatttcaaattgattaatttatttgcaactagattttttttgggtattaagccacttgtccaaatagaatcctaatttaaaagtcatatttattttcctctgtcaagagcaaagtgacattagtttgtatattttatttattttcattgttgttgttgttgttgttgttagagacagggcctcagtatatagctctagccgtcctcactctgtagatgaggctggcttcaactcacagagatccacctacctctgcctcccaagtgctgggattaaggatgtgcaccagtatgcccaggttgtctatcagtggtttttaaaaagtaggaagtattggtagagcaatgctatgagaccttcaaaggaaattatgtagggagaaatgcaactatttgagtggatatgatttataactccattttgtattgaaataaactacaagttagggttgttccctaggcaaatacaacttcaagttaatgttcctgcattactaatagaaccttgactggattaattttctcagctaatcatgaacatcccataggcatacaggttagagacatattcataacttctgccctcttcaggtggggttttcttccatggctttgggcttgctatgcaagtaaaagttgtgttagttaaccaggcggtggtggtacacgccattagtcccggcagaggcaggcagatctctataagttcaaggccagcatgacctatagagtgagttccaggacaaccaggactacacaatgaaactatgactcaaaaagaaaacaaaaaaagaagtgttattttttttaatttatgcttattaaactttaaagtactggattcccttccctacccaacccccatcccatgagacttcattaatgaaaaccaatctgttttcagatgattttcagtatgtaataatgaagagtggattttaccacttatcacccacaaatggacgaaaattacccaaacagctgaaagtctgcataattacagtttatctaaataaaacacatgtagtcatcttctggaactgacagaagggcatgagttatagcaccatctggaatcatggacaaggcagatacatgttgaagcctaaattaataaaggctgagcaacagctaacagcccaagcataggagatcagcattaatgagattaactcttagactaccttggtacatcactcaacctcattataagaccagctataagctttttaatcccccctttagtaccagctgaatatatttactggagaggtgcacagtatggattagtgatatttgttaactacaggtggggaccgacataaatttcatggattcgtaatcactaccctgggttgagagatttgggaggaatccaggatcaaggatgctgcactggtattctgcctacttcaatagtacagtttagatagtcatcatctttgcacagatgtgcagcatctgtctgaaatcaatggatcatcaactctggctgcacaatagaatcacatggagagggtttgaaaagtcccattgcccagcccaggtcctacagtagatgagttaagacaaatgctctgaaaatggggtcataaattcactgcctctaatttcaatgtgtggtcaagattaggaaactcagatccaaaatgtgactactacaataaagaaaaccaggaggcctgagggcacatttagctggaagatcagctgactcctttacagataaccatacacccaggtgccaggtgcctcttggagtcaaaaggcaatatttagtgaggattatttttactctatatcaggcaatgtgaaaaaatgcctttatatgtctcctcttagtttatccttgtagcatttctatgaagaatgtattatttctattataattttttgtttttgaaattataatcacttcctcccatctttttcttccttccaatccctcccttgcactctcttgccattgctttctctctgattctcagcctctttttgtttaattgttgttatgtaagtaatataatatataatacataaatacaacctgtgtaatccttttaatgttacttgtatgtatatgatcttagagggaccaactcaaagttggtattggataactaactggagggggaagggagcttctctgagaaaaccatttttgtcaatctcagtattccccagttgcccatagttctctgtctagtgatgaggtccctcaagctttccccagttcatgttaatatgttcattggttacttcattgttcaggtcctgcttaggcagccatgttgatgagactgtgggtgtagcttctctaacatttcaaggaatagacacaatttcacaccaaacatccaaattctctgactcttacaatcttcctacccactcttctacaatgatccctgagcctcatatacaagaattgtgtagtggatgtatcatctgcgacttagaccacaggatcccctgatctttgcatcttttctgttgtggttttctatgattggctctgttgcaaagagcagtttccttgccaaggagtgaggactacacttatctgtatgtataggaaaaatatttagaatgtaatttgggatgatgctgagtaaataaagtgtaggacactttacattctccactacagagccacgactaccctagccctgaatagttgactagctttccaatactaggcatggtttccctattattgtgagggcactaagtccatttagagactattggttactttcaaggaatgcattctcctattgcatccagatgagtatcttgctgtgctggtggtcatggttatggctcataggcatcatagttgggtaggacagggttgcttcccttctttgatagcttgcatggggccttctgatcctaacagccttcacttttgttaacaattatttagttatatttcttcttaaaagaggggctattttataagtactaagttttgttgtagaatttgactctaatccgcactaaggcagagctgacatcttcatctacaacttggactttcctacagaattgcttttccttacagaaaggaaagagtcttacttcactgcgctataaatcaagttagacatagttataaatagcagattgtttaaattgaattgagtctacttatagcttctaagtaaaatatcaaaaccaaactgttgcatgtgtataaagtttggtgttcagttagaccctgatggactatagcaatgatgagtgtttgggttggaataaggtaaggatttcagaaggaacttggctaaaacataaccttgtaaataagtttgtgggttttgtgacacaatgattgggcttcgcatgttttgctaaaaactagaatactatcaaagcattcccaaatttaaaaatttaataacaatcaaaatcaggaagtagagtagggggagattaaaagtgaagacaaaatgactaaaagccattatatatgcatatggaaattgtcaaacaataaaacaataaaactttaagtcaagttttcttataattctttagcattttagtcagaatatactttatctctacatgtagggaatatttggttttgatatagtctcactactagcatcacaactgtagaacctaaaacacgtgtatttattttaaaagttcaatgtggccaagccagcgatgcagctcagtggtagagcatttagcctaaggacttgtgttcaattaccaacatcattcaacggtagtatgaatgatagagagtttaaaactgtgacccaaagtttccagcctctgccttttaggtactttgctcctgcctcctatagcttttagttgaatataacctggccttctgaatcattcattgtaaggttgtgagtagtgaattaagtcctgtgagaatgtacattgtttgatataagcatggccaaggtctgaggaagaatgcctcaaacccaggggagtggcaaaacttcctaggatgtgagttcaaacactgacagtgcattcaggacatgtacccagtagttttggttttttttttttctctctctctcaggtttatcacctacagacagttctcctaccaagattagctgaacctctcttcttgatccaggggtatacataagtcccacccccattgttctgctgtatgtagtcagacagcctccctgctcaactgaatataataaacacactgagcttctggcagggaggggtttcagcttctccatcagagaacccagtttccccaacccagcctttctttacctgtatttgtgtacctatcttctttatttactttgccgatcttagggttcccatgcttaagctgtacaagatttttcaagcagtagccttaggaaaaaaattagattttttttctcagtgttggaacatggtccaagaatggaatcatgcaaggagaattctgattgggaggaaactccaggaaaacaaggcaagagtcgtgacttcactttgttcaaaacaagtaattgttcttggaatgtgtgtttgtgctcctcccaggtgtattgggtaggactgattttaactcagattattcagattaacagggcattattatttgttcatatgcttctatagaaaaatgtggtttttgccactggcagcttgcctttgcaattggacactctactcaagtgactagtcttaacacacagagtataaactgaataaagttgcctactgaatgagacttgagtctgcctcatttatcagctccattctcccaggtcctaccacccctagaaaggtaaacactttggaatagggagaatgaactttttatttatatgtgggcagcagagtaggaacatgaatgccccatttcctttaactctccaaatatccaggccaactagatttttataaacaattcctaataatagagttttctaagtgatgttgtatttttaaaaataaatgtatgggtatttgtatgcctacatatttttatgtgcaccacatattttcagacaccaaagtgaattagaagatggcaaaggatcacatgtactggaattattcatggctggaagccacctgttataggggctgaacctaacctacatcctatggaaaaagtatttctccagcccctaagtgacttttgaatactgaatatgagtatgttgatgacctgggcaaaatcaaaagaataaataaacaaaacggcaccttattgataatttctatgatccccagtgtacagataaacaaattgacattcaaaaatgttaagtattttccctatttttcaaacccttagttcaaatatgtgaaaattctaagggaataagatagtggtatagagtgtgtaaagagttgtacaagagttaacatatcttctcatcaaagcactaagaagcccatatcctttgtcctcatttagaagattgagctcagcaaagttgagtcacttatccaaggcggagtccactaaagcagttgttctcaacctgtgggtcatgacccctatggggtgagcataccagatatcctgaacatcagatgtttccattacatttcataacagtagcaaaattccaattatgaagtagcaaggaaaataatttcatggttggggatcactacaacatgaggaactgtattgaagggttgcagcattaggaagattgagaaccactgcactgaagtaacataataagaacatagcttggacatagctcagctccaaaacatgttcagcccacttcaccagctactctttctcctgttgccactaattgaatgcacagaattttctttgtactttgctgatggcagttgagatgtcattctgtcttctaagatgtgtggcagtaatctttccctgactaatagaagctatgtgcctttgttttgttcactattgagttttcaacaagcagaatggtgctgagtacacagtaggtgcacaataaatatgtgttgtatgaggatttgtaagttttactcttcttagaggtatgacttttgtatgcaaatgaatttttaccatctaagacagccagtgacagtatcatgtatcataatgctttacagaaaaatgcttcaaacagggtcatgggtccccaagtggggcactgtttttcaagtgatggaaactgaagatggcgtggtctatctggcaaaagtaagatactgcgagatttccctcgagtggtatatttactgctccccaatctctttgtttccactttcttgccataacaagagagacaattttgtcatatacctgcaacaccatggtatgctgctgtctcaccacaggctgagaaacacgaaaccaaagattatagactacaccctctgcaaacaaatcctccctaccctgttctcttgggcttcggggtcacagttatgcaatagtgtttaatatatgtatgttaacttcagtgttgatatagatgtctaccccaaggtcgaagttacagaaagtatcagtgaggaaagaggcaaatgctcccccagaggaggctgtggcactctagatttctctgtggagagatcaggaaggattagcaaatcatgattctaagattgagaatgtgctagtgaacctaaaaaaggccaagggcagccataattcactgagagacagagcccctctgctctccaccctatttcttataacttcatcccttccaaatccccacttctgccctagtcaacttggcttacaatactggatatatatatgtgtgtgtgtgtgtgagtgtgtgtgtgtgtgtgtgtgtgtgtgtgtgtgtgtgtattacttcatgactgcctctgaaactgagaagttgctgcttgggtaacaggactcatacttgttacgccttcatttccctggctcttcatgataagcctatgagaccacagtgattctttttcaaaacctgtttgttacatttatttattgtatgtgtatctgtgtgtttggacatgcacacaaacagtgaatgtagaggttaaaggacaactcacaggagtccattctctcctagcttgtgggtcctggagatcaaacactgggcttattggcaagtgtctttatctagtgaaggcatcttattagtccacaacgatgttttttatacccattttaaaaatggatgaaatgcaatgggggtttgtttgtttggggcttgtctgagaatacattacttttagttggcaattcttcttttgctatcattctttttttcttaacatatcatctctcagtaaatactgaaagtggtcatttgtagaaatatccatctgcttttgatatacaggctataaaggataagggacagaagtaagtagagcattattttaaatcaaccacatagattgaggcaagagatgaggagcctacactgtactgagcccattgttctggactttattataacaactttcgtcagcccactctcttcctgcactcctgaatgcttcacaaaagctatcgtcatgacttagcttcctctgacctccaaatgatccacttccccatgggcttgtctctatacctctcttgttcatgctttgtttccctagtcaaatacaagtatttgtttatataataaaatgtaagtagtgcttcactgaggtggtctgcattaaaagcaaatttatattccttttccagatctttgttttgcaatccaggctgaatgggcattcaacaactacttatcaagtgcctagtgtgtacttagcttttttctaagtacttagattccatctttaatcaaaatagaggaacaacttttatttcactggtattatagaaataaacagacaaaatatatgttaactattcagttttcaagagggtcttagaagttgtcatgaaataccaatgataacttaatatttagaagtaaagtatgatgagatgtgatttgaaatatttagtatgatattcaaggtatgcttctggggttagggttgtagttcagttgggaaagctcttgcttcacatgcttaaaagacctagatttgatccccagaacataaaaaaaaaaaaaccagacatggtggtatatacatcctgtaatatgagcacccatgaggtggacgcaggaagatcaaaagttcaagttcatacctacctccaaagcaattttgaggatagtcccaaatacacaataccttgtctgtataacattagcaattgagccaagtttgaaatggaatatgaaaacaggctaccgagaggaagaatgcttcaagcaacaactactggcaccatgctacttttgaagagtttgatatattttagcaatgaggccagtgtggcaacactgaaatgaatgagaggcagagtggcagactagacacgtaaaggtacgagtgggcaaagggttttaaagttcattgtaaatattttagcccttcctctgaataaaataaaattggtagtctttggtggattggagacaaaggaaaggcacagtcatagtatagtagaagagggccataaatgttgagaaaacaagaacgagcttattacaattaagctactgtaacttggtagctctgtgtgccctagtgtgtctcacagggagtacttaaaatgacctttacaaagcacagatctgcccaagtgtatgccacaactcaaaacccttgcttgttctctggcccccacaattctcaggataacctacaatatctggctttgcttcttaagtcttagcctacacaatctcttctttcccttgtttagtatgttcaaattatttttatgtcctcaactgcatcaaactgctactcaatcaatgcagggtctacatattgattactgacttctctataatggttttctccccattagtttctaagatgaattaatgctttgaatcttagcttaattaactgagtgagtgagactgaccacccctgagtacacctttagcttaagctttccccttgcactcctttctcattctctcacagtaattaaagcaatgcttaacattttacattgatagaaaaaatagtgcctatctatatatgtgcaaaaatactactcaacggccttctttatacttgtttctttgaataggtctttgggtcatgtaaatatcatgaggccaagtaccatgctttttttctagtccaccttgaatactctgtgtgtgtatgtgtgcaacatgagagagagagagagagagagagagagagagaacatagtatctctaatccacagaagacattatctctaatgcacagtatctctaatataaggatcttcaaaataaatgcttgaaaaattgagtgaagtctcttcatcttaagccagtcacatacagctctcctgtccaaccattttaagagtaggtagactcattttcattcggggtctactgacagtctacatagccaagttctatacttagctcttttgcaggcaaaaagaatttaggaaaatatacctgtctttgaaaagtttcctaaataagaatgaataacacatctgttcagcaagatttcttctaaaagttactcataaaatgctgtgactattcacacccactaaataccatgtagttctttataccatatagctttggttcaaaggagatgatagattagaaatctttccaggaaacagttttgtagccctagattttgtaacctgatcaagttctctacatttctttgtctgacactaagtatactggaaaacaattttgtcagtccaagggcaggagtgaatgtattatagtttatccctcatgaaggaagtctgttgttattattgttgttgttgttgtggttgttgttgttttgaaacagataggcagtattgcagagactcatgaatgttaagatccagagaataggagaccagagaaatggctcagtgattaagagcacgggctgctcttcagagggcccaggttcaattcccaggatctacatgatggttcacaactgtccttaacaacaatttcagcaaatctaatactccatcagacattcatttggtgagcctaaatacatgcagccaaaatacccatacacataaagtaaaaacactattaataagataagccaagatgcagagagtaaatgatcatagtgtatccggtcccaattggtatattcacaacacaatccctacatccaaggctgaggaaaaattaaaagaagggcatgggtgggaaagattctaagagccagaggaccctgagatagtgttttctagacatgccagagagatgcagaacacatgaaatcacaacagtaagggtgcctaaacaagatctacatgatggcaacacaaggcagcataacaatgtgaatggggccaatttcacaaggtcccacagccaggtaaagagctacaggcaatgaatggctgctgagagaaggtgaatcagttttctctgggaaggggctccctgattgttatgttatctaatcccagctggtcaatgccacgaatacacatacacacacaaacacaaacatacaataataaatggtatttatgtatgaaaatatacacatttatatacagttcttgtatgaaacaacaataagaagttataaatttgagagggagtgaagagcaacacaggaggcgttaaagaggaaagaagaagaggaacaatttaaattgagtacttatatatatataattctcaaaaaattaaaacttcaaatttaaaacaataatatttttaaaatagatctttcactacccacaagaggcagacactggcactagaatactgactggttgatttcagatttagatcaacatcagaacagctgagaaacagatggttacatgaacaagtcttctgcctgtaggaaaatccatgggggaaagccagagcataacaaagaggactgttggtgtacttggcatcactgcaaggacagttggttgtataatgctaatattttctggcaaccaagccaaatgggatgatgtactcacccttaggatgtgctgacctcagagaacagaagagagttttcttgagccagaggttcttcctagccttggcaaagctatatcgccaatgagctccttttgaacttcctgtctttcagtatttccaagtcattttcttcctccctgttgaaggaacgctgaaatttacatcacatttcaattccatactagaaaggaaatagttaatcatcagcctaggaaatgggagggcatgatgtactgggggttggggcatacccagggggttatcctctctttctaagcctgtgatagaaacacacattgggttactgtcagaattggctgtaagcctagaacctctgctgtctcttcaaaggtaactttacatctccgaatttatccatttcgtatgttgtaatttcattcatcaaattctcaagactttagtgggtgcattgttaggtcgtctaggatcttttatataatcaagtataattctcaaaggaaaaaaaaaacaatacatttctgagcaagggtcattgcaatgttttcatgtggaaattattccatggcaggagcaattaattttgacttgtggaactcagcaaaattttccaaaggggatggcattagagttcactctcaaattagaacactgagctgtagttcagagactatggtaattcccaaatagtaagaacaacttgtatcaattttactgacggtctgtaaggcactgtctgatgccaggactaataaaacttaacccaaggggagtttagaaaagtcctaaatcagaaggttgagatgtatcatcgattgcctgactcagtcggtcttatacaaggacactgaaagtgcttattattctgtatgaatcacaaaccaatccttaatccacaaattgtcaaaatctcttctaagtatgcaaataggatagtcattcctctataagcttataaagtgtttactttatgtcagcagtcactcttggcctttattgaataagttattttccatattgggtgttatggagacaagcattttggaagatatcttacaaaatctaaagttgataattttgttttttttcaacttaagcaagtctcctactagatttaaataacagatatgaactgtataatattgtagcacatttatttgatttctttttaaatttttattaggtattttcctcatttacatttccaatgctatcccaaaagtcccccataccctcccccattccctcctctcccccactcccacttcttggacctggcgttcccctgtactggggcatataaagtttgcaagtccaatgggcctctcttcccaatgatggccgactaggccatcttctgaaacttctgacacgagctctagggggtactgattagttcatattgttgttccacctagatttctttttataaaggttcttgcattcttaaattttctgtgtatcaatggtgtgagatgtgtatggttagcaaaagtatcctcccatttcttatttttcaataatttattaatttactttacatccggatatcagctccctcctactgaccccactttcacagctcctcccattgcccctccccttctcctctgagaagggtgagcaccttcctccgattccggggtatctcctactctcaacacatcatgttcttccatttcataggctgatgcctaactgtttcctttcttgtatggaatttaaatacagtgtaaatttcagccttgcatggtgacacacatctgcaatgccagcacacaggtgttgagccagaagaatcacaagttgaagtacaagttagactatcagactgaactacaggggaagaccctgtttaaacagtttatcctcgacaaacttggttcattcagaaacacaaacgtggctcaacatgtgaaaaataaataaatgtaatttactacataaactaaaggacataatcatgtgatcatttcagtatatacagaagatgcctttgacaaagtccaatatcccttcatgataatagcactaaaggaactagcaatgaaaagaacatattagagcataataatagctatatgtgatgggtatgtagccaaaactatactaactggagggaaattgagagcatttcctgtaaaatctggaccaaactctggcaaggtggctcagtggatatgagtgcttgccaagcaaccttcacaacctgagttcagtccccagctaccactatggagtgagggaactaactccacaaaattgtcctctgacctctacacatgtgcagtggtatgcaggtacctgcacttgtcacatgacttacatcaacatacacactaattagttaacagaatcttataaaatttggaataagacaagacttccaagtctctctgctgattcaatattgtgtaatcattcttagccagagcagaaaaccaagggaaaggagctacaaatagaaaagaaaggagtcaaaccatccatatttgcaaacagcattgccctatatttaaaagagcctaactctaatgttctatcagaaaactcttagtcttaacacattttttcatcaaaataggatatagaaataatgcaaaaattggtatctttcctatatatcaataatggccatgttgagaaagaaatcaagaattcactacaatctgcaatagttttaacaacaacaaaactaccttggaataaacttaaccaagagagtaaaaggtttctacaattaaaacttaagaaatctgaaataaatggagatggtgcttggagttgggattctaattcttctcattctaatccatctcatggatttgaagaattgtatctacagcttttatgtactccccatcaaaatgccaatcctattcttcacagaaatagaaaagacatcttaatatgtatgtggaagcacaaatgactccacaattctagaggtactaccacatgtagttcaagttatactaaaggagcaaagtagcgaaaacagcctgatatctacacaaaagcagacagataaatcaatagaatagagtgaaggaccagaatataaacccatgaagctttaggtacattatctttttttatgaagatgtcaaaaatactcatttttgaaaaggcaaaaccttagagagtggtgctagcaaaggttgctatctatgtgtggaagaataaaactagatcccaatcattccccttgtggaaactcaactccagttgtatcaatataatgtatgagtattacaccacatactctgatattgttaacaaataaagaagaaaaaagtgaaagatccaggcatagctaagaactttgtacagacttcactatctgaggaaaaagtgccaatgacagacaagtggaatttcatgaaattattaaaacagcacaacaaagaaacatttaattatcaggtgaaaagacaatccatagagagtacagtgttttctaactccacatgtctaacaccagcttaatataaaggatattcaaagaacacaaatacctttatatcaagaactcaaaaaacttagtcagttaatgggttaatgagatgaagagttcttaaaagataaattacaaatgaccagtccacatatgagaaaatgttcaacttcactaaccaccagagaaatgtaatttaaaattgcattgacattccatcttgtcacagttagaatgatagtcattaaataaatgcttacataggtgtaaaaccctgctagttagaatatagactagtcaaaccaccttgggaatcattatggagtttccttaaaaaacaaaaaaactaaaaatatatctataatcctacctagactccttggcatattctcaaaagactccaattcgccatatcacagacatacatgaacatcaatgtttaccgcagcactattctcaatagctaacttatcaagaaccaaagttacagggaaacaaaggattggaaagttgttgggtaaaatgctttgtatatattatatttttctatatatatgattatataaataatatactattatatacatttatatatatatatatatatatatatatatatatatatatatggataagggatatggataggagattaaagttataggaagggatgaggttacataataggaatttaaaggagactaatgatggttagaaaaagaaagtgttggtaagtgaagaagaatgttctcaaaatacattatacatgtgttttaaatatccttatggaactaggtactatgcacgatgaataaacatcaactgaaaaaagaatagcacaagatgatcctaaaattcttatgaagtcacagtattgaatatccaaagcaatcttgatcaaaaagaacagtgctagaggaatcattatacctgatatcaaactacatacccatagcaacaaaaccaccatggtttgacaaacaacagcaacaacaacaacaacaacaacaaagcacacaagtataataagatggaagactcctaaataaagcatataaccacagccacctgactttagacagtgataacaaaaagacagaaaaaaaaaataaagacaaaacctctttaacatgtgattctagggaaaattgaggcatacatgtagaaaaatgaaaatatattacccttgccctgcacaaaaatcaattcaaaataaaaaatagagttagagatgtagctcaatggtagaatacttgcctaacattcacaaagacttgggtttaattcctagtaccaccaaaatatttaaactgtaaatatagtctcccagttgcactagtcacatttcaggtgtttaatggccagaagtggtagtgattagctagctaattgaacatcatacttacagagcatttctatcagcacagacagttctattgaactctcccattgccactctagataatagctttatgtgtataatctttgtatataaatgaccataaaatcattcactgtggaataaatgaatggatggatggatggataaattagtttggaagtatagcattacaagactatttgaaaaatataaaaagaattccagtcataatcactataccatttagagatgcaatttaagcagagaccagggtcttgtgcaaaagtttggaaagctgagtatggttttggtatgggtccatgaactgtatcatagcaagagaaagagttggaataattactgaggagaaaatcagatagctcagaaacagagaagcagtaacaataatcaaatccacagcaataccgagcagggaaagtaagtattggggtcagaaggcaaatgattaaaagaaggcctagatggtagaaagcagatcagaaagagcagttgagggagtgggtgggtaggggagtgggggtgggtgggtatgggggacttttggtatagcattggaaatgtaaatgagctaaatacctaataaaaaatggaaaaaaaaaaaagaaagagcagttgaggacagaggcattgaaatatgtgatgacatctgaatcccaggctacagaatttaagggctgagatcaacatctattcatttcctaattatctcacttactctctgaagaaggaaagcttgtacatttatactggatagtttggttagagtatatctgtgagtatgcggaagaacaggatttggctcctactacaggttgttttcaaattctggaaggctggggctttaactggcctaagaactgaatttctgagagtaatgactctgggaagagtcaaataccagaaagagagaggagagagagagagagagagagagagagagagagagagagagagagagagagagagagagagagagagagagagagaggaaaaggtaaaaagggcaaagggcagtcacagagggaatatattacaagggatattttaagaggtcttgatggtgcttgttatacataattagttttttagcaggaatgtttatagaattctgaaactagtagggctaatttagtcagaaaccacagagagcaaactacagagagcggatgctccaggctcctgccattttctggaattttctattgtccactcctagttttcctgaaagcctttttagctcttatctacaaatgtacacactctcagtcagaagtggcaatttataaatctggttgtcagaattttttggtagggaagggtcaggtgtttggccacaggggaaattgaatgtaagcagaatattagaggtccccattttcaaacccatgagtgaagcagactggttgctgttaactctcctttcttgtgatggtcagtctggcaataaaatcctctcttcattacctcttttaaaaatatattttagatatataaaattcatctatacttttggctgtgttcagacccagtgttcatattagtgcacatctttgaaacaacttttaagaactagaggaagtaaaacaaagttacaaaggctgttaactatagtgcaatctcattttgaaccatggatttcgaaacctcagtataaagtagttacagctagagatagtctgcccaacagagtagacaaaccattctatcaaaccttaagaaaataatcctacaagtagagtttggggattactagagcagtcagttgtgtgccaacagtgcattgggccctcatataggactctctcccaatgctactctaacctctccagatacagtgacaagaagcttagattcctactgcatgtgtacactgttaattctttacaaaaatcacagatcttgattcccaaggctgtttcttgttctgactccacttattctttccacctcatggaactgcactcttcagcctccaatgccagggcccaggcatgagtcagtctactgaaatgtggacagctctcttggcatgcatgagcaatcaaatgtccaaagtaaactgatgactaaccatgtgtccaagagatccacagggcttagagaattaaaaggcttattcttatggttaaacactgggaatgccatctcattcctgcccactgatttttctattatcagctggaaagccaccagcagatcccttgttcatctgccaggatgcaacctaacccttctttcaagtcccatttttgttcttagggttacgaatgccagagccattctaaaaggaatctggttggcacagctaattggagatataaggtcataattccaatgttatagcatcggcctgcattttcttgtaatttatattgttatgatatacatcggtgggttgtcatagcattgttaatagctcaagagaaaaatgtctaaactgtacatatttaggagaaagcaataagtattagcactatcactgatagcctgatgttccgaagtgaagaaattaaattccacagagcttgtaaaccctgtattgaagtttactcccatatctgttttgattcaaaatatagacttttgcctcctctaagaagatgcctgtttgttcctagctgcactagcaggagatcatctgattttaattgagtggaaactgaagacatactatgatatttctttcctgatgaagtactgtaccgtacagtcctattttacatgtatgcaatagaatggtggcccgttatgttaatttgtagatcttttaccaaacatatttattgggaatatattatgtgccatcacatggagaggagattgaaagaaataaaataaacaggaaatgccattgcagaatatgtaaccaaagaaatagggctaatgaacccctttccataatgaaaggagaaacattgcagaatatgtaaccaaagaaatagggctaatgaacccctttccataatgaaaggagaaacataagagttcctcaatgaactaagcatagaattattgtgtgacccagcagagcaaataaaactctctcttatccccctcccggtgtgtgtgtgtgtgtgcgcacgcgcgcgcgcgcacacgcgcgcacgcgcgcgcgcgcgggggtatcaacttactaaacatctcctaagtgctatagtttgctggggaactgccacacttcccagaacacactctcagttgcttggaaacaagagctctgagctttgagttgaaccctggctttgatacttcctatatcatccttttttggaaaactctatgttcaaaccagggtataggaaatggagagaaagtaaattgatgttttaaaaagtaggtaggtaggtaggtaggtaggtaggtaggtaggtaggtaggtgggaaggaaggaaagaagggagggaaggagggagggagggagggagggagggaggaaggtaggttacgacctctcagccttctcatttggggtattatatggttccatgcctagagggacacacaatagcctgatgtactgtaagcaataaatacatggcaaagcctcatctaaaatattatatgtagtcgaagagtccagttaagtagagttacagctgtcttagtgatttttctacttatccttgccccaacctatcccagtactcaggaggtaattcgaattttttaaaaaaactatctattctggttcattaatcccttaattttttacattaattaattaattaattaattaatcttgttctttgtatacccctctcacttcccccttccagtcacccctcccacaattcttcccccaccctccatcgcccctccccttctcctctgagcaggtggagtcccttgggtttcccaccaccctggtactttaagtaattgagaagctaggcacttcctctcccactgagaccagtcaaggcagcccagctagaaaaacatattccacatacaggctacagcttttagcccccatttcagttgttcaggacccacgtgaagaccaagcttctcatctgctacatatgtgctacatatgtacaggttcagcccatgtatgttctttggttgatggttaggtctctgagagccccaagggtccaggttagttgactctgttggtcttcctgtggaattcctgtgccctgtggggtgtaatccttcctcctattcttccataagaatctccaagctcaatcaatctactgttttcctgtgggtgtctgcatctgtgtgagttagctagtgggtggggcctctcagaggacagacatactagactcctgtctgcaagcataacagagtatcattaatagtgtcggggattggagtttacccatggggaaggaaatgcatgtactcacttatgtgtggatattccataaaatatacgtcacacagatccaaaaaaagttaaacaagaagaaaggcacaagtgaagatgtttgaatctaacttataaggggcaataaaatagtcataagaggcagatggagggagggaattggtgtgagaggagatggggaagggagtgggggagttcaggatcaggtgtggggagggacagaaaagattgtcggatgaccatgagaatgaatagaaatctgcaactgaccaggatgtgcaggttgggagcatctccaggacatgacagagacctgggataagggaggctcccaagaatcaattgtggtgaccttagctgtgactgaaagcattgagtatgtggaacctgaagaggccacctcctgtagccaggcaagaatcccaggggagcgataggaacaccaacccatccacaaactcttctacccaaaatttatctgtctacaaaaaatgtaaggacaggggatgaaacagagactaggggatggtcaaccaataaccagtccaaccccttaatttttttaaattattggactgtgtgtgtgtgtgtgttcttatatgaatgcacatataaatcacatacacaatagttttccaatgacaaaatcttttaacagctcaaacgcccatgtggctgtttttgaagagaaagacacttactgttcaagaagaggctatgcagattgctggtgaacatcacatgttctaaacagacatataagtaaaatctacctcggggtttagaaactacatattcctagatagtgtagctcacccacactttgtgtctcagtttccttatttgcaaatataaatcatgactttcaatacctctctatgctaactttcttgtgaagctttaataagataaccacatcttcctggtattcacataggaaaagtgtcaccctctctctgatgctgcagagattcccatgacttggaaggaacttgtttcccacataccacgagccaccagtgcctcgggggaattaaagagccaagggacttcatctaaacctgaaagaatatcaaatgatcataaatattctctccaaatgaaatgaaattccaccataacaaaagcagtgcaagactctcaaatggatcttttctgtttcctgcttatgattagtctctgttggaagttatgtttttctaagagagattaactttccgtctgtacagatgtttccctagtgttaacatctgtggtactctgtgcacaaaacttgtcttatgtgatttttggaacaatcccattgtgaggagtttggagctgtaagaactttctcagaactagtctttgtcagaagcagaatctgaactgagatcacttcagtcttttagaccacactagtcttaaagaattccagagatttccttttgctattgctaatgcagaaatcaataaatgcaaagccagttgcctgtagttactcagacagttgataataaaccagggactagttcaaggaatgtcagctcacctttatttcctctgaatggacagtggtccgttaattttaaagatgattagaagatcaggggaaaatctgaaaataagttcctcccatacctcaattccttccatctggccttactttatatctcacctcccccccaccttgagcccttgagtttactcatagaagacacacagacataggcagtccacaggtggtttctattctagcatattaatggatagagtaggttcagagatgcttagctaaatatccatctagatgttactgtcaagagattgactcttcagaagaatgaacatttaaattaaatttgactaaagcagactactctctgttgtgtgggtagaccacattcaatgcttgaagaatttcctgaaaaagaaaatttgcttccaaaatatggttgggggaccagtgagagaatactcagtgagcaaaaatgctttctgtacaagcctgatgacttgatcccaggtttaacaagcagggctcagtggaaagcatctataatctactactcccaagggaagacaggaggcataaacaggagaatagtctcgaagctcatgggccatttagcctagagtttacagcccatctgtagaaacaagagtgacacagcctcaataaggtggaaggagagaactgactcccaaaattgctctctgacctctaacatgtatgccaaaacacacatgcacccgtcatgtaacccacacaagcctaatactttttcttttcttttattggatattttctttatttatatttcaaatgttatcccctttccaggtttcccctccagaaattccctataccacccctccccctgcttctatgagggtatacacccactcatccactcactcctacctcccccctgggcatacccctacactgggacatcaagccttcataggacccaaggcctctccttccattgatgcctaaccctctgatacatatttggctggagcaatgggtctctccatgtgtactctttggttggtgatttactccctgggagctctgggggttctggttaatgcatattgttgttcctcctatggggctgcaaaccccttcaactcctcgggtactttctctagctccttcattggggactctgtgctctgtccaatggatgactgtgagcatctgcctctgaatttgtcaggcactggcagagcttctcaggagacagctatatcaggctcctttcagcaagcactttctggaatccacaatagtgtccaggtttggtgactgtatatgggatggatccccaggtggggcagtctctggatgacctttccttcagtctctgctcaatactttgtctccgtatttcctctcatgagaattttgttcccccttctaagaaggaccaaggcatcaacactttggtcttccttcttctagagagtcatgtggtctctgaattgtatcttgggtattctgagcttctgggctaatatccacttatcagtgagtgcatactatgtatgttcttttgtgattgggttacctcactgaggatgatattttctagttccaaccatttgcctgtgaatttcatgaaatcactgtttttaatagcttagtagtactccattgtgtaaatgtaccacattttctgtatccattcctctgttgagtggcatctgggttctttccagcttctggctattataaataaggctgctataaacatagtggagcatgtgtccttcttaccggttggaatatcttctggatatatgcccaggagaggtgttgctggatcctccggtagtactatgtccaattttctgaggaaccgccagactgatttccagagtggttgtacaagcttgcaatccctccaacaatggaggagtgttcttctttctccacatccttgccagcatctgttgtcacctgaattttttatcttagccattctgacaggtgtgagatggaatctcagagttgttttgatttacatttccctgatgattaagaatgttgaaacattttctttaggtgcttcttggccattcaatattcctcagttgagaattctttgtttagctctgtgccccatttttaataggatcttaaattcaatttagagagctgttggttatcaccaaggtctgagtggcactattgtacccttagggttatcataccaggctggtcattgttgtagttcgtaggcttcatagctggattagactgctggttgtctctctcctttgtaagcttgcatggtgcctcctgataccatgaaagcttatcttcaggaagaagccatttcaggttgctactatgtcaggaaactctggactgtgcgaagtgcatgatgtttacagcagtagggacttaactcacctttgctggtcagcaagggcaatagcaacagactgcatctttgaagagtcaaaagcattcactatcaatagcttcagagaaatgtaaattcaaactgggttaaaattcactctctgcccatcagtttttattccccacccacccacccccccaaaaaaagtttgctagagtgaacatggggaaagaagaatcttttttttaaagagatctgtggtgattttacttttatgcccttcactttaatccagtcattgaatttcacagtgatttctggggtggggcagaaggaagacagcatttagaatgatggaggccatggctgtgaccaggttggcctcactggggaagctagagtagcatggagtgcagactgcgggagagctggtatgcaatgtcctcagcagcttccagccttctcagcttgatcaggccaacacctgctgtgacaagcgagttgacaatcagttcagctttcttggagtcaccctcaggggagatgatggctgccttatgctgctgctcagccttttccatcacaaatctggctctctctgctttctgctcagccacttgtttgacttctactgtctccgtgaactccttcccgaaggtcagatgtgtcaggggcatgtcatccaggatgagtccaaatgttgctgctcactctgtgaggtcatcactcacctgcctagagaccagttctcgttgggtaaccaactctccagtatcgaattgaacttaaggatctctgtggcaatagatggcagcacccgctcatcatagtcttcgccaatgttgatgtagatatgaggaaggtggcaggccaccagccagaagaggatgcgcactgtgatgttgacattctgtaactctgcttccagtgacaaccagcacactctgtggtcgagagcatcagtcaaagataattggcttctgtacccaagggatgaaaaagtcagtcccttctcctaccacaatgtcctgtactccacgtaatcagtcaaggatgacagctctgtgtcaagcattcacattacataaagtagagttcaccagcctcctgcaactgctaatgcgaggccgaactttctgatagactcaaacactttggcagtcatgactccttctgttgcttccactcacacctgctctctctctgacctccatatgaattccccagccccacattggaaagaatctttatacaccattgtagtgttgtaaactcatacagacaccatagaaatctgtggaaacttctcaaaagatccaaaccacaactgtcagttctggacacatttctgtatgactgacacgacttcacactacagagatattttctcatggatgtttatggctgctctatccaaacataatagctaataaatgggaccacataaatgtccactagcaaaatgaatgaatagtaaaacataatacaaatatacagttgagttatattcagttataaggaaaaatggaattataaaatgtggaaggaaatggatgagatacctgcaaagaattgaggtagttcagacacaaagggcatatgttccttctcaaatacggagcatagtagctgttatatatgtctatctaggtgagcaaatgtaggtaaagttcaggaacccagaaaggatgccgtaaggcagtggagtgtcaaagacagtgtaattaagtagaaagtggaatactggggcatgaaaggttacagtgggaaaatggggataggaagataaggcagaagtaagacaatgggcaagaatcaatcaaaatgaactatgtatcaaaatgctatatggaaacttattactttgtaagataattgtggaaaataaaaaaaaaattaggtgccagtgagatgatgtaccttttaaagacaagtctaaggacctgagttgaattccctaataccctgccaccaacatggtagagagggccaactttggcaggatggcctttgtcctccataggcaccttcacacatatactcatacacataaagtgaatacatggaataagttgaaataaaacatcgaaaaaattggaaatttggggttgcctataatactctgcatttcaaaaacaaaaacaaaaagatgtaatcagactccactctccatgagatgatcacatgaattagttctgtatactttcatcattatcaatgaacaaaatatttgtgatacctacttttccccttgcagtaatgttagcaactgttgacatatattgccttattccattacatcattcatgttgcttctataattctgtctcctcttaggcatagttgaaaacttcattttatagaaatttctctccattaatttttatgatttaccttgagttatagttcagtgagcaaaatcaggagaaatgcttgattccactactttttaaaagaccatttaaaagtattttataccattgaccaaaaatgactgggatgtgagtcaccctgtgtactggtgcgcatgtgtatgtgtgtgcatgtgtgtgtgtgtgtgtgtgtgtgtgtgtgtgtgtgtgcatgtgtgcgtgtgtgtgtatgtgtgtgtgtatgtatgtgtgtatgtatgtatgtgtgtgtgtgtacgtgtgtgtgtgtacgtgtgtgtgtagtatgtatgtgtgtgtgcatgtgtgtgcatgtgtgtgtgcatgtgtgtctgtgtgtgtgcatatgtgtgtgcacgtgtgtgtgtgcatgtgtgtgtgcgtgtgtgcgtgtgtgtgtatgtatgtgtgtatgtgtgtgtgtatgtatgtgtatgtgcgtgtgtgtgtgtgtgtgtgcgtgtgtgtgcatgtgtgtgtgcatgtgtgtgtgtgtgcatgtgtgtgtgtgtagggagagcatcatcataaacttacggagcccttaatattggaatcatttcatttcccacagatatcattattaatgctcacattatcactgttggaccagcttagcttttgcttccctttgaatgacccacatactttgttgtgtgtgtacagtgctactgagttacagtatacacttcctaaaatacatttcccaagtttagacccatgcatacaaccatgaacgaaccatcatagtcagggaaacggacttagctttcacactcccaacatttcttgttgatccttccctcaaacctctacacgtccctcaatcctgggataattaaaaatatatatatattttctcttttcagggttttagaatcaaatgtgtgggaactcaaaatgcacatgctttctttcccaacttcttttcctcagtaaaattattttgacccttatgttgcctgtactctacttatggttgctatcctcctgagttttacattccaatgcttccttattagtttcttcttcttgttgtgaccaaatgcttgaaaggaagcaacttaagggagcagctagggttacttttggttcacagtttaagggtacagtttaccatgacagggaagtcatggtatggtagagagacatgtgctagctggtgacactgtggctacagtcagaaaaaaaaaagctgtaagcaatgtttcttagcttgctttctcctttccattcacttcaagacccagatgtattagtttgcttctctgttgctatgataaataccattaccaaaagcaactttgggagaaaggagtttattttagcctcctatcactgagagaattcagggcaggaactcaggcaggacaggatcctggaggcaggaactgttgcagaggccataaagggtgctgcttactggcttgctccatataccatgctcagcttgctttcttatgcaatccaggaccacctcctcatgctcagcaatgaagaaaatgccccatagacaggcccataggccagctgatagaattccgcaaatgaggtctcctcttcccatctgaatttatttgtgtaaagtggaaaaaaagctaaccatcacagcctatgggatggtggcatccattggggtatgtttttccctcagttaagcctttctagaaatacccttttagatgtgcccaggtgtctgtttccatgatgattctaagctcagtcaaattgataacaaagattaatgatcagatcttacacaactaacttttaaaaaaatgaatgttgtccaatttctcagattgtctcatatatcattttaagtattatataaaacattgttcctaatataagaaaacaaagatggttttcctaattttcctactaaaaattttaaaactaagtggttatatttttatgctcacaatctaatttgaattgacttcatgcatagcataaggtgcaggtcaaaagtcattacttgtttactttgtatgtgatgtccactattctaacagcatttgtcgactccttttgtttctgaattacctttgtatctcaataaaaaccaattgcgaatgtatatgtagacatgcttctagactatgttctgttccactgatatatatgccagtcttcatactggtactattattatggtttgaatctgaagtggtccatgaatggttgagctatgatttatttcagtacatggtttttaatagggtgaagataattccttctacttcttgctttgctttgttgtttgtttgtttgtttgtttaaccaaaaccagacaataaatatctttcttcaaatttactttttgcacctacatagattctaaccagtcacatgtagttctttctgtctgtcttttttttctctaattgtaagtatgattaattacattgattgtttttttaattgttaaaccaccctataatgcatgaaataaatagcatttttccataaggtccatcactcacttttacacattattaaatttaaaacctaagttggtgtgaactttttacctatataggttaaaaaataatgtaggcacaaccacacatatgtcacatgcccatctaagaatcacaggatgcaaatgctcagaagaaacataaatggaaactgagtaagataaatcaaaaccgtaggtaatctccacacagtgaggcatgtgaaaaatgatcttttaagattagagagagacactctccccaccaacatgaaaccatttgccactgcatttaggataaaactggaattagttctaaaaaaaactactactctgcactagtgatacttgaatcagtaaaataggacaatccttaagtcaggtttgtggcagaatttgtgtagggctgataatttttccctagaaacttgagagaaataaacaccaaggccatattgcccagaagtttccactatggggatatttttaactctcaatttccttaataggtaaagaactttctacattatctacttttcttttcttgaatgagatttagtattttgtgttttgtgaaaataataaaagatgtaactagggctttaccacagacatactttctaaaatcagatttttgtgtcactctgcctagaaatagagagaaaagtagatgagttttaaagtcatgacacagaatgacaacagaaatactggaccacttctttgtgtggggttggctaattccaaaatatttgacatgaagatcaaacttcacttttgttaagatttgtgtgtgagaggtgagagagagagagagagagagagagagagagagagagagagagagagagagagagagagagagacttttaaagtcagctcctactaataaagccgactacttgtctagtttctattttctgcagatgagatgggattagaatgtttttcctaattttagcaatccaggaaaacgtgacaagttggttggctttgctcatgatgcaagcaaaatgaaaccacttctgaaagaatttttgtcttaaaattatagccataaaatgaagtagattaacttcatgttcttggcaaataaagactgaggtcttgttcagctgtggactgggttttgtactttgtgattttccctccttttattgaaaatagattcttttatcatacaatatatcctgattatagtttcccctccctctgctcctccaagtttctcccccatccctacccatctgaattcactcccttcctgtctctcattagggaaaaaaaaaggcttctaacagataacaaacaaatgtgatgaaataaaatataaaaaacgatgaaataaaagccatcacattaaaattggacatggcagccccacaagagaaaatagtcccaaggaaaggagttagagacccactcatttttacagtcaggagctccataaaatactaaactaatagctatagtgtatacacagagatctttgtgagttcatacgggccatttttagttgattctgaaggatttttttctcctggtatccccttctaacagtctttctgcctcttcttctaggggttttccttagctccaagggcggggttttatggtgaccttccatttagaatatatctctttgtctctgtgtctctgtcttcctccatccctccaccccccccttctctctccccacaccctgtctggctgtggctatctgtatttgttcccaccagctgccaaaggaagcctctctgatgatgactggctaatcttgactatctagtctctgattcatggttacataagcagtataaactgtgggttccttctggtgaagtgggctttaattcaaatcagaaattggttgactactcccaaaggttctgtgccaccattgccctagtgtatttttcagggagggcagattgtaggacaagggttttatggctggttgttgtttacatttctcttttggtaacctgcagagtaccttccagtagtaaagaaactaggacttagggccgtataagcaccagctcaactttcccatgttcagtgaggccctgctcattttacagagagcaactttttgtcttagcaacaacctgagtagtttggggattttcatggtacccccttggtcaagaactcaatggaatgtagcctagtcactcctagaatcaagagatgactagttgagactatatcatccattcctaggagttctcactaaggtcaccctcatacatttcaggatgtttccaatgcactagctttctacaccacctcccaaatgccccctgatccaatcatctcttcccacactgtctccctccagcacatctcccaccaacacctgatttccccatgccgctccccaaatacctctagttcacctgtaaaatatattctatcccttccagggatatccatgtgtccctcttaaacccctcttctttacctaacctctctggatctatggattgctacttggttatcgtttacttattggctaatatccacttataagtaaatacaaatcatgtttgtctttctgaatctgagttacctcctgaaaatttcatggtgtcatttttttaacaactgactaataactttgttggataaatgtaccacgttttctttattcattcttctgttgaggaccatctaggttgtttgcagtttctttcttataaataaagcttcagcgaacataattgagcaagcatccttgtgctaggatgcagtgttgtttggtagtggcatagcagggttttaaggtaaatcaatttccaattttcaaaggaaccgtcatattgattttcaaagtgattgtacaaatttgcattcccaccagcaaaggaagagtgttccctttgctccacatcctcaccaggatctgctgtcacctgaggttttgatcttagccattttaatgggtataagttggaagctcagaattattttaatttgcatcttcctgatgacgaagaatgttgaatatgtatttgtttctcatctatttgagtttcctctattgagaattctctgattagatctgttcacatttttaattgaattttttgtttgtttggtgttttgtttatttgtgtgcttgattgtttttttaatattttttattattacgtattttcctcaattacatttagaatgctatcccaaaagtcccccataccctccccccccctcacttccctacccacccattcccatttttggccctggcattcccctgtactggggcatatacagtttgcatgtccaatgggcctctctctccagtgatggccgactaggccatcttttgatacatatgcagctagagtcaagagctccggggtactggttagttcataatgttgttgcacctacagggttgcagatctctttagctccttggatactttctctagctccttcattgggggcctgtgctccatccaatagctgactgtgagcatctacttatgtatttgctaggccccggcctagtctcacaagagacagctatatcagggtcctttcagcaaaatcttgctagtgtatgcaatggtgtcatcatttggaggctaattatgagatggatctctggatatggcagtctctagatggtccatccttttgtctcagctccaaactttgtctctgtaactccttccatgggtgattgtttccaattctaagaagggtcaaagtgtccacactttggtcttcgttcttcttcagtttcatgtgttttgcaaattgtatcttatatctcgggtatactaagtttctgggctaatatccacttatgagtgagtacatatcatttgagttcttttgtgattgtgttacctcactcaggatgatgccctccaggtccatccatttgcctaggaattttctacattctttataaattttggatattagtcctctagtggatgtgaatttagtgaaaaagcctttttcattctgtagactgtcactttttctgattgacagtgtcccttgccttacataatcttttcagttttctgaggtcctattaattaattgttgatcatattggtgcctgaactattagtgctctgttcagaaagttatctccttcacaagtgcattcaagactattccccaacttctcttctattagattcactgtatctggttttatattgaggtctttgatccacttggacttgaggtttatgcatggtgatatatatggatctgtttgcattcttgtaaatctagtttgaccagcaccatttgttggatacgctgtccttctccagtgcgtattttttgcttctttatttaaaaaagcaggtaacccatatgtgtctgtattaatgtctagggcttaaattcagttgcactgatctacttgtctgtttttatgtaaatattgtgtgtggttttgtttttggttttggttttgttttaatattgctctgtagtaaaacttgaaatcagggatggtgacaactacaacatttttttaatttttttcaggattattttggctatcctatttgtatgacttgtaaaaatgtatttatttactgatttatttgtttgcttgtttgtttattgcatgtaaacctgaagactagaagagggcatcagatctctttaatagatggtcaccacgtggttgctgtgaattgaactcaggaccactggaagagcagctagtgctcttaaccactgagccatctttccaggccttctgtgatttttttttttgcatttttattaggtattttcttcatttacatttccaatgctatcccaaaagtccccataccctccaccccactcccctatccacccactcccacttcttggccctggctttcccctgtactgaggcatataaagtttgcaagaccaatgggcctctctttccgctgatggctgactaggccatcttctgatacatatgcagctagagacacaggctccggggggtactggttagttcatattgttgttccacctatagggttgcagacccctttagttccttggttactttctctacctcctccatatggagccctgtgatccatcaaatagctgactgtgagcatccacttctttgtttgctaggccccagcatagcctcacaagagacagctatatcacgattctttcagcaaaatcttgctagtgtatgcaatggtgtcagcgtttggaggctgattatgggatggatccccagatatggcagtctctaggtgctccatcctttcatctcagctccaaactttgtttctggaactccttccatgggtgttttgttccaaattctaagaaggttcaaaatgtccacactttggtcttcggtcttcttgagtttcatgtgttttgcaaattgtatcttatatcttaggtattctaagtttctggactaatatgcacttatcagtgagtacatatcatgtgagttcttttgtgattgggtgacctcactcagggtgatgccctccaggtccatccatttgcctaggaatttcataaattaattctttttaatagctgagtagtactccattgtgtaaatgtaccacattttctgtatccattcctctgttgggggacagctgggttctttccagcttctggctattatacataaggctgctatgaaaatagtggagcatgtgtcctcattacaagttgagtgaggtaacccaatcacaaaagatcacacatgatatgcactcactgataagtggatattagcccagaagctcagaatccttcttagaagggggaacaaaatacccatggacagagttacagagataaagtttagagcagagacttgggcatccatcccataaacaaccaccaaacccagacactatggcagatgccaacaaaagcttgctgacaggagcctgatacagctgtctcctgagaggctctgccagtacctgattaatacagaagtggatgctcacagttatccattggacagagcacagagtcaccaatgaaggagctagagaaagtatacaaggagctgagggggtttgcagccccctaggaagaacattaatatgaactaaccagtacccccagagctccttgggaccaaaccaccaatcaaagaaaacaaatggtgggactggtggctctagctgcatatgtagcagaggatggcctagtcagtcatcaatgggaggagagggccctaggtcctgtgaagattctatgccccattataggggattaccagggccaggaatgggagtgggcaggttgggaatcaggaggaggagagaggagatggggggggggttgcggggggaaactaggaaaggggataacatttgaaatgtaaataaagaaaatacctaataaaaaataaacctagattatatgtatgagggaaaaaaaaaacatgtcttcttttatttcctagtctggcttcttttgtctcatatgatgatctcaagtttcattttcttgtaactgatacaatctcattcttatatgtctgagtaattctctgttctgtatatatgctaacagctttagactgcttgcataacttgttattgtgaataatgccatattatccttacatgtacagctgtctctattgtaacgtatgtagcttcctttcctcaagaccattatatggtcgtcccactgtacatttttggaagtctcatactgatttctgtaatgaatgcagtaatttatatcgctaccaatcatttataagggccaggggtggatttcctatgagccattctgtttttctctgtcagagtcccttttcaatgtcatctttccccatttctgagcacactgaagctcttttagctttctctacacctacaggacttacaaattatctcatagtgagctcaggatcttcacggaaataacctagtttgtttcccagtcagtctcctgctactgcaccctgtctttctcaactagacattcattagattccttccttctgatacaaaagacagaaaaggcagtgtccttggccatttagacttaataacagaggaagcagtctgtactgaaattccagtattccctgttcctgtaggatattttttaacttgtggagagatagtgaagttttctgtgctaacataagttcccacctagaaacactaaaggattttcttttcaactagccacaagttttcctaagggcaccatataataaatgaacattaatcctctggtccaagccactaaagcaaatgaagtttaccatgtaaataaagtctatcagtagcaagataagctcgcagagtgtagaagagcatgcacagccactccacacattgcacatctgaggaaacaactcagtccaactacctaaaataaatttgtatgttttagttggaaaatactcagcacagtttctcggaaatagtcaaaaggtaggctattagttaaggtggtggatgttttaattaattattgagagtcgttgggaaagaagtaacatttaagagtgtgtgaagcgttatgtatgagttatatcttagtaaagtttttctaataaactattgccaaaaactgaaaaggggagaccctgactaagaattcccaagcagtggataggatataaaaagttttctaggaaaattaattgttgatcaattgacattttgttacttttctgttgcattgataaaatgacataacctaggtaatataaagaagggaaggtttcttttaggtcacagttcagagggcaaatccctaatgatgtatgaggcacgcaggcaggtagagcaggaagctaagagataatgtctttaatcacaaacgcaaagcaataataaagtagaagtgaggcaagaatatactctctccaatcccattcccagtgatgtactttctccaccaaggataccagtcctacaccttcccaaacagcatcaccaacttggaattaagtattgaaaatccataagcctatggggacattcctcaatcgaacctccacagacctctatgaccagaacagagtagatcagagatgaacctgcaatagtaagtcaaacctgatttagatgtcttcaaactttggaggaaatgagtattcatcaaatgtttttgagagaagaaacatgactgcaccgatgccttctcacattattttcatgatagttagctcccttatcaggattatagttcctcgggggaatatatttattctttaatgatttatttttattttgtgcacattgatgttttgcttgcgtgcatgtctgtatgaagatgtcaaattccctggaacagacagttgtgagatgccatgtgattgaactcaggtcctatggaagagcagccagtattcttttggggggtattttttcttttattattattaatcattctattcgtttacatctcaaattatataccacttcctggttacccctccaccaccatcccatctcacatctgccctccctctcccttttgcctgtatgagagtgttccccacccaaccgcattttcccaccccaccactccagcattccccccccccctactctgaggcatcaaacttccccgggaccaagtctccagccctaaagatgtatttttaaaataattgtacttttcctgtagagttcaatatagtgaccttgtattcagaaaatgtgccctaaagcttcaacgcagtaaaatgatcttggtgtgagaggttctaccttgctcagcttctactggcatccttcctatttaaagatttcctagatccaatttttctttgtctttagccagcctccatataaaccttactcaggctgccattctttagcatgtggattgctgtagcagtcttctgattagccttccctcctcctcctatctactatccatactactgccagaaacatgttggttatatatatatgcatatacatatatacacacacacatatatatgcatatacatatatacatgtacacacacacacacacacacacatatatatatatatatatatattcaatcttaccatgttactctgtaatcaaaactagtgagttcctcccgctcatgtatcaagcataacactgtctgtgccttcctataccatgtagccccttgccatccttcccttgcctttctttttctattagatattttctttatttacatttcaaatgttacccccttcctactttcccctctgaaacccccactatccctttccccctccccctgatccccaacccacctactcttgcttcctggccctggcattcccctatactggggcatagaaccttcataagacctaaaagggcgtgcacacacacatgtcagggtacatgcatatggaagtcaaacggtatctaaatcaattgtgttttgcctcatttttgaaacaactcagaaggtctgcttgtctctccaccttccttaggattacaggcatgtgctaccctccatggctttacatactgatgctagtgattcctatttatgtcctcatgcttatagcaacacgttactgactgaattatctccctacctcaccaacaaatatttttctaatgagggaataatgctaatgtcctcatgttttaaatttttaaacatacataacacttttaattttcttcccattactcttggaacagttcttatactttaagtgtttatataagtttattccaccaaagaatataaattccatgatggcagggaacatatttattgtttgtattatatattctacaaataataacacatacatattataaatgtacagcaaatacatttatacaaatttacttggaggtgtgtattataaaatattacttcaaataaaacatagaacacattcttgcattctaggaagtatctttatgctaccaattgactccatccttcatctccagaaggagtggaccctattgcaataatagtcataacttcaccctttccttcctagtagtcataatacattagaccagtggttctcgaccttgctaatgctgacatcctttaatgcagttcctcataaaagtatttccattgctactccataactgcaattttgctactattatgaatcataatgtaagtatctgatatgccgatagtcttaggaaacccctgtgaaagggtcccaacccacaggttgagaacagctacataagaacataaataaaaagtgactccattgcagaaagaaaagtgagccctccctaaattttaccaaatgaatgttgcagagtttatcctttatgtttcttactgaatgttacttttgacacataccacaagtgaactttgcacacaaatgccatgatactacctgtaaggtttccagataaaatatgggaagttagttacctttgaattataaataaataatgagaagacttttagtgtaagtacatctttgatattacattgaacatacttacaatttgaagactaaaatattcttggcattctatatttttttatttgctaaatctatctactgtgtctgcaaagtgtgaaatttctgcctctttcagtatcttccaaccctaacaacttcagttgtgcccagcaatcgggcttagcaaaatattgtatttcatggactctcagtgaaaagcagcatctatttaaagaaaattctggtcaacatttacattgtgtattaagcatttgctaagccattttaagttctacccaagcaatgctacatctctccaggtccttcttcattccggaatgctcatttctctacaactccctgaccctgtctgttatgtttatgatgtgatgtgaatacacttaagcagatgttagaaagaagtgcctttcagaactgctcagcagtgtctggtgtcagctctttctttaagatcaaatgtggctgacaagtccttctggtggggagccagctcccgcagctcccttccttctctcctcagcctttcattcataaaatcatggggagcttttcttcaaagggaaacacacattcaacctgggacagaactcagtgtgctttaacatgtatgtttgtttctgtttcattgagcagaatttgctttagaagtgttcaaagtcatattagattccttgtagtttcagtacaatgctgagaagctgtaggaggctgtcaaaggcgatctgatttagaggaaaagctctgagacttggaaccaagcttgggattgaaaccttgtgaccttgaagagatgtcagtttagacgcccccctccccccacctcaagtttctcttctgtgaaatatgatagtaacagtgcctgccccacagttctataagataaaaaaaataccaaaaaaacccccatgagctatttagcttagttcattgcacatgtttatgctagaaatgcctgtgaatgtggatccaagaatatgtctaatgcactcgaagaagcatctcttgattcctgggcccttgactgactgatcatcagagaatggacattataagggtatcttcctgtcttataatccactatccactgaaaagagaagacctagcctcacaactctgtcacctaaatggcaaataacaccatctctgaaattcataagtattagtgttgtttttaatctagcaaatggtcaaatagaaatgttttcatttcaaaagtactcacacaactcaaatatgaaggttttctagaatatgcaacaattgtgtaatagtatgaagtaactaatgtaatgcttttgacgacttgttttcctggctgtcattttcaaactaatcttggagttagtatcaataaataaaagaggaaaaggagagattattgatagaaactttttgatagtatatataagtgaccctaaaattccaccagagaactcctaagcctgataaacagcttcagtgaagtagctggatataaaattaaatcaaacaagtcaatggcctttctctacacaaaggataagcaggctgagagagaaattagtgatctttctatcttctgatattatctccatttttttcttcaaagacttgtagatttctgtcatacaggtttgtcacttgcttggttagagttacaccaagatatttcatatttattgtggctattatgatggaggttgtttccccgatatcattctcaggatgtttatcatttgtatatagaaggactactgagtttttgagttaatgttgtacccagctactttgtacaaggtgtttataagctgtagtttgggatcgcttatgtatactaccatatcatctgcaaataatgatacattgattccttccttttgaatttgtatcctctttatctcctttagttgttttattgctataactagaactgttagaactatattgaggttggcgtggtggcgcacacctttaatcccaaggactcaggaggcagaggcaggcagatttctgagtttgagaccaacctggtccacaaagtgagttccaggacagccagggctatacagagaaaccctgtcttgaaaaaccagaaaaaaaaacccagaactatattgagtagacatggagagagtgggcagtcttgtcttctccttgattttagtggaattgttttaagtttctctccatttaacttgatgttggcttcctgtatgttgcatttattgtgtttaggtatggacattgttttcctgatctcctcaagattttagcatgaaggggtatttcatttttgtcaaagatattttcatattaatttttctttcagtttgtttatatggtgtgtgtgttttagtggaaattcctatattgaaccatccctgcatccctgggatgaagcctacttgatcatgtaaattatgtctttgaatcattttattcagtttttttgttaaagaattttttaatattatcaccagctcaggctgagcttaggtttcctatatagcccagtatggccttgaatttctgccacccacattttttaacatcatcttttttattaaactaataaaatttattttaaaatatacaacacaatattgacttttaagtcatcaaaataatttataatagttaaatgtctcttaaatatacacgataccttctgaagctaaaagttatgcactcaaccactttttaaaatctgtttggaacattaaacatgatagaaataggaaaaaattcttataaagagattttcctctgagaaaggaaattgtgacaggttcgtgattagacaaaaaccattccatctccaagggagaatacagtttgtctgtggcttcatagaatgaattgggtaatgttccctctgtttctattttgtggaatagtttgaagagtattggtattagttcttctttgaaggtctgatagaattctgcactaaacacatctggtcctggttattttggtttggagacctatttgttcttttttttttaattagatattttctttatttacatttcaaatgttatcccctttcctagtttcccctccaaaaaacctctacctctaaccccccctccttcccctgctccctaacccacccactcccattcccagtcctgtccttaccctatactggggcatagaaccttcacaggacctagggcctctcctcccattgatgactgactatgacatcctcagcaacatatacagctagagccacatgtcccatgtggttaagttccaaggagctctaggggtactggttagttcatattgacgttcctcctatggggcttcagaccccttcagctccttgggtactttctctacctcttccattggggagcttgtgctgcatctaatggatgattgtgagcaaccatttttgaatttgctaggcactggcaaaggccctcaggagacagctatatcaggctcctgtcagcaggtgtttgttggcatctgtctgggtttggtggttgtttatgagatggatctccaagtgaggcagtctctggatggtcattccttctatctctgctctaaactttgtctctgtaactccttccatgggtatttagttctcctttctaagaaggattctgagcttctgggataatatccacatatcagtgagtgcatatcatgtctgttctctcatgattgggttacctcactcaagatgatatcctccagatccatccatttgtctaagaatttcataaactcattctttttaatagctgagtagtactccattgtgtagatgtaccacattttctgtatccattcctctgttgatgggcatctgggttctttccatcttctggctattataaataaggctgctatgaacatagtggagcatgtgttcttattaccagttggaacatcttctggatataggcccaggagtggtattgctggatcttccgctagaactatgtccaattttctgaggaaccaccagaccgatttccagagtggttgtacaagcttgcaatcccaccagcaatggaggagtatttctctttctgcacatcctcaccagcatctgctgtcacctgaatttttgatcttagccattctgactggtgtgaggtggaatctcagggttgttttgatttgcatttctctgatgattaaggattttgaacattttttttcaggtgcttctcagccattcagtattcctcagttgagaattctttgtgagacttttaatgacttcttctatttctttaggggtttatgggactgtttagaagtttctcagatcctaatttaactaaggtatttggtatctgtctagaaaattgtctatttcattcagattttccagttttgttgaatatacacttttgtaataggatctgatgatttttttcaatttcctcagtttctgttgttatatcttccttttcatttctgatttattaatttgatactgactctatgccctctggttagtttggctaagggttcatctatcttgttgattttctcaaagaaccatctggcctttttttctcctggttgggagagtttagtactgcttctatttacttaggggtgtttaaattgtttatctgatcttgatttaactttggtggtatttatcaaggcatttgtccttttaggttttccaactttgtgaagtagaagtttttgaagtatgacctgctgattcttttgatttcttcagttcctattggtaggacccccccccttttcatttcttattttatgaaattgtgtattctctcattgtgttttagtttggataaaggtttgtctattatgttgattttctcaaatagacagctctttgtttccttgatttttttatattgttctctttttttctatttttttattttaatcccgagttttgattattttatgccatctattcctcttaagtgtgtatcacagagaaaggagcttcagttggggaaatgcctccatgagatccaactgtaaggcattttctcaattagtgatcaagggggaaaggccctttgtgggtgggaccatctctgggctggtagtcttgggttctataagagagcaggcagagcaagcctgaggaagcaagccagtaaagaacatcgctccatggcctctgcatcagctcctgcttcctgacctgcttgagttccagtcctgacttccttggtgatgaacagcagtatggaagtgtaagctgaataaaccctttcctccccaacttgcttcttggtcatgatgtttgtgcaggaatagaaaccctgactaagacagtgtgtatgcttttttcatgtgcagtttgtttgtttgtttgtttgtttgagacagggtttctctgtatagccctggctgtcctggaactcactctgtagaccaggctggcctcgaactcagaaatccacctgcctctgcctcccaagtgctgggattaaaggcgtgtgccaccacgcccaccttcatgtgcagttttaaattcttagtatgagatcgctctaatttttttatgaagacacttagtgctatgaactttcctcttagcactgcttcattctgtcccataagtttgggtatgtcatgccttcattttcaatgaattcttcatttatttctgcctttgacccagttgtcattcagtagagagttgctcagtttcaacaagtttgaagctttttctgttgctgttgaaatcctgcttaatctatgctggtctggcaaggtacaagaggttatttcaatttccttgtatttattgaggcttgctttgtgaccaaaaatgtgtcaattttggagaacattctgtcaggtactaagaagatggtgtattcttttgtagctgggtagaatgttctttagctatttgttaggtccatttgagtcatggtgtgtttcagttccattgtttctctgtttagtttctttctggatgaactgtccattagtgagagtgtggtattaaagtctatcactgtcaatttgcgatgtttgatttgtgatttaaactttagtactttttttcttaacaaatgtgaatgtccttgcatttggagtatagatattcagacttgggaagtcatcttgatggatttttgctttgatgaatataaagtgtccttccccatttcttttgattaattttggttaaacatctattttactagataatagaatgggtactctaccttgtttcttgtgcctgtttgcttagaaaatgtttttccagccccttactctgaggtaacatctatctttatgattgaggtatgtttcttctatgcatcagaataatggattctgtttttagacccatactgctagcctgtgtcttttactagggagttgaatccaaaattattttctgtgttttcttgggtgtagttaacctccttgggttggagttttccttctaataccttttgtagggctggattagtgaatagatactgtttaaatttgactttgttatggaatatattattttcttcatctagtgtgatagaaagttttgcagggtatagtaatctgggctggcatatgtcgttagagtctggaagatatttatccaggcccttctggcttttagcatctccattgagaagttgtgtgtaattctaataggtctacctttatatgctatttagtcttttccccttgcaagttttaatttttttatttgttctgtaagtttagtgttttgattattatgtggtggagtggaattttacttctgtcccactctatttagtgttctgcaaacttcttgtacctttataggtacctccttctttaggttaagaaatttttcttctatgactttgttgaaaacattttctgggctaatttgagctaagaatcttctccttctattcctattattcttttattcctacttttcttatgtatggtcttttcatagtgttacagatttcctcactgttttctgtcaggaacatttagttaacattttatttgactgctatgaaaatttcttccattatatcttctataagtaagattctcttccatctcttgtattctgttgataatgctcatatctgtagttactgttctcttgtttaggttctccatctctagtattccaactcagtttgtgtgtacttgattgcttctaattttttattaggtattttcttcatttatatttcaaatgctatcctgaaagtcccctatttctatcttcatgtcttcaacagttttagtcatttccttcacatgcttgtttgtgttttcatgtatttctttaaggtatttacgtattttttaaggtcctctatcatcgtcataatattggatgtaatattgttttcttgtgcttcaattgtgttgaaatatccatagcttactgtagtaggatagctgggctctggtggtgccatattgctctggatgttgttgtgttattactctgacttctagtcatctgtgtttggggttatacatttcagtgccaactttggagttaatatttgtttgatgaatatgttttggattttttctattgctttccattttcctctctggtcttttggcctgagtagcctctagttctagtaaccaccaagttttcaggtctagtagagtatctctaccaggattttggttgcctgcgtgacctctgggattttgtatacttatgttgcctttagggtcctggattctgggaactggcctggacacttaatttgtgtattttaactaaagtaatagtgcctcaaagattagctagaacatagatttttttcctttttaacacgtgtgagaatatacaagaagaaaacagcttggatattctttacaaacttaccatctagttaaggaaaaagatgttgggcctcaaccaaagatccatagtaaagttggtcccataacattatgtgatgcttattcagtgactggaactttgagtgctatagcttttccctgacactgccatggctagggaagatatgaaacttgaatatggccttgacatatggagtaatgggatggaaatggcattaagatcctaagtgttaaggtatacaccttaccattacttcccaggccaaaacaatttcactagatactcttatacaacaattctgctcttaaaagatattttggaaattgtcaaccatatttggttgtcttaacactgacaaaagtggcacttaatagtttggggtcttgaaggctagatgtatactctgattatactgtaccctgtactacattcatgcaagtgaaaactggttataattatctgagtccagaacatagatacagtttccatattgaaatgattttttcatggcattctatcttttccagagtggtctcatgagttatttattgcttcagagactcagtgaacctatctaaactacaatcctcagagttgacatatcatagccccagcatcaccagttcagcaggatgccatgtttgtgatgattctatatacagctgctagcctctgcctaatgaattatccttagcattcgagctaattaaatattcaaatatctactgttttattttaagtgacattttcatgatgattaagtcataatatatggttttcacattatcaataatgtattttttgcattatgcattaagcccagagccttgcatatgctagacaaaccctctaccattaagctattctctagccatattttcactttttaattttgagataagattttactaagttgctcagactatccttgaccttataatcttccattatagtcctgcaccactggaccaggctgcttacatccttattttatcctattccaatcactttcttttaaatgatatgttagtctggtacattttagactatgtcccaagttcccagtggttttcattttctgtaggtatatactgagggttatattttcaggggaaggtgagagtactgaaaggtagaaaagactactgagaaaaaccaagatttgagtggccccgaacaaatcaggatagtacataagcttccttagggcctttactctctgtgggacaaaaatggggtcccatgtcgctctggtctagggcagctgggcaagccagatgtggggagtttgactgtgtggagcccaggctgccactgggaagtgtctgactgtgagaagccgcagaatcccactctgggggtgagggaggcacagactggggtccctgtggaactgctcgagtcggactctgactctcaggcaccacagaccatgctgggcactgtggaagagctggctctgggatccctgagccgcatggaggccagagacagcaggttctcactcgcagacatcccagatacggggcaggggggtgctgaagggaaaagggtaggaggagagctctggcaggtaatctctgtgatgacagtctggctagctcagaggacatcttgggttggtggagaccttggctggagcacagggagccttccctgtgggaggttagactctttagaaaagagaaacctgctccattgctccaacatggcaggttctgatgagaggagactgtccatgtttttaaggcatttattgtaggaaggcagagagagggagaacgtatagaagcagaggatgggccaggtggagagaggggagaagggaaggcagggggaagcaagcaagcaagagtaagagcaaaagaataagaggtaagagagtaagagaacaaggagggggcgagcagctccttttatagtgggctggggctacctgactgttgccaggtaactgtggggaggagcatacctgactattgccaggtaactgtggggatggaatccagacagaatgccaggagtttggggcattgcctatgtgattgatggccaaacacctctctgcaggggactgtgggagggtgcagctgcgacaggagccaggggcccaggaggcatggccaaactccttctgttccttagggtcaccagggttccaggcctatgcttaactgggaccaggctgtctgtacacagctcactgccccataactctccacacctcactgtaatcgaagactcttgttactactgccagggttgacattacagaaaattgcctcatggctagtgagacttctctgattactttcctcaatgacagagaacagtgatatctctctgtctgacagcttgttctggagaattccttgaacaccttaatttctgttcttatatttttgtttggcctctgtcactggcaggttattctactaccttttaaagctttctgacttatatagaagagacatggaagttcttagattattacagatctttcttttttcatttttattagatattttcttcatttacatttcaaatgctatccccaaagtcccctataccctccccccctgctcccctacccactcactcccacttcttggccctggcattcccctgtattggggtatataaagtttgcaatacaaaggggcctctcttcccgatgatggccaactaggccatcttctgctacatatgcagctagagacatgagctctgggggtactggttagttcatattgttgttccacctatagggttgcagaccccttcagttccttgggtattttgtctagctcattcattgggggtcctgtgttccatccaatagaagatcttccttttcacttttgcttactgccacccctagtttgatataatggtttttacaggaaaccaaacaaatgccttatgggaacagaatatagtttcaaaatacacttgttgagtgctctcagttgaaaggtataactttccccttacttaatagcatacattttctttcacttcctactaattacaaacatcccatgaagagtgattcagaatgcaggaatgtaagggcaagcaaatacaaatcagcaaaatgtcaagaatatgaaacattatgacaaagttgaaatatgaaatcagtctatcaaacctattactttcttttcagggttacaaaaaaattaataaaaacttgtaatataactgagtttttctcttggttttatttttattctcttcctggcctccactagttcaaggtgcctcttctcagagcatctcttgatcttacttttatgaaaaatgtgaaatggaaaaaaaaaaagaaaaatgtgcctgtgtgtgtacagtaaaatggagggcaaactggaaagtgtagagtgccacttcgcatgtcaaaggcatagaagagagataaactatctcatatcgggaaggtgtttagaatctaaaatagcaatattttgccatagctctgccatcactaccttattatggaagtgttgtggtgataaagtattgtgggaatgtcttaagagataagagaccatctggaaaaagtcacaatcgtctctgagaattggaaaaggcacacattacacagagagggaaggatgattaagtgtgagaccagctttttttttcccattgggggaaatgtctgttattaatttttttttaagttgaatgatgttgttgcacctacagggttgcagatcccttcagctccttgggtgctttctctagctcctccattgggagccctgtgatccatccattagctgactgtgagcatccacttatgtgtttgctaggccccggccttgactctagctgcatatgtatcaaaagatggcctggtcggccatcactggaaagagaggcccattggtcaggcaaactttatatgccccagtacaggggaaagccagggccaaaaaaatgggaatgggtggggagggaagtgggggggagggtatgggggaattttgggatagcattggaaatgtaattgaggaaaatacataataaattttttaaaaaaaaagttgaatgatactaaatcagcctagagacgaagtttgtgatgcacatattagttagaattaatattttcaaaggtttttcaaagtttgataaggtcagaatggcagatttcttccatttggagtccttgattgaggatctggtagagagcggacttagaaaacactaagtcaagtctttgaggttaatcttgattcatgccatggtttcattcctgttgtcatcaatcatgacttgatggtcatctactgctttaggcattgaggtgaccatgttgtccaaggcagatgatgtctttaataaactagaatttgggttctagtaggcaaagatgatgcctgatgcttaaaagctaacaaaggaattaactaggggtcacctcaaggtgaattctctggagtgacctaacaaccatcaaaatgagacctggcttatataaagaagccataatgaaagaaaacccatctggggaagagcattctaagaagtgacactgttcctgtagcaaatcaagtccttaaaattttatttagcagctgaaagagtcagatgcagacatttacacccaaccaatggacagaagctgctgacccctgtggttgaatcaggtaaaagctggaagaagctgaggaggagggtgaccctgtataaagaccagcagtcttaactaacctggaccctaccccagagatatctcagacattggaccaccaaccaggcagcatacaccagctgttataacaccctcaacacatatatggtagaagactgccgggtctgtgttcattcagagatgatgcacctaaccctcaagagaccggaggctccagagagtggggaggtctggggggaattgggggatacagggtggggacatccttgtggagacaaggggtagggatgaggtgtggggtggggaacagtcagagggtggaccaagaaagggataaaatctggattgcaaaaaaaaaataataataaagattaaatacaatttagaaaaaaattattttgaaataattctttgacagaatattatttttttaatgaaagcaaatttccatacttaattagacagacatacttatttatttttctacaaagcattaagtctaggctgaatatttgataattcaggacatacatcttcaatattttccagaattgatcaatgttttgattttgtaagtggcaatgctgagaacactgggttgtgtaaatgtgtacaaataaatggcaggcacacatttagggcaaattcagaaatagttggatactgtgccttaataccaagtcaaatttcattcagtcagtatttataaaccttacgtcagcaaagttaaagaagaaaatttaaaaatcaacgttctaacatgataaaatccaaagacactaatctgatacatgttaaagaatgatggcagggaaccattgaaagtctttgttttctgtaattaactcatcacatgtctatgaaagcaggaacctttccaagtcttatgaaaacactgaaattcattatgtacaatagtcttaagtctgtgcagaggtgtctcaagcagtgtttgttaaccctgtgtagtgtggcaacatacacaaagcaaattatctgtgctgtgcgttcagacccaaggctgcagtgaacccactgatacagcactggcaagtgtggtcagaaacactttagacttgttgcatgtttaattttgaattaatttttgcatggttgcatgttcagaagcactgtcctgttgcaaaatcttttatgaaaatgcatattctcagtcacatgtccccagataatgtcgcagaagctgtgattctgttggcaggaaagtttgagaacatgaatgaaggtactaaactgacttgaagaaggagccaaaacaccagggaaaactgttttatagcatcctattctgcagtgactaatctagtcccttggaacttacgctagtcttacatgtggaggttttttaaatagaatgagtgtctgcccacatgatggaagctgaatgagcaaggaagagactaagaggagttttttttttttttaagcatgctcacatatcaggccatttgaaggactcttgaacatcaattagtcatcattgctatctcactgacaacatcatcaagcagtgtagagaggggaatgacgttaaggatttcccaaaatagtgtgcatgggatgccacctgagcactttgaagctgactcatgaggtagaggagaagcactctaagtttgaatgatgctttgaaaatagatcttgaaaagatgggaacaaggctcagggtcactactttcatctttctctatatttctagcatgttctcctaggtaattagcaacaactactgctctgtcaataagtacaaatccataaatctctggacaccttcttccataccagccccatatgtaacacacattctcttgtattctgcaactggaatttctactaatgaagtaatgtctacgtcaccatttctcaaccagctaccacactgggtatttgatgaagtatagactttacctaaagggatgctagcatatgtctttcattcaaataatggcatcaatgtatgcaatcagtccattacttggttaagaagaatgtgactaaaggttaatttccctggggtaatgatttcccctggttcacatgctctactaacatctcttttttatttaatagggacagaagatgtcctatggaaagccatgtgggagccgagattgccatggagtctgtacatgctttcctgagaaaggagcaagagtgagttgcttattgcattgttgaaagacaaatagtcacaggggaggttatctgttttatctgtttcctttagaattaaatagtgtagaatttgctcttctgacctcatagcaagagtaaagcgctgagagcaagctggaaaacactttgcccactgctaatactcagaaagagagtggtcaaatctctgagggactgggaagaggtttccctcactgacttaatgccaaggctcccccaccgtctcgttgaaatgactccaaaagccagttagcttgcacagaaccagattgtgataatgtttgtagatatgtggagatgttcatggctcatttatatccacttagtttctccctgccactctagggaacaggtgatccagtttttaatctacagattgtgatgcaatttgtcccaaatcactggcttactggggatagaatgaagagtaccgggaatctgtaaagtccagaaatacaggcaactgtaaaaatggtttgtagacactctattgaaataaaaggtgttatttttaagaggtcttatgctttaaaatatactgtcatgtgaattgaaataaacacagcattttcccctcagtccctatatacatttagccacagtgcgatttctaccaaataatcctgcatagaaaatgtattcaaggatatttattcaaataaagttatagatattcctcaaaacttatggctgctgggtaaaattcagatcatctaacttctaggattatgttatgtttgcattctcaccagattcaactgaaccaaagcgcctatactgtcaaaggaaagcagtagcataggggggaggtcaaccaaaccttcaaaaacatagtcaaacagggaacatgttgactggtccaccttctcttccattatcttccatttgcagtaaagtgaaatgtcaaactctgccagaatctgaaggaaaagaataaaaagccatctcttcatctgaaaggaccgtgcccattattaaggacataaacttggagaatcataagctatcagaaaaggaatgcattttagggagctcttcatctgattgtacagagaaaacagagttagagggacaatgacttcctgggggtcacacagcaaagtaatggcagagcccttttgatgtcttacctgtacacttccctcactcaaagactcttcctgtcttctagtgaatctacatttattgtagccactagggccaatgagttcttttaaaaggatttttattgcattgatttattttgttggagggcacttcatgcatgtggaggtcagagaataacaactggaagtgagttctctctttatacaatttgggtcatagggatttaactctggatgtcagtcttggcagaaagcacctgtagccactgaaccatcttactggccccaattgacttttaatcaatgtgctagaagtggagacaaagtgaaggctggcttcatgacttcttagtaccactactgtttttgtgactttcctctgtatataatcaacattgtgtacatgtctatacagccactctccatttttttttcaattctttttaccaaatagaattgaaaagtgttgtgtgaggggttgttttaagttttgtttttggtttagttatttagtttagttggttggtttagtgtgtgtgtgtgtgtgtgtgtgtgtgtgtgttatccttaagggcttttcttctatctctagttgaatgtatgtcccttttgctggtgacttttatttgttctgtgtttttgtcactccataaaggcaatacttcattggcaatacttaaactgatttccttgtgcagatagctacataaatactaaagataagaattattatgtatacattttaactttcaaaactattgggaaaattacccccacaaagtatcttcaaagtttccccattcactttgtatctgagtgtgccagttgccagagttttgctaagtacttgacagttttgctaatatgaatgatatgcatccccattcactgacaatctgtgaatctcagcacatgtccacatattgactgaaagcttgccagtcttctgtgaatttcctgcacacatcctctaactgattttctgagggggggggtgattcttacccatgcaaagaaatattaaataaaaataacctttgtggaagcagatatgatgtgacgtttaacaaaatcttgatggaatgtggtgggtagaaaatggtgggtggccctcaacaatcagggacctggggagccctaagtctacttgatgcactgggatcatttaataatgactgatctgaaatggggcccaccctgcatcaggcgcaacatgcctggagctaccccactgcttaaccttggctggggtttgattttttttttcaagattctgtgaggagtcctaattatggatccaaacatctggacctcaagtctgtcctctcccttgtaaacatgagtggttggatggaacagggatagaggaaaatgaactatcactgtacagagtttcttttgggcatttagaagagacagactacactacacagttaaatgtgtgcttaatttttatttgtgatctctgagatttctgagagtgtttttcagtcttactgaaatgcaccaacctcaattttatgagtcaagagcaagaatgttataattttacactataattttacaaacaggtaaggcccatgctcttgagacaagctgtgaacataagtgcttaatgcctcaaaatcactgcatcctgttttgtcacccttccagccctcttaagttcccagggccaagcagcgttgtttaatgtggcctcagtactattaaccatgcaggacaactcttggtccgcttttgtgcagatgtcagaaagatttgagactgttttccttagctgagcagacagccccatttggatttcaagctgttcctctccagctgggaggggagcagaagattggatcaactcctgagcaatgttgcagcccctggcaggcgcctcctgccctgaagagacatcagctacataacttgctgggcagtgtgtacttttcctttgccaaaggcctcttgaactgactgggacatttccacaacacctcacatgcctacaaacaggaatcaatccctttttggcttcaactagagtgaactgatgtctccaaatgatgccatgcttggttaaaagctttagccaaatgcgaaggaactacactttctacatctaaaacatttctgtacttcttttcttagggatcgtactacatcacttgcttaaatcctattattgaaattttagcctaccataaaagtgacaattgttaaatgatggcatagattgccttgtgttaaataaaaatggttacctttacaacaaaactggatatttaaatttatatttaatatttgactttcacatttctttcttatgaataaggttttgttatccagaagaaccattcttcctgccatttggttaaccaaaacattttaggttgtcaaacccatccctttcattttacatttatgggatttgaaaactgcttctgcattattgcctattgtttcttgttagtgtgtatttgtctgaaattaggaataagagtaggttgggtgttattgttgttgttaatatatttcagagttttacctgttttgacaggcttctggtgtttatgtacaacatggtaaagttctcactatccacagtatctaaaggatcactaacatcaaaatcaacaggatggtgatgaaacaatagggaatgtagtaggttaaaggcaggggtatgcagagtgcagagggaggaagaaaagatgtacacagcaattggctagttcacaagaaaatggagagacatcttggtagccacagcagaagtcaacagatacaaggaatactaactgttcccaggagaataccttgatcaactagtgggcagagcatctgggttctgtacaccatggttaacatgttttgtgacaggagaagcaacagaagtagaatgcacattgacaacaagaaattgagccatttgtgaaactctcactttgtaaactctcaagctgggtaggatatgacttcccaaaggacaaaatgaacaaatgacccttacctagggaaatccaagcattctctgtaaacaataacaccaaacagttgcttatgccagaaaactagcagccattcctgggttctcatgataatctgtttcataaaggactgaacaacttactgtgtatagttccagtccagcttaacatgtcctggattagctgtgagatctctataaagccagactgtctcctacccagaaagcacacagcaacatcaaaaatgaggatctgatacaggcatttcctcatgttcattggatctcactggttgtcagggtttcacattctggttcttagtgtttgttttcctaactcctctggagtttttattttactttggcttttcttatttcctgtcacttcttattttgtacttataagagattttgtcacaagagttttctttaactaccagcaatctgctcttccaccaagataaaagcattctcaaatcataattttttgacattgactgtcctttgcaccaactttttccttaaagcctcttaatcttgtgaaaatttgatgggcttccatttcacttgtttcttccccttgttggggaataggagaaattgaatctgagcagggagctatctccttgatggcagtagggaagggaagctgtgcggtccttcagtggttacatattgttatttaagttcagggtgattgatgataatcttagttagtgtctatgctctggctcaaggtgcattcctagccaagcagatgttcacagatgctcttaatcatttctttgatcatattggaacatatatagagtttctttttcttactgggagggaggctcctactaaaatgaagccatgtggctgaaggggtaggtaaatacatagttataaagacaaaaagaatgctttggccccctagaggcctaagtagtctacaccaactactgttttctcctctaaggaattcagtatacttcaaagtagtgtgagaacaatggattgtggcatggatctctaaggacctacaacttcccatgatctaacttcgacaccccattactgtgcactgaagttgtgcttgcctcagactatcttatagtgctttctagtatttcattgataaatgcagaacaatgcatggcagtgccttgattttggggtggctttaagaagctgcctcagtatgaagtcacagacagtggtggttttgtttgtttgtttgtttgtttgtttgtttgtttgtttgaaggcactagggttcaaatccaaggttccacatatgcaaggcaagtgccttctatcattgaattatgtcttcaactgtccaggctcagccattgtttctttcctgcagctaccaggggctcttaccactgaagttgagtgatttaaagatagtcacaggaattgctatatacagtctctcctgccttgctttagaatcattctgtctccagttttagctttgaaaattcactcttgcttcaacacaaccccatccttgtagtgtctgaatacacctccaactctgaagagaaggccaggggtcaccctattcatctgaggagttgtaagcacaagtcatttctctttagaaactgctcagttttcgtttcactgactctagtaattcatatgccagagacaatggatatcaaaaccatagctgagcatctgtacatcaatctgtgacagattcttttacctgagaatctactttctttgtcccttgccagttatttgtccccacttttgtcttcgttctcttttgtgactagtccctactttcttcctatccccttccagacctccctcactctggctttagtttttctaactctccatctctctttcccattctccccatcatggcctcctcacacaatttccctcttcttttttcaatttcatgagattgcttcccaggccactagtctctgcaactatctcattattctttgtcatcaaagaagcataaacatttcctcatcagggttttaggaaggagtccttgaaatgcactttataaaagcatctcacttctccaaagattctaagtctcagagtctagatttgtggccttcaaaatttggaattaaatgtatagaatgcaagacaatccactgagtgtgcaaaaaatattctattaagattaagattatggtaagaaaatctagaaagatactaaattctaaggctaagagtgtgtggttaaaaaggagtggatgcaagatagcatgctgaggccctaagtatgattctgagcagaggaagaaaagaagaaatggtggaaggaaagaggatactacctgtcctggttaattttacatcatcttgacactagctggagtcatcaaagagtacggaacctcaatcaagaaaatgcctccataaaatcgggctgcaggcaaatgccagtaaggcaatttcttaatttgtgattgctgtgtaaggacccagtcaattgtgaattactgggctggtggtcctgacttctataagcaagcaagctaagcgtgccataggcagcaccttccatggcctttgtaccaactcttgcctccaggttacaggcctccttcagttcctgtcctgacttcctctgatgctaaacagtgatatagaagtgtaagccaaataaaccctttcctcaacttgcttttggtcctggtgtttcatcatgttatatattatatgttatatattacacattatatgatatatgttatatgttatgtgtaatatataatgtgtaatatatggtatattatatatacataatatataatcatgaagactcttaccttaaacaattccttataggtattatttcactatttattaaagatcaaagcaaatttgcaataataattatgtgggtttgcttgtttatttttacataaaagagaaatctttgctggatatttggtactgcaggacatatactatgatgatctatctttgagaatgtttgtaagggaccatctaggtgaatggtgatcagaagacccatccttcctgataggtcaaataaaaaggagagaataatctgagtattagactgtggaaacaatgtgaccacccacctatagcccttgtctccacaccctctctaccatgagagactgtaccctatgaactataagccaaaataggcccttccctaaattgctgttgttaggtactttgttatagtaaccagacacgtaaatgatctatagtgcatctcaacttttttttcagagttgatggatattttaattttataactgttgatgctgagaaaggccatttcacataaatagtacaaagaagtgtgtgtacagccgtttcaaagattcttggaaataatatcctaatcctaagccaaaattcaattaataaccttttatgaaactaaagtcagtaacttaagcatcaattctaaaatcaaacattctgctacaataaatccaaggatacatgctgaagaatgatggtaaaatatttcttttgtttgttataattaaaccattctataagagcaaacaactttgtatgtatataaaaactctgcaattcataacatatagtaatcttgaccatggattgaattgattcagacagcatctattggctctgtgtggcatgatcagaggggtcaaggacaccgcaagaaaacccacaaaatcaactaacctggactcaggctcacagagactgaactgtcaaccagggggcactgacctatgccttctgtatatatgctgcagttgtgtagcttagacttcatgtaggactcctatcagtgaaagcaggggctgtctctgactttagctggctttgggatcctttcgttcatactgggttgccttgtccagccttaataggaggggagatgcctagtcttactgcaacttgatattccatgtttgattgatatccctgggaggcctacccctttttctaatagaaatgaaggagaggtggataagtgtggggcagaggagaggtggggactgggactggaaggagagaaggtaaaaacaaattttaaacccatatgcccatatgcataaattatatattcatttatttgttgaaagattacagaatttcaagtttggggagattggacccagcacccatgttataaattgtaatttgaaaagactttcaagacaaatctgggaatattcttctcatgttaactatgaaggtgcttagaagaaagcatccaaaaggttaagagacatccttgggcttccttcctgaagctttgaaccaagtatctcatccccacacttgtcgttcttcctacccatgtccataattattgcaactccctacctcatccttggtgcttggacaattgtgaacagaagaatacttggagtaaagaaaatatgcttagacacagaccagatagtaacaaatcaatcacctttctttttctaccccagtgagtagtaagtcataccactaggacagcatcatatcattgtctgcatttaaaaatatttcctaatatttctgtctattaagggctaaatcaatgaacttcatgcttaaggaaagcctgattttcctttgtgatgagaattttggggagggatcatatcatatcttacagctccaagcaggtctttccctttttgcaggccactcactatatggaattcagtgaattgaattgaagaatatggggataaagttactgaatatgtgtcagagaagatatttgatatctatttcagaggaggatcatgtattaatggaagtcttccaagaattttcaacaaaactaattgcacagcatctctattgcacactagtaaaagtcaatgagaaaatgtgcatcactttgcagaaattggatttactgtcatcttttcagtagggtttttattttagcaaatgtggcacctgtccaattatttaatgacctcttccacttaaaaaaattacagaggtgggtatcctaggctagattctctatttcattttcctcattatgtaatgtgcagttcaaatccactagcaaacatttatgaaagtgttcagggaactaaacattggtgcagacattgtaggcagtgaaaatgcattgcaaacaccaggcctctcctagatgaagacacggtggagtgcttagctacctagtaatgtagatggttagaagtcttaaagcatagaacacaagacccactaaagtagagagatttgtatgatatggtatggtatgattaagaaactctttaggaaggttgagttggtaggaggaaaataaagtgggttgaaatgaaagacataaagaacaaataccaggctccttgtttgttgggtggcatgcccaaaacctctagtgtagagaaagtgaagtttacagtgtctggggttgagatgctaaattcctctgaatgagtctattttatagaacacacataaaacattcacctgaactagtgacttgaaggagcttggcttctatgtggatgaatgtatcatgttgttactctttgaatgctcgaaaaaagagtgctagttccttttcttcacattcctctaaccccttcaaagcattgcagagttcccactgatcccattcgaaagcatccatcctcaagccaaatggaatccatatcactaaggtagactggctgttaacttttctctgtggaacacttaaacctcccaagattttctgtggtattcaaggagagagagagagcaactcagtggtttctccaaggtcatctgtttcctactcaatgaattttgttgtagagttgctgaatgaaaaacagagtttggagcatcttgagggtctcttttcctatgaaacagattttaaagtttggttcagtgggaaaaaaatcagccaagtacttttgtcccttgtgacactaatgtggtctgtgaccacagtaggatcatactgtggagttactactttatttttgaaaaaattaaaagaaatgcttcttcagcctacagaaagattaatgtatatgattcattatcatttatatcaaggaaataatggtttctgtccctgtgcatgtttttgcttgttcaagtaattgtagtgacttggcaatgtcctgctttagttgggttccctcacagagctgacaagagtcaatgatttctgtccctttcccatgttgctgggacaaatgccaataaatctatgagcaaagaagggagctatagagaaacatgctatgtggcagggaatggagtaagagacaaccagggttcaggaaccaggtttccccagagagagacaaaatgaaaacaaacaaaaggaagacacaggtcgaaacaggctccccagacggggcctatttgctgcaaaaatggagccttaaatttcataaagctcaatgaagggaagaagccagaagttaaacatggtctttgtaatacaattgaagaattattaaccaagtatacagaggaaaggccacatatttggtgagcaacatttgtttttcttaaaaacctatttaggcactctgtgaactaaaatatgttcccaaacctgtctagccacatagatactaatattactctcccaagccacagaggtacccaaaagaactcaggaaaaagtagagggaagctaagcagtgggaaatcccacagaggctcaaagtacctaacatgggctgctttttgaagcatgtgacagggagttgagtgacctagtaaaatttattatcaaaaacgcagaagttgtggctctagttacttgtccagaataatttaacttcttcctgagtttcatgctttaaataaaatttaaagaagattgagctccaataacagaaggatcttcccagctccactcctctaaggataaggagctagatcccttcttaccctattatttatggccatatgacaagccccaggcttatagttggaattgctccatcacagcctcctgcaagattaatgacaggaatctgaaaaaccctgaaatatgcacatagtattcacaacatcaaaaaaaaaaaaaacctcactttgcagactccctgccccccactaaacagctgctggtcccaccagcagctagcctaacaatgctacctgcctgtctcaggtcacctctcaggtcaatggcaaccttctgagataaggagtctgacagctgatctcaagagaggtgataataattttctgccatgctccccagggtggcactgaaccactgacctggtggaaccactgccctaacttgcccacctgcagcccaagccagactgtcccttggtccttagcagtggaaaaaaacgggttggaagaaatatgacacgaaacaaactcagcctgggaacttggcaccagtttccaaactggaagttctcaaacatcccttgttcccttcctgtaatgtttacctcatgaaaacacggaggatatttaaacaaataggacaaatgtcaaggcagaaggcccccttaggtatagtatagtctaaactttgcatcttatgtggggagaccaaggcacatgctggaaatgagatttaaactctgaagaatgttaaaaaaaaaaaaaaccctttcattcattatgatgaccagatgaaacccatgtgagtgagggacagaggaaaagaaaggaaggaaggaaggaagggagggagggagggaggagacaaggaaagaggagagaaagacaattgttcgaatcccagtaaggaaagatgtgaggcggaaatcatattagagagcaaataaaatgaatctgtgggttttaacatgcattcaattctagtggccaaagatcacttccatttccaagggactcaggaatacctaaatcatggtagggaaattcttcttcatggaagtctaattgaggatggtagttgagagcatatacttttgttggagttgggtaaattagtcttttaagtcctgcctctaccatgtactagatgggttttaagtagttctcgacaagaagaagtgtctcagggaacatttatcaatatctagatatatttctgcttgtcacaagtggtgaaacatctagctgctagagtactgaagcccttataatgcacagtcatacaatacaggactgtcccagcccaaccatttagcagtggcaaggctaagactctctgaattagatatatgtcctaaacattctaatcctcagctcctccatttgtgacttgaaaataatagtactctcaaaggactgctttgatcattaaatatgctgacctccataaagcaaaatctttcccattaattttgggtattcttcccaatacgcattttcaactctttctcctgcatagctccgtggatgggttgttcacaatcaaaatctccatttttcatattttccctttaaccattctcttgttttaaaggtcagcagtcctttgagataggacctagacattctattttcatttttacttaatctgccttcaacattagaaaagtatttttgaagttagagagatggcttagtggttaagagcacttgctgctcttacaaaggaaccaggtttgattctagcacctgcatggtgcagccatccatagcttcagttccatgagatttgatgccctcttttgatctggtatgctattctgacttccacaggtaccagacacccacatcccacatacaggtaaaatatttacatcaagaaaagaaaagaaaagaaaagaaaagaaaagaaaagaaaagaaaagaaaagaaaagaaaatctatcaaaaattttgtttttgttttgtttttctctctcttagtaaaccaggaaacaaacataaaaatattttggcttaactttcaagattcctttgattctcctcctgtttttatgaaccaagtttcccatctcttttgcttaaagaagagaagagcttggcctgatttgtttgtggaagaagttaataaattaatatttagaatgcaaattcaatgagatggtgtatataacgtgcttagcacacatttaacattcaataaatagccatcgtcactaccatactacaattgttattgtcaatgttactcatactattattagtctcctttactgtcctctaagtcctttgagataggattagtatatattttgctctgaaccttactttgcagttttacctactacaagatatatgtctagagatatatacatatatccagaaaatattttccaatagactggagtagctgataagggtatgagaagaggagactggaggaacgccttggcggggggggggggaacatgtaatgaaaagcttaactagggtggggatggctagtggctcatgggaacagggttccagaagggagttacacactagctatttgaactccccttttcattaaaaaaaaagtgggaccataaaatggagggagtagtcattcctacccattaatcatgcaactactttcctccctgggtttggaggagaaattggatgatagccagatgttaacaagaatcgtgcttatctattgtatttgacaaaatgcacatgaattcacttttcttatagtactggattaactatatatctattcatcttgtacttggagcaactttgtacatttatcagttactatggacatctttataaatttgcaaacataatttatattaccctgagaccatggtaccttgggtgatacacattagaaaaagtacagaaattaaattttactagaaaatttatgactattcaaaatatctacttaatgttgatgatctaataacatattttttcagtatttttagtgaaaatgaggtgattactaaataggatctttgatccaagtttcttttaccaccaagaacagaatagctattttttgtaataattaaagccatcgagtatgtcaactaagtcaactatggcattacattattgtctcttccttttcctctcaccactcatgtacaaaaatttgacacattgcactttgactttcaaatgtaattaaataaaacccatatgattctgaaagtccatggccatccaaaccaaagatccctgcttggttgttatatatctgacatacaataaataactggctttctaggtgagtcagcctatttgtacattgttagatagtccttgacctagtacagagaaaaaaattgtaattggtcttacatgaaaaactaaagtggagaaaatgaaccctcaaatccaaattattcactttgaaaggagtaataattagagcagcttctatttctgtcagtaggggtggggtagagagaaattttagtaatatttcaaaatggcatttttccttccttgaagtttaagcttgccaatcaattcaaattgttctaaatattaacttaattgctacatgttcttaacttttaaggaaccatggccctgtatttaagacttccagatgatagaatagttagatagatagatagatagatagatagatagatagatagatagatagatacatacatacatacatacatacatacatacatacaggcataaatacatagatagatgcatagatagatacataggtagatacataggtagatacatagatagttagatagatatatagataagtagataggtacatagatagccctccctcctctcacttcccagcttccttattagggataagatataggatcttaggatatgctgagaaagtgctctaccccagcccttcatgtcttccttttgattgattgaaatgtttgtggagactaaatcttgtcagagctactagagatgatttttgctatctctttcatcagcaccaacatcatttaataataaatataacacataacaagaatttagtaatttttgttaccatgtataaataaagctttgactctatcatatgttgttctaggtacgaactctcatgtaatttttaattagatagaagtgacagatcatagagtttaccctttaaaggcattcggttcagtggggtttagtatgttcaaaagactgtacagctgtcataatccactaattccagaatacaacatcagcttatctcattttaaatcatagcagcctttaagtgcagtgacttatttaaaaacatcgttttgcaggggtttcaagtataatttacagagtttaaatagctcggcagattccagcagcatataggtgatggagctgagcatcaaagacagatctctggtccctaaactatgaaatccccttttaaaaacttcctttgtctctcatttgtgccatgaagcattcttattcttattaataatgatacaaaaggggagacattttctgtgtctgtgttgacttcttggcctctttttctttgtccctgaagagactaacagattttgtagtagtagtagtagtagttcctcacaactacacatatctggcccataacacatagataccttgacaaaaataaatctctctgagatggtgatatgaatttgcatagattgtcttgtagtgctaggggaatgttagtggtcccctcaaaacccagacaggagccgatatgatacaactcacagcagggtttttattctattcaagctagctcaggcctcctcagtgcattgctgtcatgcaggcagttttggtggtggtggtggtggggaagccccgaatatctattggggcaaggctttatagtaagcagcaagcagggagtatgtgtgcaagcatctaattggaaagctcctgtggtctttaacataattggctgatgctgggagtcatataataaacttaatttctgctcccctctgcattggtgggtccttagtcagggggtgagcttgtaacctggggtgcaggtttgttggagaaatcgcctggagacgctggtcttgttgagggtgtaacctgaaaatgctggttttgttaaggtttagcctagagagtggagctaagcttggattttgttggcggacaacttggaaactaatgctaggtaccagcctgtcagttaacctgagttcaaacttaggtcaggttctctaaaatggagactgaacataaaagatttggcctctcagtcttaaaggtatagttttgttagtttgttttggatttttgagacagtgtctcagtttgtaacctaggttgcccttcaaccaagacaagcttcctccttcagcatggtaagtgctagggttataagaataagccaccacatggcaaaaagaggtgtaaaaaactcaaatttgatagatcttccaagtcctactttcagttcccagtatatcattattcagcacagtgataagaacagaattacattgtgtgtttatgtgtgtgtgatgttttatttaacaaatacaggcaagatattgtagcatgtaaccactgtaaaaatccttattagagataattatacatattttatgttctttctgtctttgcagtcttgtttatgtcacaaagccacttttattttattttattttgatctattttaaaaattatttcttttactttttatattataatataattataacatttctcttttcctttcctccttccaaatgctcccatatatggcttcttgatttctttaaaatgtatggccttctttttcattaattgttatatgcatatatgtatatacatatagaaatacaaccttctcagactatataatgttacttgtatatttcttttcatgtctgagcatttggaattggaaaactagttggtgtgctcttccctaaggaagactcagcatttcttagttgcctatagttctttgtatagaattgagatcacctggacttttgcctctatttaaatgtctattgttgttgctcttatgtagctcatatttaggcagtaatgttggtgagactttatgtatgttgcttcttacattactaggaagtacaatctcacaatgaactccctgttcccctggcccttgcaatctccccaccccatccaccccctttgcaatgatctctgatctgtaagtgcgagagtaactttgtagatccattgggattgctctctgcaactctatattctaattggttttggttttctgtagttatctccatctgtaagagatgttttctggacatgcagtaaggaatacggttatctgtgagtataagtacatgtatttagaatgtaattagggactattcttgattagtaaagtggtagttgtagtttctcctccaaagtccatgacttcggttgccctgagtagttggctaggtttccagtaccagacatgatttccctctagtcaaggaggtcttaaatccaattagagagctgttggtgttggttagcatcaaagtataggtgctactactacattcttaaggtcatcatgccatgctagccattgttatggttcatcaatatcatagcttgagtggacttttggttgtctctttcttttagaatcttgtgccatgcttctggtactctgaaagctggtcatcagagatgagacattcagatcagtttcagctcatgagtctttgggctgaatagtatctccagaaatatggacttaccttccacttctggaaagacagccgactgcaatgttttaggagtctcttggacaaccctgaccagcaactcaaaacaaagttgaagtatctttgttacatggtctttgtctcttagaaggaacctgtcaactcaggtgggaaattttcatttaaactatatatgtataaatatatgcaggcttgtgtaaattgtagtagtttttggtagatagtttgagtttaaattttaaattatggtctggttaccccatgataattatataattgtataaccttggcaatttaaaaacaacaagcctcaatttcctcacaacaatagtacacatatcacaagattgcggcaacgtctaaattaaatgtgcatggtatatgtctctcaaacaatgttaaaaaaatagtagcatcagagagtggataaagaggggcatgatagagatcccattatgttatacggtctgtgctatccctaagctacctccctccaaggcaaattataaatatgcgtgcgcacacgcgcacgcacacacatacacacacacacacacacacacacacacacacacacacacatccgaaaacacaaacatctattaaatgtggctatcaacattgagagaaataacaacagacagcatacaaattcatgaaagctggacaactctccactggatactggatagttgtataagtaaagaaataaattaaagaggatcaggaaattgaacagaaaaatgaagtagtgggaaatggtgtacttggcataggccctagaaagtcccaggctccaggaaagctagaggctcccagaactcaatggtgatgacttaagctaaaataaacaacaaaaagatatagaacctatagaggccatctccagtatataggcatggctcctagttgagtgatggggccacccatgcatcccaaattttttagcccatacatgttcctatctaaaggaaagacagggacaaaaaatatctgcagacaggaaatccctatactattgctgatgccaaaaagtgtgtgtgtgtgtgtgtgtgtgtattaagctaggaagtacctgccatgtagtataccaatcaacttaaattgttctactaattcttgccagtttaatcaactaaaagcataaagatcattttttggcattaaatcccctttgagaaaagcattcatgtcattttccatctttaagaattagcagtggttcccagttgtcatcaaatagcaaaactctacttggcctggagtatacatagcatgtgtaggagtggcacaatgtcagctagtgtatgacctgcataactggaccacatcatcctggcagagaaatgtgattgagtagaagccagaggcccaaatttagttgagataatgatccacacactactgagatttaagagactgggaataagatctcaaataggacttaagacagattatccctttaagatttacatgggtgcagtaagcagtcaggagatctgttactattcatgctaagagcaaagaaacccaaatttgactatcaatagaagctatctttaagtgcttacttacaattagtgaggacttgactactaattgcttcatctacccagtatttagtttgctcaattatttagtactatatcttttttattttaaaaaggaaactaaggatctatgctggaacattgtaaagctaggcttcaattcctgatcggtctgattcaaacatgtgtgctctcaaccatcgtaatacctccaaaacacaatgctgatagtaactaaagagcattcacttggccactgggacacaagaataaaactgtctcagcaatgaaactgacttgtagtgaatgtctcgcttgttgtctactgtgtgctggcagcaatgagccaagtgcatattgaaactttcagggaaaggctaagaaattcttggagtagcattgaaacagactgcttcagtgatttgactcaagatttgattcttttgttgctgctaacagttcactttggcctatagagccattctgaaatttttgtcctgatcaccccctacagtctaaattttcagtagtcccaaacagcataatggttcctaacatcctacctttacattctgtattttcaattcatctctaaaagatgatatagcatgctggagtaggtggcccttccttccactgaaaactcccattaaaacaagtgacagccgggtatggtggcacacgcctttaatcccagcacttgggaggcataggcatgcagatttctaagtttgaggccagcctggtctacaaagtgagttccaggacagccaggcctatacagagaaacccagtcttgaaaaaccattttttaaaaagtggcaagtcctttcagagatattccacttttcaagatgaagttttctttttacagaaataggacaagcaagaaataggtaaaggaagaggatggtattaagaggcagcctctgttgaaaacttcctggatctctttggagtttaaagaaagctggggaccttagaatgttttctgctctttagtagtcagtgggaggaacaaagaatggtggcataaactgttgcccaatttttttatagtaaatgcaatgcgggaagtaatatccaaagaagatggatggcttctttgagaagtcagacacaatggtatctgtgtttctgaccaaaggtagtgtactatagttaaattacattggaagatactttaaagttaatttctaaggcaaacaaattgttagtgaattatttcctcaatgtgtatttccttgttcattgtggggggcatcttagacacattataaaggcaaggcagtactgcagaggtctcttttataatcattagtagtatctaaatgtttaccatgcagtgttttagatacaaaattcagggttggagttttaagagtacttgctactcttacagaggaccagtttggtacttagcatttatgttgggttgctcacaactacttgttacttcagcttcagggaatcagacactttcctttgacctctacaggcgcctacacatgagcagtcttgtgaatgcaagagagagagagagggagagggagagggagagggagagggagagggagagggagagggagagggagagggagagggagagggagagggagagggagagggagagggagagggagagggagagggagagggagagggagagggagagggagagggggagagagatataaatagaaagggtgcaagaatttcctaaaagggaacattctttgctatactttggactggggtttagtatccagaatatataaagaactgcaaaaattaaacactcactaaaaatttagtccaatcaataaatggactaaagaactaaatagacatttttcaaaaggattataactgattttatattggctgagcacagtgcactgcctacaagtaactcaacagattggagagagtcctgtccaaatgtctcagttattttgaacctcttgcaggcagctcagctggcttttgcttattccaggcaactagtttgttcactgaatctcctttgcagcctggcttgtgtgagagtgaatctcgacagcctttcctgtgcacttttgggagagaaatcctaatgaatctggtcagtttcaagaacttcctgaagctcattgtgagttgtttacttctgtcttaaagagcttccctgcaggatggaatgtttcagtatctgaagtcactgttaaacaacagagctaaggtgtggacaaaatgcacatagcttatttttaataccagccataagaatgggagaagtaagtagaaagaatagaaagtagtaagttaggatatacatttggaatcccactgaagcctccaaaatttagaacaattacagcttctctctctctctctctctctctctctctctctctctctctctctctaacacacacacacacacacacacacacacacacacacacacaaacacaaacactaatcatcaaatccaggaaatacaacatttacacaatacatagaaaatctgcattccagtctcaatttttcccagtgtctccaatgatattctagtagctgtgtgtttcatttgtttgttggtttctataaggttgaatccaataaaaaaaatactgggcaatgcatttagtttgtcagtttctttgatttccattaatctagaagcttctctgattctacttttttttttcattttctctttcataacattgatatttttgtgaatcctggccagtattttgcagatgtgtctcaattggatttgtatgattatgcctcatgaatacattgtgattaaaaaaattaccacaatgttttgctctcatcaggaggaatagaatattattttttgcctactggtggtaacgttagtcattcattaggactgtgtccaacatatttctctattgcactgatatcagtaaagcttttaatctgtgtgaatatatcctgttcagaaacaggctctttaggctgaaagtataaattacttggttcactacagaaccacgagttgaaaaggcattatccctaattaaaagaaaaaaatagaacagatttattttaatcaaataagctgtcattaagcttcttagccaaattcaagagctattcacatgacagaagactttatctatataaagtcccttatccaaattgtgaaacgtttgtgggtgattttgtttcactccttttggatggctcttgccatcatctaagttagttgccttacacatgtggtttgatcagtatacgtgcctatattgttagatctgagcctagtgcctaagctacagtagaagctcaaaatctgtggagcacatttttacccaattacaactactgtcatcatgaatgagaatctaatcacactaagtggaaagtatacttgactttgtcagctggcaccagctgtaataaacttggctgctttcagaccgtgcttctcatgggaaatgacagagctttcggttttcatccagatctttgaccttcttcttcaggtgttggtcaagtctatagttgtcctgaaatggataacttctttatgttgaaattagaagctgtcctaagtaaaccaaggatcaaccctatgcttgttaagattcagtctaagcagaaatgacagaaaactctaaattacaatgggttaaataatagagtcatttattcctctctgatgtaacatttctcacttctggccaagataagataacaagaaccagatttactctcctgccggaaacaaggcgaaaaccagaccaaatgaaaacaatagccctcagacattggaaatgaggcaacaacaacaacataccagtgacccctgcaaaacaggaaacactgaaggcaagttctttatgtttttaaagcttaattcctggagggcttccaggcaataatatgtagaaaggataccaaagcagagttttacaggtgaggagatgatctgtgctccaagtccaggaggaacgtggcaactagaatttacacagccaagtccagaagaagacaagactatgtaaaagaacttaagatcgatagcaagtctccagtgaatctttagcagagtactgatcaacatgtgtttgtatggaatctaacatagaccaagagggaaaaacatcaaaaagaaacagtaataataatcacagttctaagatatgacataaggctgaaaatagtgcatcaatacctaaccagggtgaaaaggctccttttgcatagagcatcagatagagtattcaaaagagcttgccaaaatagcctttgattcatggatacaccagagctggataataaaacaggcctggagtgactcccttacaaagtccaaggatatttatagaaatacaaactgtccagcaacaatcaagataaaattcacatctggcatcccatgcaaagtcatcaggcatttgaataagctggaaaatactgatcactaatgagaaaagtcattcattcaaaactatcctagaagtaacagatgacagaatcagtagcaaatttttaacagttaatgtaactttttacatacgtttaaactcctagaggaaaaactgaataagttaagatatttagaagatctacatagaactcagaaagatgaagaatgcagtgttgagctgcttctcaagtctacctacacagttaaatgtttgaatgacagctctattgactctttatattgtcttacatctcaatttatgattttcaatttgagtctacagttgttgctctagcttcaaccaacaaaacttcattgaaaaaaagcaagagactagtggaaaataagaatgcccctccatttaaagaaactcatacatttcatggtttagatgtttgcatactatgactgtaataaaacactgagcaaaaaccagcttggggaggaaagggtttcattacacaattttcaggttatgctctatcatggaaggagttctggtcagacactcatggcagaaattgaactagaggctatataggaacaattaatggcttcttgcccacagcttcctcaacttaccttcataaatcatccagaaccatgggccaaatggtacttctgcacacaatgaactggaccgtctcacatcaattatcaatcaaaaaaatgaccccatcaatttgcctccacatgctctcatggaagcattatctcaaatgatgttccttcttctcaaataactctaccttgtgtaaagctgacaaagaactaattcagatggcatcaacttttgcttgcatcacataagccaaaactttagtaccactgacccattctgaaagtgaaggaaaaaaatacagtcttatgttgcccttactgcaagaacaaagaccattcccagcaacaagagtgttgattgtctagaaaatgttaacatcactcaagagcaacatgcagtcattttaagggtccccagaactctctggagaggttgcagtcaaatgagacttcttagtctccttagaagaagaagagactgagttaacaaatagtggagaaaatagaaaggagttgataactgttcatactctctgcagttacataaaaaaaaaaaaaaaaaacatggtcagaggtgttacaatgagattctgttacaagatgaggactttttacactcaattcctcatcaataccattttttcacagtagaatggatcccttgttgaaatccaaatgtcttggttgaaaaacacatcttcagggtttggatgaatacagatgctgcttgttaacgatcttaagtccaaaatgatgagtgagtccttgaaagacatgatattgaacttgtttcaaattcagcttctttggtttagcaagccacaaaagttaagaacaaggtcattggaacatttcaggatagtatttgtttctaaaaggggaactgtgcagctggttcatgaagatctcagttatccagctacataaagaagacagtgggttgttaggccaatttgtggtattttaatgatgcaataaaaaaaaatcctattgctttgggatacattcgtaatctctgtaaaccggttggcaaataaaacaaatcaacccaaggaaaacatataaaggaccattaagacacctcgtggcataaagctgttaatccctttggcacacatggcagaaggagagaactgactccctcaagttgtagtagttgaacctccatatgcccaccatggtggttgtgcacatacatacatacatacatacatatttttataaagaattggtcttagttctgggtggctactgttcccagctaaaagaccagagttctatcagttagcaaagaataaaagagtaagaatgaaggggaaagaagccacaacttgtccagttgaaagccttgtcactgttctggagcagtccttgtctgaggatgaataattatgacccttgtctttaaaataatcttaataagactccccctaggtatttttaatatctagagaatttcaatctatgtaatttgttttcaaggatttgttttgattctaggccccacacctctgcatatttgggggtttatctcaaacaaactgccagagttgttccattttcagtcggtggcaccaagctagaagtggaacttgcactttgtttaacttctaactatatttatcatttctaagacaccaaggtcattcagtgtgtttacaccgtagtcctgggtggctcactttcttccctaataaagtcactatcacatacatctgaagccacctttcacaagccccttcatgtttaatgctgttgaacttcattcccttcttcccataggtacaactttttctctgaactgtgtaacacctatacctacaaccttcttctggttgtccttataactgattggacaaattgaataacctggttgctacaattcattggatatttgaacagctttcactattttacatggtctttattgctctcaccatgtcaaagtaggtactgttctctttctgagatgataaatggtcatatagctggacaatttttttcctcgagccaaaaaaaaatattactgaaaaaaatgctgcacaagacacatgtcattgctggctcactaatgttcctgcagagcatttttcactagctctgtgtgatatcttgagaacacaaaccaaaagctctgtaggaagtcaggcctgggtgctttccagttactaatggctttgattgctttacaaccttccattcagacactgcagtgtgacattttcactttccctcataaaagctctctcctcctgtaatcatattgcttctgtgtgattagcatccaaaccatcattattctttaggccaagtcagattgaatctgcaacttaacatgcataaaggtttggaatagcaaacgaacatcttaaagaaatgctttagtggaataaattaggatgaaactttcagtgctgatttagattccagattatgaactcagaggaagatggtttccctgctggatcctgagggctagcctactgtagacctgtccacaaaggtcacatggaatctgtctggcagacattctacttgccttgctgtgctctatctcagttgatttctttttttttttttttatttttacttttattttttattagatattttctttttttaatatttttattacatattttcctcaattacatttccaatgctatcccaaaagtcccccataccctcacccctatttccctacacacccattcccatttttttggccctggcgttcccctgtactggggcatataaagtttgcatgtctaatgggcctctctttccagtgatggccgactaggccatcttttgatacatatgcagctagagtcaagagctccggggtactggttagttcataatgttgttccaccgatagggttgcagatctctttagctccttggatactttctctagctcctccattgggggtcctgtgatccatccaatagctgactgtgagcatccacttctgtgtttgctaggccccggcatagtctcacaagagacagctacatctgggtcctttctataaaatcttgctagtgtatgcaatggtgtcagcgtttggaagctgattatggggtggatccctggatatggcagtctctagatggtccatccttttgtctcagctccaaactttgtctctgtaactccttccatgggtattttgttcccaattctaaggaggggcatagtgtccacacttcagtcttcattcttcttgagtttcatgtgtttagcaaattgtatcttatatcttgggtatcctaggttttgggctaatatccacttatcagtgagtacatattgtgtgagttagaatcaacagtcctggataacttaggaaagtgaggatttttgacttaacaaaacactgttttttacttaaaacagtgtgtcaaaagaaaattccaatttctttttgggaagacagtggcctcagggaaaaggaaagataggaataatgagctggtgtgaagcaaaataagttatgagactagatatttttataatgataaaatggatattaagaagttcagctttattccatgtgaaaatggaaaggaatctttttttcaacatggatatttgaaacttgatactgaatgatctcaaaaactcgaacttggttccatttattttaagaattatctccttggccatgactatcaaaagttggcatgacagcttgaacgtcaaatactattaatactataaatagaaaacaattgctagctaagtatctcactttctgactgctttctttttattgatttgtaaagtgtatcattctttgagctggattgcactaaatctgaagtgtctaaatccaagtagtcattcttcccagaggaggcaaatcaaggaaggttttgtggtctttcaggagaaaaatcccaagaaaacaacaacaaaaaagcaaaacaccttgttgaaaatttcatctaatgacatataaaaggccaattcagctttaagattctgtgcctttcttttcagtggattatatcgaaagcacaagagctctcagtctttcggcagtgaggcagggtgatgaagtaggattaccaaatcaataaatgtaacattaagcttattgaatgtagtacattttttgatgcctctgtatttcaggcttctttgttttggtcacctttctttctttctttctttctttctttctttctttctttctttctttctttcctcttttgtgactcagggtctcgctatgtcatagtgacatatagactaggctagccttaaactcacaaaaatctacctgccactgttgcccaagtgctgggattaaggcctgtgtcaccaggtctggcatttgctcacatttcttaactgtgatcctttttttagatctattagcagaacacttttttaaaaaattagtcttcaacaacctttcctccactcctccatcctgtctattttgaagagtctctgtcttcatcccaagtcctattttaccttggaagtccatatctaatatattcttgccactcttgtatgccacacacaccagggtagttcacaggctgtctatctcccctttctgattctgctatttcaacctctgacactgtgctgagcttttaaaaacttccaagccactaatctagtcaaattcctgcaggatacagatgaggaagcagccccctcacccccaaaaaggagggaagttttggaggaagtcatgtaacaaattagaggctgggagcaccatttctatggttctagtaatccatttctccatgccacctgtcaaccaaacagaaaacactccagaatgtcagagtgatttgctgtgttaaaaataatcacttgtttgagaaacaggaaaaaagttgctttggggcatccttggccaaaaaaaaaaaaaatccaataaagaagagctgagtaacactgttcaatccctacatctatttaactgttcacaaatgtcttctttcattgttgtctaagattgcctaactagtgaagttgttataagaacttaagtcatacaggcaaagtagttaagacataatagatgtaaatgaacaatggtacttaatagtatagttatttcttggaaatgtaacatgttttctttcagcattatggtttctgattagtctatatacaaagaaaattcaaattttagctctctgaataaatgagctcaaggtgagttcatctggtttgccaccagaatgtcattttaagatgtagattgatagccatttggctgtccttttttgcccctctgtgaaaaaagcaaagtgcaaagtagaggatggggtatgagggttattttaagttcaagtctggaaaatgctattcttagctttgactttcataatccaactggaataaatgaaagagaaaaattgtcataaggaatggttatttttcttggagacgttcacttcttgagaattcacaaacaaattgtccttgcctgtgactaaaatggtagatttctacagagggacttcaaccgaaataaatgtccattttggaaataaatattcagaagcaacactgctagcattgcctggtttcatggtgcatttatttcctatttgtttctatgcctttccccaaaatattttccaaggcaaagtttgtaattggggcttgaatcacaaaacccagtttatttacgtctaccaaaaatttgatttcccaaaccccaattccaaacaactatttcttcctagaggtatacagcttctactgggtttttgttttagagattttaatatgcctactcttccactgatccttggagtttgaaatttgctctctcttctcttaattcccctgtcttctttgagcatcagttctggattattaaaagttaatcaattaaccatagattagttaatccagctagaatttcacaagagccaagagtataaatgtaggtgcaatggccttagagtttgagagcttgtcttttctgccccattattcagaaatttctaaagtgagctgagacttcctgggaatgagttcatagaggagactgtgatgatagtgacggataggatttttgcagaaataaagtggtataatgtgagtgtgtcatttaggtagaaaagcatagggtagatgtggggaagtacttactttgacttgagtatgagattgttttaaggaggggctgttcaataataactatttgaacatagttggaattatacaaagataacctatttgacaagatagacttgtacttatttgaaatgttgttccttttattttttgttcacttccaattttcttccctttttgaatagtacatgcattttataaaataaaattaatatgatctaaaattaatagcatttgaactccctaaatggaactgattaatacacacacatactctctctctctctttctctctctctctctcctagatttctcccttgaaaacatagtcatgcaaataatttcatattgagaaagacagagttctgagattcataccacttcttatatgatttgtataatcccaccttgtcaatattttatctgcaaatatgatgtggtctttttcctttgattaacttatattacctggtaaaggtgtagtcaaaaatgtatgatgaacaaccatttccatgattatgttatattatgtaaaaaattttatctgatgttgaaaaaattcttcatgttttgaaagagtcacgtgacaaatacctgagaagacttcctgagaccaaatgccagcaggcaaccagcaataaaacagcctccccctaaagccacaaagaacttaatttagccaatgacaaatgatcttagattacaattctagttggttctttgaatccagccaagtgagtatattaatgctattttcttatattctacatttttttattctttggcaagtgtccctgatggaggaatgactccccagggcaaaccaaaccttagggatcacaaatagcatatcccagaccacaccataccaatacaaactgaattatctggtatataagatacctcttcttcctgtcttttatgtgttaggagacaatattcctctctttcagccattttagggccaggtgcaagaaaagtagaaataacctcatatcacagtgcccagtgaattatccaaactaaactagtcaagcataacctgctaccttgtcttgcatttctccatagaaaccatagaagcatccctgctcatgatgttcctccctcttatctcctcacagtacttggtacttccctacgtggctctgtgtggcacagcaaacttactcctcttgggaactataagaaactacattttaaatagcagtcacatcttcatctgaagggctcagagaaaaaaaaatgaattaataaattgaaagccctatgttttaaaacagtgatagtccttaagcagaggcccagtgaaattgtgctgatgaaaactgtggcttcataaaacttcattgttaattaatctttgaaatgtgtaaccatttgttttgcagtaacagaaaacctgtccaacatgtaaaaattctatctaagcatacaatagtcatttctaatctatttgcccacttactataggatgtatatcaccatgccattgaaagactttgaatagtgaatgaaatacagggagctgagcatgaaatagcactaaaatttggggcagatgagaagcaataagtggagaaagcttggcaggaagtcttgggggtaataaggatcaatggttcttaacttggaagtcacctggaacagatttttggacacagatacccagggctcaccactcctagagattttccttaattttccatagatagaatgtggataaacaatgttttatctccctgagtaactcctttgcacatcaaagtttgaggctttgagatagagttagtgtcattccaaataaaggtagttcaactaaaggagaaagagaagattggctgaaaaagccattgctaaagaaactaccaataaccaaatagtaactcaactgggaacactacagattgtgtttttgttatttatttgtgtgtgtttaattaggttcttattcttctagtgggtattttttttaaagaaacttcttttttattattttaaatactttattttaaaacagatggaatataaagagaacagaagctagaaattctcactgcattatttttattgcttatacaaataaatatatgtatgtagattatacatactagatataagtaaaattagtcaataaattatgacatgaaaatacagttttaaattatgaagggggtaaaaattgcatgtttaaagtggtgtattcattcacatactctctctcagggaggcagaggcaggcggatctctgagtttgaggtcagcctggtctacagagtgagttgcaggacagccagggctatacagagaaaccctgctcaaaaacccaagagagagagagagagagagagagagagagagagagagagagagagagagagagagaaagagagatttttaaagaaatttcttgaagaaacaaaaactttaagctaactatgcatacatgcatacagttactagaaagaatgctgaggtttcagggatacttctagccaaatgaatgaatgaataaatgaatgaaagccttaggttgacaagcactgctctacacactggcttgcagttagttgacacagtgagctaaattcgaataactgagccaccattcagaggcactgactggtgacttttaaaagaaaggaaataagctgattttacaaagcagtagctaaggcagagaatctgagatatactatgaagaaaggcatagaaaacctagggattggatacttcattcttccttagaatagggaacaaaatacccatgaaaggagttacagagacaaagtttggacctaagatgaaagaatggaccatccagagattacccgacccggggatccatcccataatcagccaccaaattcagacactattgcatatgccagaaagattttgctgaaagcaccctgatatagctatctcctgtgaggctatgccagtgcctggcaaatacagaagtggatgctcacagtcaactattggatggaacacaggacccccaatggaggagctagagaaagcacccaaggagctgaaggggtctgcaaccctataggtggaacaacaatatgaactaaccagtaccccccccacacccctggagctcgtgtctctagctgcatatgtatcagaagatggcctagtcggccatcagtggaaagagaggcccattggacttgcaaactatataccccagtacaggggaacgccaggaccaagaagtgggagtgggtgggtaggggagcaggacctggggggaggagggtgtagggaactttctggatagcatttgaaatgtaaataaagaaaatacctaataaaaaataaaacctagggatcaaagaccttagatttcaagtcctcttaggtgattaggtgattaggtgatacctgattgctactggacgacacagaatccatccactgccgagtcttccttgttgaggtgggagcatgaaaaaatggatggaaacatgatgaaaataaagtagttctcaccttctgcagtagtagttctcaaccttcctatggctgtgactttttaatacagttcctcatgttgtggtaattcccaaaccataaattatttcattgctgaatcataattgtaattttgctacttttatgcattttaatgtatatcagaggacagttgcatgaaataagaattagcaatacaaactgataagtaagagagcccaggatttccttctttacagatccccaaagggaaactttctgatactatttctggttctgattcatatttctggctgtatttcaagatgtgccatgtgacatgtaagctggtcacttgtagcgagagcaccacatggccattcctctctgccttaaatggctgagtcgtacccacttccttaagagtataaataatttactctctattcgactgaatccagttaatatcatttcccaaaataccctgcctgtgctcttacatttactaatacttttcttgccaaggtcttctaaatatcctgtatatttattttattggtaaaaataccacctgacccaaactctgaagtaaaggatagaagcatcattactcagcccaatgggtttgttttagagtcaaactgtccctctcccttgggactgaaaacaactgtgtgagtccctgcttttcatcataggtttattggctaatgaggcctgtggctggtgtggttttcctgtgtttagcttttggagctctcagagacagttgcttggaacagagagctgacagaattattgcccagcaagcttgctggccacagctcacaacattgcactaccaatgatggattttatggctgacttaatgagcagaacaagtatttgaagaagcacagtgaagagctgttggcatcccattctgctgtgtgaagaggtctgaaagtcttcttattaagccatcctttatctatgtctttttgctcaagactttattatcctttctgaagtacctggacagtactttctgtgcaactgtagattcatgtgaagtcattgggatggaagacttgggacatagctctcccagtttccgtgtgatgaaagaaaacatagaacagaaaatgactgaagttcttgttacctcaatgtttccagctatcaaacttctagtcacacttagactattgaagatatgtaggtaggtaaggagagagagagagagagagagagagagagagagagagagagagagagagggagagagagagagagagagagagagagagagggagagagagagggagagattagatagagataaagatagagatattcttaaagcatttacatcttggctcacaagtttgctgaggattggccactctgggccagcctaggctcagtattgagtctgtgataagctagaattttttaggctggatgcagttttgcatcacatttttcctcttcttcctcccccttccccctcctccgaacatcagtgagctagactcactatgttctcttcatatttgaggctgaaatgcaaaaacagttacacagagtacctcttaggcatagactataaaagtcttagagataatttccataacattctgttagctaaagcaagttatatggtacaacccagaatcaatgaatgggaaatagccttcatctcttccaggaaggaaatcactaaagtgcaacagataaagacccaacaaagaaccaaagtcaaaagtgcaatctaccacaggtggatagggcagacatgatggctcccaagttgtaggtgaaaagcacaatgctcaaagctaaatgtgactcaaggtcaccacaaaaatttgggaagtgacaaaacgcaaatccaactctcaaaacttttcattctagttcctttgtgccattctaagtatccctactatattcccacaacttgttaaagggctcgaagtatttgggagaatgatgctttgaggccgtgttttcttttctttttcaattttattttatttttaatttatttttacacatattccattccccgcccctccccatccaccctcagactgctccacatcccacacctcctccccatcccacagcatctccacttggatgtccctacctccaccccacctgacctctaaactctctggggcctccagtctcttgagggttaggtgcatcatctctgaatgaacagagacctggctgtcctttgctgtatgtctgttgggggcctcatatcagctggtgtgtgctgtctgtttggagatccagtgtttgaagatctcggggggggtgggtggtccagattaattgagactgctggtcctcctacagggtcaccctcctcctcagcttctttcagccttccctaattcaacaaaagggtcagctgcttctgtccattggttgggtcgtgttttctttctgtcatttttccttaagatttggaacattttcctgtttcacagtcatcaccattcagacatgactgagcaaggagtatgaatgaaatcacatcggcacacacacacacacacacacacacacagagagagagagagagagagagagagagacagacagacagacagacagacagacaaagacagagagacagagagacagagacagagatggaaaagtatatatacaaaatctactgtctggaaaaaatgagtaaaatcttcctttttttttttaacaaaaatgggtttaaaaagaaaatccaaacctcacatagcagttgaacaataataactttaatgctgacatactatattcctttgaaaaacaagaatatatgccgggcatggtggtgcacgcctttaatcccagcacttgggaggtagaggcaggcagatttctgagttcaaggcctgcctggtctacagagtaagttctaggacaaccagggctacacagagaaaccctgtctcaaaaaacaaacaaacaaacaaacgaaaaacaagagaagagaagagaagagaagagaagagaagagaagagaagagaagagaaagaagagaagagaagagaagagaagagaagagaagagaagagaagagaagagaaagaagagaagagaagagaagagaagagaagagaagagaagagaagagaagagaaagagaaagagaaggagaaggagaaggagaaggagaaggagaaggagaggagaggagagaagagaagagaagagaagagaagagaagagaagagaagagaagagaagagaagagaagagaaggaagagaagagaagagaagagaagagaagagaagagaagagaagagaagagaagagagagagagagagagagagagagagagaaagagagagaaggagaaggagaaggagaaggagaaggagaaggagaaggagaaggagaaggaagagaagagaagagaagagaagagaagagaagagaagagaagagaagagaagagaaggagaagaaagaagagaagagaggagagaaaaccaggattattaaatcaccagaaacccgtcagcctctcgagttccgattctgagttttactcagatgttactaggcccacagtagttcttggttagagccttccctgctggactttagagcccagtggctctgatatcatgaatctgtcccattctgccctgtccgttagggtagaagttcacactacatgttctcattcctagcccagagaaatttaagctgatctttctgacactgactaagaatttctctagtgtaagtctccatgacaactctgtgcccttgtctttcaacatgtttgcactcctaaatctagcctctggcatcctataggtaacagataccagctgacctgaaatttacccactctgggtttatggttgacctatactgacaatgtgcttgcctcttataaaccatctatacagaggggttcttctaactccaggctctgaaatcctcccaaccccagcccccatttctttgtcagttttctttcctgatctattttataacacaactagcagcagctgtctgatatggctggctggctagctctaacattcagtaaggtgcagcttcatatcttttcattctcatggttaacgcagctcagccacagccaaaaggcagagttctaatgttctatttcccatgatttcttggaagactaaaagactgattaattacttgcggtgattttttgagacaggaggtaagttagtattctctataatggtagaaccaagagagaatgactgcccatgagcctttagaaatgacagctaaatccagggtgggtaggtggggataaataaataaggataaggttgtcagggggaaatgttgctactagaaaaatattactgctgcttctgaaagtctataaattcagacagtgtctgcttttggccctgatttttttatgctgcctcatcactcaggagagagcttatagtggccatgtcttcaaagatcaagagggagaaaagtagagctatggaccttgtatatggaccccacatggatatggggcctcctgctttggaatactgcaccaaatactgcatacaaatacacaatactgcattatggactgtgggatgagtgtaaggattctgctgtgtattcccaacttgcttgcctcatgcttggcaacacaatataatagtactgagtggcagcttcagattatctagacatgaataaatctcttttactgtgtacaatttggcaagtttcttaacttagtttattcatccataaaatgggcattatatatattacttcatatagggcttcatgaggaataaatagaataatgtccataatgttcttgataccatgctgtgttcatactaggcactataaaatattagtaattattatcttagctgatgtacatctcagagaactttcaaaaaattaactacagtagtgaatctagacagtgatatccattgactgtacctttttagataaccgttttaatatataacaaaagctttccttactcacctccacttaactgaattgatgggttaacttgatgcttgccttccttctgaaatacacatgctgactaatgcttgggatacactggacgctcaagggcagtttacctgcttctattggctccttatacttccacttctacacacagaacttaattactaccaagaaatacttgtgttccttccaaatccattctgctagttataattaagcaccaggatatacacttgtgaagtatgaaaccatagaacaactgtctccatgaaacctgagttcagggtttcgaaagacttgataaagaaagtttccttaaacccagctctactgctcaaagaaagcagaagctggaaatcaaatggacatacagttgggctataacttattggggaacacacctgtgaaatttacatataagaaaaagcattacagcctaaggccagactgtgtgaattagtgagcttgaatgttttagggccctttgcaccacttttatcaagtggtgcactttgatattctttgcccactgtcttgagaagctcttttgacacctccagacctgctatgttctcttcaatcagcctttgagcctcaatgcacttgtcatcatcttccccaaattctcatcatctggttcttctcccactccctccaagtcacagcttaacaatggtccttctctgtattaggccttccttgataacaccctcttaaacccatagcccctagcaccatgtgtttctttgtaacactaactgatctgtcaattacttgaattctttttgtctccttctagataaaagttgtattctcattggaagtggatttatgactcaaaataatgaatggaattttagcctcagcttcctaaattgtctgtctctgccattgtgagctcagggaaggcagaagtgttctctgtcaattcactgatgcaatattatcagcgcctacctcatagcataaatcaaacctaatatctaaaatacctttggcatctttgttgtatccagacaaaataggtcttattagtcatcaattattattattattgtatattatattgtatatatagtacaatatacagtatggtatattgtataatataataaaaaatatattattgtagatgagtatggaagtacattgcttagtagttcctcaaacttaaatgtgaaacagaaccactgagagtgtttgctaaaataactggttctcaaacctaagcccagttttgattcttccagtgcagaatgtcatctaggaatccacattttgagatgtgccttcgggctactcagaccctgattgtctaagaatcactccccacccacacacacacacacacacacacacacacacacacacacacacatccagaaaggctaatatgaatttgagtgaaatgtctacagtggcctgcatatatactatctaccagacagtcttactattagtaaggcactgatccaatcaaaggggctttatagaaaggcatcattttctaatttaaaactatgtaatagaatacaaagaaggaagtgttatgagcccttcaagtaagagaggtactttactcgaagtcacatggcttctaagtggtaacactcatcatatttacctccaaagaccacactccttgccttcgtccaggttacccgccttcaggaaatttcctccattgtagacttgtgggtccttggaaggtttaatgcacacttaccacttggttatgcttggttttcttctttcagaagaaaaaaaaaagcatattctttcagaccttctcaaattccatataattctcatctagggaagagaaaagaaaactactgaacctttgggcttacttggcccttcttcaaaacaagaaaaaccatagtaagagacaggttttattcttttttctttcattttttttccttttttttaattcggtattttcttcatttacatttccaatgctatctcaaaagtctcacatgcccttccccccactctcatcccccctccctactaccacttcttggccctggagatccattgtacttaggcatataaagtttacaagaccaataggcctctctttacactgatggccgactaggccatcttttgatacatatgcagctagagtcaagagctccggggtattggttagttcatattgttgttcctcctatagggttgcagatccctttagttccttgggtactttctctagctcctccattgggggccctgtgatccatccaatagctggctgtgagcatccacttctgtgtttgctaggtcccagcctagtctcacaagagacagctatatcagggtcctttcagcaaaatcttgctagtgtatgcaatggtgtcagcatttggaggctgattatgggatggatccctgggtatggcagtctctagatggtccatccttttgtctcagctccaaactttgtctctggaactccttccatgggtgttttgttccaaattctaagaaggggcaaagtgtccacactttggtctttgttcttcttgagtttcatgtgttttgcaaattgtatcttatatcttgggtattctaagtttctgggctaatatccacttatcagtgagtacatatcatgtgagttcctttgtgattgggttacttcactcaggatgataccctccaggtccatccattagcctaggaatttcataaattcatttttttatagctgagtagtattccattgtgtaaatgtacaaattttctgtatccattcttctgttgaggggcatctgggttctttgcagcttctggctattataaataaggctgctatgaacatagtggagcatgtgtctttcttaccagtttgaacatcttctggatatatgcccaggagaggtattgtgggatcctctggtagtactatgtccaattttctgaggaacctccagactgatttccagaggggttgtacaagcttgcaaacccaccaacaatggaggagtgttcctctttccccacatcctcgccagcatctgctgtcacctgaatttttgatcttagccattctgactggtgtgaggtggaatctcagggttgttttgatttgcatttccgtgatgattaaggatgctgaacattttttcaggttcttctcagccattcattattcctcaagtgagaattctttgtttagctctgagccccatttttaatggggttatttgattttctggggtccaccttcttgagttcttcatatatattggatattagtcccttatctgatttaggatagttaaagaccctttcccaatctgttggtggcctttttgtcttattgacagtgtcttttgccttatagaagctttgcaattttatgaggtcccatttgtcgattctcaatcttacagcccaagccactgctgttctattcaggagtttttcccctgtgcccatatcttcgaggcttttccccactttctcctctataagtttcagtgtctctggttttatgtggagatcttgatcatcttgttaggtgctgagaaaacatttgacaaaatccaacaaccattcatgataaaaagtcttggaaagatcaggaattcaaggcccatacctaaacatgataaaagcaatctacagcaaaccagtagccaaaatcaaaggaaatggtgagaagctggaagcaatcccactaaaatcagggactagacaaggctgcccactttctccctacctattcaacattgtacttgaagtcctagccagagcaattcgacaacaaaaggagatcaaggggatacaaattggaaaggaagaagtcaaaatatcactttttgcagatgatatgatagtatatataagtgaccctaaaaattccaccagagaactcctaatcctgataaacagcttcaattaagtagctggatataaaattaagtcaaacaagtcaatggccttttgtacacaaaggataaacaggctgagaaagaaattagggaaacaacacccttctcaatagtcacaaataatataaaataccttggtgtgactctaacttaggaagtgaaagatctgtatgataagaacttcaagtctctgaagaaagaaattaaagaagatctcagaagatggaaagatctcccatgctcatggattggcaggatcaatgtaataaaaatggctatcttgccaaaagctatctacagattcaatacaatccccatcaaaatcccaagtcaattcttcaatgaattagaaaaagcaatctgcaaattcatctgaaataacaaaaaacctaggatagcaaaagctcatctcaaggataaaagaacctctggtgcaatcaccatgcccaacctaaagatgtactacagagcaattgtgataaaaactgcatggtactggtatagcaacagacaaatagaccaatggaatagaactgaagacccagaaatgaacccacacacctatggtcacttgatcttcgacaagggagctaaaaccctccagtggaagaaagacagcattttcaacaaatggtactggcacaactggtggttatcatgtagaagaatgcgaattgatccattcctatctccttgtactaaggtcaaatctaagtggattaaggaactccacataagaccaaagacaagttttattctgatggtcaagtgctctcttggaaactatgacctgaatctgagttatagatttagtgcatgatggatacatgagcactatgaaacaaaaaatactttagtggatgaaatgtgtatggagagcagagaggaatgtgtaaacaaggtcatcaaggagtcctgtccatagccattgagtaacctctcttcatgcttgccctttcctatacacttgatgttggaatttccattaacctgatttgaataaaaccagaagcagcatgacatgaagtgtaaagtttttcaagtgctagatatgatgacagatgtctgtaatggcaacactctcagtgctgaggaaggagaatcaagagtttaaggccagtcacagatacattgcaagttccaatgtagtgaaactcaaagcaaacaaaagtacttcactgaatagaagaggtgattggatgatagagcttcctcttgtacccacctctggcttctaccttctgctgcagagcaatattctggctgacaatcatcatgatatttaagtaatatgtttggaaataaaagccaggggcagactcaccaaaggtcattagattttttgccagataggatttaagataaagataacaaatagaaggttgcctgcccactccacccatgactgtggctagctaccacagagcaaaaatcatgaggccaaaaattggacactctgggaaagaatgccagaattgactagtgatgcctgccatgatcatgaaggctgactatattttcaacattcttgctccaagccaatagttcgaaagtctgattgcacacagaattacagggaacattttttaaaaaatactaatacctggggtctggttcagataaatgaagttctctagaggtaagttctatgtactatagcaaccagaaatgctgctgctctgcatgattacagatttacagatgattgaattctgtagtttcaaatggcattctattctctcctaccaggacttactacattacaaccatctgagcttgtaaaatcatgaattctttgcactaactcctcaaacttttttatttatttgtttattttattagatattttcttcaattacatttcaaatgctattccgaaagtcccctataccctcctcctgccctgctcccctacccattcactcccacttcttggccctggtgttcccctgtactggggcatatgaagtttgcaagacctaggggcctctcttcccaatgatggccaactaggccatcttctgctacatatgcagctagagacacagctcttggggtactggttacttcatattgttgttccacctatagggttgcagatcccttcagctccttgggtactttctctagctcctctgtcgggggccctgtgctccatcctatagatgactgtgagcgtccacttctgtgtttgccaggcactggcatagatttgtaactataggggaaaggcccaagaatctgcgggtttaaaagccagactcagaaagacatacatttaatgttttctctcagacgatagtatctagatttaagtaagtgtatgtgtgtgtgtgtgtgtgtgtgtgtgtgagagagagagagagagagagagagagagagagagagagagaatcatgatagcataagcatgacaagttagaagaggaagggatctaatgaagagaaaggggaataaaagagaggggtaatgggtacataaatgctagcagaatagatatgtgtgtgtgtgttctagtgagacgcatcatttttacaatgaatatacactaattaatttttttatttttttaaaattttttaattaagtattttcttcatttacatttccaatgctatcccaaaagtcccccagaccctcgccccccactcccctacccacccactcccacttcttggccctggtggttcccctgtactgaggcatataaagtttgcacgaccaatgggcctctctttccactgatggctgactaggccattttctgatacatatgcagctagagacacaagctccggggggtactggttagatcatattgttgttccacctatagggttgcagatccctttagctccttgggtactttctctagctcctccattgggggccctgtgatccatccaaaagctgactgtgagcatccacttctgtgtttgctaggccctggcatagtctcacaagagacagctatatcagggtcctttcagcaaaatcttgctagtgtatgcaatggtgtcagcgtttggaggctgattatgggatggatccccagatatggcagcctctagatggtccatcctttcgtctcagctccaaactttgtctctggaactccttccatgggtgttttgttccaaattccaagaaggggcaaagtgttcacactttggtctttgttcttcttgagtttcatgtgttttgcaaattgtatcttatatcttgggtattctaagtttctaggctaacatccacttatcagtgagtacatattgtgtgagttcctttgtgatgggttacctcactcaggatgatgccctccaggtccatccatttgcctaggaatttcataaattcattctttttaatagctgagtagtactccattgtgtaaatgtaccacattttctgtatccattcttctgttgaggggcatctgggttctttccagcttctggctattataaataaggctgctatgaacatagtggagcatgtgtctttcttaccagttcgaacatcttctggatatatgcccaggagaggtattgcaggatcctctggtagtactatgtccagttttctgaggaaccaccagactgatttccagagtggttgtactcacagtatgatgctctttggagctttcatcttatcagaaatgatgcccttggtttgattcccagcacacacacacacacacacacacacacacacaaaggtggggagaagctagagacaatccaatgggtaaagaaagtacttactatgaaagcataaggaccagagttccaaacaaatcccagatgattgtggtggcccatcttgtaaaacagaggctggggagtcccagagctgggagactagccatatcagtgagctctgggttggagtaagagatgctacctgtgttttgcaaattgtatcttcagtattctgagcttctgggctaatatccacttatcagtgagtgcatatcatgtgtgttcttttgtttttgtttgtttgtttgtttgtttttatcctttttattttttgttattttatttacacttcaaatgttatgccctttactagtttcccctccaaaaatcccctatcctccttccctccctctgctccccaacccacccactccagcttcctggcccaggtagtcccctgtattggggcatagaacctttacaggaccaaggccatcttttcccattgatgactgactaggccatcctctgctacatatgcagctagagccacgagtccctccatgtgttttctttggttgttggtttagtcccagggagctctggggttactggttagtacatattgttgttcctcctatggggctgcaaaccccttcagctccttgggtcctttcccaagctcctccattgggggacctgttttccttcccatggacggctgtgagcatccacttctgtatctgccaggcactggcagagcctctcaggagacagctatatcacacttaagagccttgaagatatgggcaaaggggggaaattcctggacaaaacaccaacagcttgtgctgtaagatcaagaatcgacaaatgggacctcataaaattacaaagattctgtaatgcaaaagacactgtcaattagacaaaaaggccaccaacagattgggaaaggatctttactgaagggaaggctatccagagactgccccaccttgggatccatcccatatacaatcaccaaaccctgacacaagagctccctgtgactaaaccaccaaccaaagagtatacatggagggactcatggctctagctgcatttgtagcagaggatggcctagtcagtcatcaatgggaggagaggcccttgtgaaggttctatgccccagtataggggaatgccagggccaggaagccagagtgggtgggttggggagcaggaggagggaggaagggataggggattttcggaggggaaactaggaacgaggataacatttgaaatgtaaataaagaaaatatctaataaaaaaaaagagagaaagatgtgccaggcagtggtgggtgcatgcctttaatcccagcacttgggatgcagaggcaggtggatttctgagttcagggccagcctggtctacagagtgagttccaggacagatagggctacacagagaaaccctgtcttaaaaaaccagagggggggggggaagactacctgaatggatgagttataagagaaaatgagaactcttcccaacatcatcttcagtgttccatatattcatgtacacatggttgcacacacatacagaaaagggaaatacagaattactgttttaagctatttgtgatattttagatgaattaatggatttttgagctgctccttgtgctctggggcactgcattgcaatcctgcctgcatattagaacctcctgggaaacattaaaaataaaatcagtgcttagcttcaatgctagtccaattaaatcaaaatctccaaaggagaatctataatactccagttaaaactgagaatcgctgttctgtgtagtgggacacaggggctctcttcgaagggccttgctggaatggcttcatttctctctctgtgggtttggtttctgagtcagtcaagacatgttggcttgatactagcatctagccacattctatttaccaaaccaggtttcatactagactcttatcattagtgactgtttggggtagagttttggggtttttcctggacttggtaaacatttgctaaaatgattcatccatctgtgggacaatatagagaagatattactggggattaaaccaaagccttatgccagctaagaacccacttcactaatcttacctccaggccttcatacatttctttttcattttattttgtttagttttgtgtgtatatatgttattcctgcatgcatgtctgtataccacatatgtgcctggtacccaaggaagacagcagagggtgtcagataccctggaactggtcttgcagatggtcatgagccatcatgtgggttctgggaatcaaacttaggttccctggaagaacagccagtgctctaaacttctaggccatctctcctgccccattcccccatccccatgcccacatccagcaattcattgcttaaagcacatagttactgaatgtatcagtgtttgttaaatttaaacagtccaatatcttctgcttgcataaagaagggtttattttttccacaaaactgtagggccaccaacatttcattctgtaaagaaaaatgaaatcacaaaatttacaaaaaagaaaaaaacaaagaaaaaaaccagctggacttataatctataatatggatcatggatggtaatgttgacagaaagcaagaagatttacctcttcttcccaacatatttttgtaatgttgtagttgctgttgctgttattatttgagtaattagttgttgttggtagtggagatggttggttcattgattggttggttgactggttgatggttattttcacatttttctcggcaaggtctcaatatgtagaccacgttggccttgaactcactatatagtctggcctcaaaatcttagtgatcaatcaacctgagcttctcaggtattggaattaaaagtattcacctccatgcccagctctcaaaacacattcctgaaggttacactcattttctaacttacacttgaatttctaccattagcaataaatgtatttgatttacatattttgtctttgactgactggctttcaatataaaaagaaagaacacattaagctgcaaatgcttccagtcctttggaaagtaaccgtgagcacaacttagtagaggaataattgagaacaatagcttgaggtcaatatggaaacatacctagaatgtcataagaactgagtggggatggaggcaaggttccctgaagtagacaaactgatttgtctaagaaagctgagcttctttgcatgggtacttgttctgggtcacatagttgaaagacaggacacacattcatgatatgtagcccttaggttttactttagccacccattcttggtagtagagaaaacggaagccaacaaaactacactaccatagaactgtcaaagagcttttggatcttcacttggacccactcaaatgaaactatgcttccagatttctcagggcaggggagagcaccaattggccttataaacatatctatttcctttacggggcccaacaagctccttgctgatgcaatgctatcagtgtacactaaaaacacagcattgtgtttttgccaggagtcagctacccagtgagtaatgtgttcctatacatttatactgagagtggaatagtctaggatgtgtttatcactgagaaaagctagtattaacattgtcaggggattaatccagtttaattgtaaatggcaagaagaaacctgcttctttgggggcccagatgtatgactttagttaaatatttatagattagttggaatgtttactcttaatcctggagctaggtatttacttgcatattctaacccatttctggccctatccaacatcctcctgatgtttttctctctaaaatactggtatgttacgagaggagtgatggaaacatctggtcactggtctaaagctactgatgctggtgggagatggtaacaagccaaggaagctcccattaaaattagtgggaacttcaaaatcaggaaacctgtattctaatctcaactctgctacaaataagctctgtaaccatctctaagcctcagtttcctcatcatgaaattaaagagataaagttgcgtttttaagatttcttatagatatgagacatggcagtttatggatgcctaagacatttcagaatccatatccacaaaaggaataatccttaaagcatctagacaatcaccatacagtatagatttctgcaatgaagctaatggtctagattcacgatgtcctgcacagtagtctcttgccactattattgaacactctaggattatggttaggattagggctagggttagggttaggtttagggctagggctagggttagggttagggttagggttagggttagggttagggtgagggtgagggtgagggtgagggtgagggtgagggtgagggttagggttagggtgagataaaaggttaaggaattgaattgaaaatcatgttattccattatactatgtagggccacacaatgttaaatggttagttcccggaggaaggatgtagtcaatgttaatgatggcttctaatttgggtaagggttatttagtagaaactacttgggtatgattactttctccaacatggaaggtaggataaaaatctcataatctagatgcattgagatttttttatttttaaatatttatttattcatgtatttctttaattagttttaaccatttctcacattgcagtcattatccctctcccggtccaccctcccatagtttcttataccattcctcctcccctgtctccaagatgtttccatcccacccctccaaacctccccactctgtggtgccttaagtctctcaagggttaagtgcatcttccctcactgagaacacaccaggcagtcctctgctatatatgtgttgggggcctcatatcagttagtgtatgctgtctggttggtggcttagtgtctgagagatcttgggggtccaaattaattgaaactgctggtcctcctacagggtcatgctcctcctcagcttcttccagctttcccctaattcaacaacagaggtcagctgcttctgtccattggttgggtgcaaatacctgtatctgactctttcagctgtttgttgagtcattcggagggtagtcatgataggtccctttttgtgagtgctccatagcctcagtaatagtgtcagaccttggggcctccccttgagcaagatcccactttgggcctgttgctggaccttcttttcctcaggcacctctccatttccatccctgtaattctttcagacaggaacaattatgaatcagagatgtgaccatgggatggcaactccatccctcacttgatgccctatctttcttctggaggtggactctacaagttccctctccccactgttgggtatttcatctaagatcaccccctctgagtcctgagagtctctcacctctcagttctctggtacattctagagggactccccaccttctgaggttagctgtttctattcattctgctggccctcagagcttcactcctgttccctgcccccaatacctgatcatgtttccctttcccctcccccttccacccaggtccctccttccctctgcctaccactgtgactgctttcttctccctcccaagtgggattgaagcatcttcacttgagcccttcagcttgttaaccattttgagctctgtggattgcatcctgggtattctgtaattttggctaatatccacttattagtgagtacataccatgcatgtcttttgagtctgagttacatcattcaggatgatatttcctagttctatccatttgcctgcaaaagtcagaatgtccttgttcttaatagctgagtagtattacattgtgtaaatgaaccacattttctgtatccattcttttgttgtgggatatccaggttgtttccatctcctggctatcatatataaggctgatatgaagatagtggagcacatgcccctgtggtatggtggagcatatcttgggtatatgcccaagagtgttatagctgggtctgcaggtggatctatttccaatttcctgaggaacatcaagattgatttgcagagtggttgtacaagcttgcaatcccaccaacaatggaggagtgttcctctctctccacatccttgccagcatctgctgtcacctgagtctttgatcttatccattgtgattggtgtaaggtggaatctcagggtcatttttacttgcgtttccatgatcactaaggactttgaacatttctttgggtatttcagccattcaagatttctgttgtaaattctctatttagttttatacctcattcttttgagtgggttgtttgagttttttcttttttcctttttaattggatgttttctttattaacatttatttagagaagcattttatttgattagtagtcatcaaatgcagtccaaatgactctttaaattaatttaggtttaggtttgagcctgcaattattgcttgaaagatgtgatctaagtatatctacacagttccgtgaatttggggttaaagatttaaatgcccagtaactaaaactagttctgtatatatgagctgcatcattgttatacaaaactttggacatgaatatgctcagtgctgatctttattagactgaatcagggacgtattttatgaaataaaaatttattaaatgttagtgctagaattgatgaggaattatttattgctagtggttttctttaataatttgtggtatattttctttatttacatttcaaatattatgccctttcctggttccccctcccctggaagtcccctattccctcccccctcctcctgctccccaacccacctactcctgcttcctggccctggcattcccctacactggggcatcgagccttcacaggaccaaggacctctcattgatgtctgacaaggccatcttctgctacatatgctgctggagccatgggttcctccatgtgtactctttgattggtggtttagtccctgggagctctggggtattggctggttcatattgttgttcttcctatggtgtcctattgactatgtactttgccttaccaaagcttttcaatttcatgtggtcccttttatcatcatagcatctttaaacatcttcatttcttccttttcaatcttatttgcctttatttcttccttgcatcattgcactggttgagacctccagtgaaatagcaacctggaatcattcttaactcttgagatttttcaagattcacagagcccaagttattaattccactaaaaagaagaaactcgttgttgaactaatgtttctctttttttcctatcataaatataaagacagttttaatcacgttgggttaagctacaaaaccagcatcactgtagggcatttggggacatatacagcaaaatcaacttccatcaccccaaattaattaaaccttcttcaaacaaaaaggcttgtttgcctaatttgcaaaatgtttcttttccttttaatagcttattgacctatatctttattcattgaccacataaagttattaatctatctgaaacaataggtgacaggtccctattacaccactcattgagttgaaaatcagttttgtaccagcacctacatgttcttctttgacgtagccaagagattctactataggttttagagttcacagcattcatgggtaaggtttggagtgtaggaaaaaaaatacttgtgtccagttccataaactcgattaacctgttgatttgtttaataattacatcgaaagctaatatttgacttattttctcatgagtaggacttgaatattttgtagacattggtgttctgtgccacctgattagaaggaagatatagcaccccattcattgaatcaattcagtctagcttagcaaggtctactgttagaatataggtctggttaataaatacaatctttgctcttattcttagaaaattcctgaatgtgtgcctttgttagggtttctcttcttctcttttttccttgtacttatctctgaaactcttaatagagtttattctataccaagattgtgtttaataactatgataacactgaaagcattttcagactgtttctaaaatcttattcttcacaatttcactagagaagagaggaacatattctactgttcccttacaacaagaacctagaagtctttgctactagttgttttggttggcttgatagcctaaaatttaattccaaaatgattctttagattcagtgttaaatggtttgtaagatgaaaaccactattatccattaaataatataattattagaaatgaacaatcaggagaagggtatatttgtgctccatggcattatcattttcctaccagctgcatctcatctgcttcagagcgaacagtcaatgcttctgtttagaaaacatgtttacatcttaaagtttctcctgctaatcaacattccgatgaagatgtattaggaaggcttcctagtagtgacctttcttttcttctttttttcttttgtcctccatctccccctcttccctctctcccatactccctcctccctccttccctccctccatccatccatccatccatccatccatccctctccctctttcttttttctttctttctttctttctttctttctttctttctttctttctttctttctttctctctctctctctttatttctttctttttctttcttttattttttttacactccagactttattcctctcccagtccactcttccatatcccatacctcctccgtgcccatgtgtctccacaaggatgtccccaccccacccaaaaccacctgacctctaaactccctagggcatccagtctcttgagggttaagttgcatcatctctgaatgaacacagacccagaagttctctactatatgtgtgttgggggcctcatatcagctggtatatgctccctgtttggaggtccagtgtttgagagatttcagggatccagattaattgagacttctggtcctcctacagggtgtccttctcctcaacttctttcagccttccctaattcaacaacaggggtcagctgcttctgtccattggttgggtgtccattggttggtctccccaacctcctacctcccaaggttgcctgtttccattctttctgctggccctcagcccaaagcccaagtctaagggggtcaatggcctcaacataaaaccagatacactgaatctaatagaagagaaagtgggaaagagctatgaactcttggcacagggaggaataatcaggacttcattggctcaggctctaagatcaagaattaataaatgggacctcatgaaactggaaagcttctgtaaggcaatgaacttagtcaataagacaaattggcaacctacagattgggggaaacctcttcactaacccaacaaccaaatagagggctagtatctaaaatatgtaaataaaccaaacaaaaatggggtatagatctaaatcaagaattcacaacagaagaatcttgaatagcagagaaatacttaaagaaatgttcaaagtccttagtgatcagaaaaatgcaaatcaaaacgagactctaccttacaccaatcacaatggataagatcaaagactcaggtgacagcagatgctggcaaggatgtggagagagaggaacactcctccattgttggtgggaatgcaaactggtacaaccactctggaaatcaatctggatgttcctcaggaaattggaaatagatctacctgcagacccagctataacactcttggacatatacccaaaagatgctccaccataccacaggggcatgtgctccactatgttcatatcagccctatatgtgatagccaggagatggaaacaacctagatatcccacaacagaagaaaggatacagaaaatgtggttcatttacacaatggaatactactcagctattgggaatgaagacattctgagttttgcaggcaaatagacagaactagaaaatatcatccttagtgtggtaactcagatccaaaaggacttgcatggtatatactcactaataagtgaaaattagtcaaaaatatagaatacccaagatacagtccacagaactcaaaaagatcaacaagctagtctcacttctagactttgaattaaagcttttcctatagaatctacatacaaaagtgagccttccaaatcttaacttcataaaaaatgtgatatttgtctccaaattgctgagggaatctgaatgaaaagatcttctgtttgatctggagggagggagggggagggtttctgggaggggtggaaggaggagaaactgcagttgggttgtaatatgaggaataaagaaaaaatgaaaactaaaataataaaacatctgggattaagtctctgtcaacactacccctccccttttattttcctaacattttacctcaaatcatgcaactgtgaaatagtttcagagtctacagtttcactcatatagaaaatcataattggagaatatattattagtttggtccttctgtaattcagactcaaaggagggtgtgtgtgtgtgtgtgtgtgtgtgtgtgtgtgtgtgtttgctaagtcagcttatcttaaagtagtaacaataactaaatcaccactgagaggcttagaactcagtagttactgggtccttgaggttggatatcccagtttctaagtagtcccaatttggcactgaacatctggatttttcttgaagaactcctgtaataggctaagtgaactctaaggcaaaggagcagcagaccaagtgagcaaaaacataccctcttttacctggaccactaccagaaagtctcacctacaatcagcatgggtcttccagcatcaattaaggcagtcaggacagtttttcaggtgatgctccctactcagggattctgacttatgacaagttgaaatgaaaacaagcagcaatagcaaaggatgtgtttatttggcttatacttctctatcacagtctgtcattgaaggaaactgaggcaggagttctggacaggaacctggaggtaagaatttaagcagagattatgggagaattctgctgactaagttgctcagctccccttaaacaagtcaggaccaactgcacagtggtggaactgttcataatggactgggccctcccctaccattcattacccattgtccacaggccagtctgatggaggcaattcttcaattgtggttccctgttcccaggaaacactagaactaatttgcacttcttatttcactaaatacatatcttcagattggtcctcaatttaagctgaattaaaaattaattttaaaatgaaactattttgtcaatgtaaaatagaattatagcaatcaactaggaaaaaattatcttgtactaattcaagttaaatatggtttggccctctcagaaaacttacagttatatatttattacaacccttgttttcaaataaggaagctgagattcaaagaaggatgggcttgcttatgctcacataaagttggccaaatctctgatttcactggatagcatgcgtaaagaataccccactctcctctgcttctatcttctgatgacttcatagtagccaggactctgatagtgaggattaattactaattttctatcaaggttttgacatttaccctacttttatagattgttcaaagtctgtatgtttatattacaggtattttgcctatagatgatttttatcataagaaactgggtttccagggaggccaaatatgctggctgacaggtataatgaacgaacattagcaagcagactcaaggtttgttaacaggttatgttgtaagaaccaagagagaactgaaaatcagactcaagactcatagacttaggatatggacaaaattaagggaaagagaagagacaggagcatctgaatgctgtgttgcatccagcgggcctttgggaggacaagccaagtatgtttttctacttagaatcttaagtgaatctcatttctccctctcaggctctcccatcttcccctcctccatccaggccttccctttaggaaattctgctttgctttttagaattactagagtgataaaccctagccactaccaggtccttctagattatgtagatcctctccttggtccaattcacacagcaggtcattagaacagagagaactggtcaactttcttcaggaagtaggatcccctccattcaagagtgctattctttttttttctctctctctctctttttctcagtggaacttagtgatttgactaatcagcaaagctgatactgagagctctttgtaagtatgcagcttctatgttaggcttccctagcatatctagagaagaatttctacaaattttggccaaaattttctcctcccaaggcaccattttccagtgtggctttaaaaaaatactagagttaggaattccagatttgcctagatataacaaagtaaacaaaatgctttacctcactgctgggatcctccgagcttaactttccctccagtcttcttacctctccagtccagcatgacaaccctggcatataccaatctctgaagcgtcttccattctacacagctctcccagataaaaagagcttaccagcatatatgtattcacagtgcccactggtgttaccacaactgctgttacaagatttataaaagtctgtgaactgtgtaatgtgaggatccaaacaaaacttttcttccttaagaagggctcattattcttcttgtatatcagcaaattgatttctactatattagcactagaactgtaaaaacagtctcctggaatcttgcagctatccaggacctcttttgttgagactttacttagctacatcagagaatactgaaagtgatttgccttaaatttaagtgtgagactaagattacagacacccaccaaagtcttagtgatagtttgttgctacctggagtttttgtggtattattttttttttagggagagttatatatgatcagaaaaattatccataaaaaattggggtatatccctgggagcaaattaagcaacttatagacagtggaaaatgttctatgaggaaatgactcagagatccaggtagtcttcaaacagccaagaaatagtttgtgtcatctctgcttatctgtattttatgaggcaggaatgttgcctctagctatttggaagaacttttttttaaataaatgttttcccccttaggctttagtggatcaaacaattctgtaaatgtctatagtctattctccaagagtcctcattagatttgttataatctccaataactgccttgagcaaataaatgacagggcccacagaaactcacaaatcatagaacaacactcccaatgggctgagagggggcttagtgatctatcccagcctgacctggactcaactggcaagggtgcatcattgttatctgttcttcctagactctacatgaaaatcactgaaaggtctcaacactgatgataggaatccaggattttcatttcaacaatagttcttaaacatctggttaggttctagggaatgcaaagatgattcaggcatagtacttccttttgggtaggtaactactgggtaacaggagcccaggagattaatcatcacaattcagaaacgtaaatgttattatcaagttgcaaacagtgcaatgtttggatccctagcacagacaaaaaaaaaaaaaaggagtagtgttatgtgcatgtgtttgttgacataacagtgacaacagataaaagatgattcttttgttcatgaccattttgttgttgtgggataatgtcagatttatttaaactagaaagaagtagaaataattagctattcatgaacatcatagaatattcatgtaaaatattgtggtcataaaatttcaaacttgaactttaatttactgttaccattcttttgtctcttctactatgaaggaaagtacatgatgacagggaacttggtcagtttcattaactattgtagctacagagcctggacctgagccagtaaatgtgaaataaagatttattgactagatgaataaattaaatatagacaaattatggtaacactaagattggagaccatagcatgagaatctgaaattgtttagggcattggggtaattgtccctgaggaagatacactggagcaaacataaggttaacgtgaggagtgcgctaatgcaggagttttatcctgcgggcaactgaggagatttttgttgtgaagtgatttaccttcccagaatatatagttggagtgttaaggagccagttcaaagtggaatttttttttcaagtgatattctcagtctactagttgtacctaaatctttaggtttaaaaccaaggaagaaaagttctcttctcatctcagatcccctttccccaagtaggattctgggtagaccaaactccctttagggtagaagctctgctcaggaggcctttccttcttggtttgcctgacaagagatgagctcaccctctagagtgagaatccactaaacagtgtagcctgggctctggacaatgaaagaaaggacaatagccaactcctctgcaatttgctgattctcacaccccagggtgtgggactgtacagccagggctgctttgctctggctctcatcaaggcaggatgaacacagatcctgacaggtcaaatcttcccccggacctcagaggttgccttacaaaggacctggcttaatctctgaccaagtgtgtaattcattcatctgctaggtcatgaattctgagctctcaaggcaggaagtatgggcattgggaggggttctacaggtccagggagtcacttcagccctgattatactatagaggaaaggattttctagacaaaggctcctgtcctccagagagtgagcagaatgaactaggagactatgtgcacaaaagaatggtgcttcagggaaagggtgacagcccatgaatttctttagatcctgtaagtaatgacaagggagttagaattaattatttttataaactgtagccatgaggaattgagatagatagagttcatctcaggatgtttgcctgatgctcacccaccacttggtagtaaagggaagtttttaaacactacgttatttcctcctactggatccctctcaaagttgttggaagttcttaatctttgtagctaccaaagctcctttagcatccaaaagactaagtaaaatgcagtgctacacatcgagaaaatacttgaaagctaatttgaaattgtttggaaatttacaatttcctgacctgaccagctggctttttctctgatcctctggacttcctgccaaacaaagatgggaagggatcgacttttctttctatgatcctgaagtttcatttgcacaattttccagtcttggggtcgtgacccatcacagtaaatctagcttcaaacatagagttatttggattttgagatattgtatttcgagtttcatgtcttgcaaaccacctggaacttacaataaagggtattttaaccacggattgtattttatacaactgcaggctcctggaaaggaggaggcaaatgttatgggaggcaagcagcaacagagagaaatttgactaataggactacagagttttctctgacctcagagagacactttgaaggtctcttggtgtggtaagaaattcctgatgccatatttacctttttttttttgactcttcattttttggaatgtgatgtgcagtgtataagaaaacagcaagcccagctctcccccagatcctgttagtgcctacactgataattctctatcactccagcaaaggtctccattatggtttttcagccattatctgcaatgaggttatgcactaaatacattatcagtcattaatactttcccctgaaatacatttgtcaaattagtctcaacagaaaactgagacccctggagaaacagactagaaggacaaagttctatgaggtgacagaacaggattttgcttggacttttactctttgacacctggtttctagatcatcagtattacttcatgggagttcgttcaccctgccagccaatagctttataattggaagaaacatgggaggagtccattccattgcattgcaagcagcttattgctttgtctccattcagggagtctttgtcaaacactaattcaagctctgtggtaggtcctataaaggatatggaaagtatttctacagtcttcctttaatgagcgtgatgcctccctccattctttcccacacttttcagctgacctatccctctttacaagtttctaatgttctgctccttttctctctgggaaaaacctatatttattctgattccctactcttctgtaccaggccacacagagacagtatctaatctttcatcttacccggcactccacacgtatgctttctagttgtgggagataagtctgtaaaacatgcaaagaacacagttaagtttggtgacaagtactgtagagaaaggcttgcactgggtgtttcagatgggacagtccagttgggcttttgaataaaggtaggaatttgcctaaaaccttaaaaaatgagtatatttttagtgtgtacagaagagaatgacttcatacacagcacacaaaccttgttttagacctgagaaggaacctgtaatatgtatggaggactcaaataagagataagggtaaaggctagagagggctcagcagttaggagctctggctatattttgtgaggactgaattcaattacagcacccataatgactgttcactatcatctgtaactccacctccagggaggaatctaacaccctctcctggcctccctgggagccagagagccaggcacacaagtgatgagcagacacacacacatcacccatacacataaaataaatttaaatttttataagaaaaaagaatagaaaaagatagcttcattaccagagagtgaagagcagaggacttttcatttgaccctttgtaatagtagtctcaaaatatttgtgtcaaaagtgagcatgccccaattatatatataatacttatactaatatattaatatattataaaactagtaaattataaaacatacacaaaagttatgccaccaccttaggtcatcagttaaatatatggtaccatgaattcttttgagagtctggtgaaagctacatatctcctttcctgtcaccaaaaatcatgcattgatgccctacttcttcatacagtcttcagggaggccgtggagtctctgaagcccattttaaaacctcagtgtaatttgctctgaatacacaaaggcaccagaggtttctgagtagtttgctggcctgtacactttacttccaggaactctgaatctggcctctatgcatgaagtgagttgacaacagtgcgggataacagaagcagaaactagaaacaagaagacacatttgtaaactatttccatgcctcatgccagaagtgcagatgtaatgacaggaagtatgtctgaggcctcaagttttatgtaggaaaaagaagagcaatgagtattcaggattataaactggttcaagggacagtctcccatctcagtaaaaatggtctgcaggcaatgagaaatcggaggataaaattaaagggaataattggctttgaaactcagtttgggaactgggagtagggcagttatgagaaggaataaccacagtaggcattttgttgccaggcacccatgtgaatcaggcactgtgccaactctctgattgctaagataagttttgccattcctgctgttataatcactgaaaactttctgtgtggaagacagtatgccaagaactttgtgggacatcgtgggtatttgtcatttgtaattgcttagcatccaactgtctttcaggtttggaaagattctccaattatgtgacatttagtgtaaagttggatcctgcatctcatagtagaagccagatactccccatctctgtctttgagtgactagaatgtgggcacaggacttattctgagtcaacaagatgcatcctgtaggactttcagtctgaaccaactgaagccaatatggtgagacaaaattcaatcacagtattaggcagtgttagttgtgacaatgatactctggccagattctgtcattcatttacccattctggaagtctttatgttgcagattggcaactacaaatctagcctattaaggttttatatgaataaaggggttttagatcaccatcatacatagacacatgaatgttttctctgtctgcttttgtactacaatggaagacttgaatagttgcatcagatatagtatggcctggagagctgaaaatatttactatctggccattagcagaaagagtttggccacctctgctgcatatatatatatatatatatatatatatatatatatatataaacacatgcagagttaatttctgttgcttacagtcaagaactttaactgatacaaatgaattagctcatccagtccttataacaatgttgactaatctatcccaagcatgcctccactatccccaaacagaaggtaagacaactgatgcctgcagaggctatctgcccatgagcatattagctagtaagtgctactaattgacactgcataagtgccaatatagctatgacactatcagacaggaaagacattcagaaaatggagatagaacaattaatggtcccagacctattttgagatagtaggaaagacaatcatttctcacccagttgttcagagaggcactcaaatgatcagtgcttcagaaacagagaaaaagaagaaaaagaagaaaaagaagaaaacaaagacagcagcagcaaagatctaacaggtttatctccttcttggctgttttgatgcagttaattagcatgctggtagagcctttgtcaaaaatttatactgacctctcaattcttaggtcctccaccagactttggtttgctgacaaattagaatgtgttcaaactatgatccagactatgttataggctttggagtttgaagtttgtccttttagtctttggagtctacactgaattcatataacagtagccaaaataacaattgataccactatgaaaagctgcaccctatgaagacaaggtagaaagtttgccctttaagtctacttaaatattgaaatgtgcaatctgtgccttctgttaaggaggttcacacgtatgtccacagaatattatttcacaggaagtcccctgtcttccccgtgtaagtgtgctgagtgatcaacttcatggcatgtgcagggtcatgatgtttttgctaaatgccaagatactgaccaataagccacagctttatgggagtagggtggaatctaacacatgtaaccagatctagagtctcttgagtgtgagtcttgaaaatgctgattatggtatattctctgcgctgtttaattgggctaattcgcaacaaaagtggtgaaatttctattggaaatgtctgtggagagagagaatcacatttcagattggtgaaggaggcttcttggagaaggtcaatagtaatgttattgaactagtctcatgtgaccacatactcatatatacatgtgcccttctgttaaaataaaatacttcttatatgtagagtgataaaattttggaatttttttttatcttatcacatgttctaatgtattttcctttatgatttttgcacctcataacttatttctgtcacaggcaaagaaaatattttaacattgacaattgggatctgggaatttatggaggtcttatattttgttgcatatgaacgttctccctggagtatctttttttttttttttactgtttcttgatgcatccagaatgtatattaaaggcttctgaaagtagacatgtctttgttctggatcaagccaattactatgaccatttaagctggctatttttctggcgagtttttggagctatctaccaaagcataaacctgttaagaatcttcattcttctttttttatgtgcttcagacagttgagacaacctgaagttcaccaatattaaccacttcaacaccttcaaacactttttatgacctaatcactatgctactaccatattgaccaagttttgaattcctttccagagccctctcaaagtgaagcttctctcgaccttctcggcatttaaagaaggtacgatgattagaggtcactttcgagatcagatgttcaacagctgtgtctttcaacagggcaagtgcacaggtgtctatgctcagatgccctgaacttgaggcaatgtggtatagttagcccaagcatagcctgaagaaactgactgcctctagcatgtttttataatttttaaatgtctgatgagagatttcgattcatttgctctcatccattgatttttctgtaaaagtcttgatttgaatcaagtctattctttcctgaccacactcaatgttgatccttggcctctcaaatcaaatgctccttaaaagtgaacttatgaatgttatggaagtacaaagatgcttgatgtgatctgagaatagtgggaaatagctctcatattgttctcccagaagggaagcaaaagtgttggcaaaacgtaggggaatggttcatttttcatgagattcccacatgctgagtgggaaggcagtcacatccagagtgcagccagcaaacagaagatacaaatcgtaacactatccataggcagaactccaaggtaatatgagcaccatctctttgtagacatcacatgaactctaagatttttggggaaggtacacgtgtccatggtagatatgactccatgactccattaaataggaaagggacttttatctacactggaatgaattgggcatgtgattccaggcatgatggatgaactcttataatcccagcacttggaaggaggacacaagaggatcagaaaggagttacagtcgtccttggctacaagaatttgaggccagcatggaccaaacaagactgtctcaactacaaagtggtgatacaagttgatgttttgacaaggaaatttattaacgtttgtgataatgtgggtgcatgaatgactgcacctttgataacttgttcacttcaattatttagggtggagctttggatgttccaattgtacattagaatcaccaggagagtttcgacagctaggtcatatcctattttaggcagttacatacttgtactggctagttttgtgtcaacttgacacagctggagttatcacagagaaaggagcttcatttgaggaaatgcctccatgagatccagctgtaaggcattttctcaattagtgatcaagggagaaaggccccttgtgagtgggaccatctctgctggtagtcttggttctataagagagcaggctgagcaacatccctgagaacatccctccatggcctctgcattagctcctgcttcctgacctgcttgagttccagtcctgacttcctttggtgatgaacagcagtatggaagtgtaagctgaataaaccctttcctccctaacttgcttcttggtcatgatgtttgtgcaggaatagaaaccctgactaagacaatactatatggtttaagtaattgaaattaatttttcttattattctgaagagtggatatttaaggccagcatggaagcacggcaaaagtttagagagtgctttcttcctcactttgtaagacaattatcttcctgttgtgttcttatgcagaagacaggtctgatgcctagtatgttcagtgttctacattataacctctttaacccgaatctcttcagtaaaggtcctgtctttagtatagtcacattcagggttaagtcctcaacatgtgaatttgagggaaataccattcagtccatagcatgccctgagtgagaaaatcaaatcagagcctctagaagtgaaacctggaatgagtaatttttttaagcttctaggtgattccagtatgaagccaagttttaagatattagttttcttctttgctactagaatgaaacccattgatcatttatgtcagcatcacctgggagcttgttagaagtacagagccttagatatcacccttaacttattgaatgggaacctgtgctttaatgagatccctaggtgatgcatcggcacactactatcccaagaagcactgactgagaatttctaacatgttcctacactagatcatctttctccttctttatgtagtcaaatgcttgcaacaagagctatgtgatctcattagtcactataagattgtccctagtaccaggtaactgacagtatggtcttctgacagttgcttgatggaatagaatatgtgaatggtatgctggtaggttcatgggaaccactaaagacatccatactgggcacctcatcactcactcaagtaccaagcacagtgctgggtaacttccagaaaatatatcaaatgaaggttgaaggttcgcttctaaaaacagatagagtctccatattactcttagtgatctttttccttttggattagtttcacaaaactgtcttctccgaaaaaccatttgcagcttcttgtttgggctatggattccacttattatgcttagctgaatattgccaaagacttgggatgtttgtttgtttgtttgtttgttttgttttttaggagagtttgccattaaactagtctagatgtttctacatgaaccactcatatttagctgtttccatggttcccattatgaatcaattcctttgtctggtcttgttacaacttagttgttaattgcatggcagtgtttctctttggcttctgctacactggactacacattttctttgttgttataaaaatgcacttcgctagtttcagttgtggaacattaaaaatatgatgaatggtagtgatggttgcccaatataaatggacttaatgatacagaactatacatttaagcatagctaagaggaagaatgttatgtatgttaccacaatttaaaatgtaaatgaattttgcttattgtggtacagaatcctcatttggattctctagtacaggaagcatgaatataaagctgttaaagatatgaatagagtggagtgttaatagtattataccaatgttaacttcttagatttaggaaatgtataatggttgtgcaaagacaagtcaggtgatggagatgagggtgatagcagaattctaatttctgcattttctataagtctaatattattctttttaaaagcttaaaaggaaattatgaactgtatttcaacccattagtttagaaagaaaagaagttagaccataggaacaatctgacagaaagacaggaggagcttaattcctttctgctccggagcttccaggtaaagatccttaaaaatgatggcagctggaagggcaacaaaatgctcctcacaaagatatatgctttctaaaaagaacagccaagagagcactgttctcccaagcttcaaagacaaacaaaccaacacacatatcacattggaaagtagttcagcatagtgataaagaaggaagagaaagtaggaaacatcctggaacacattggcacagggggaaactgaaggaactgaaggatagtgcaaccccatgggaagaacaacaatatcaactaacctggaccccacagagttcccagggactaagccacgaaccaaagagtatatagggcctggtctgtggctcctgctacatatgtagaagaggagtgccttatctggcatcaatgggaggggaggcacttggtcttgcggaggcttgattccctagagaagggggatgctagagaggtgaggaaggagagggttgttgggtggggaaacaccctcttagaggcaaactgagggggtagggtgggcttaagggggttcatggagactgggaagggagagaaaatttaaaatgtaaataaatattccattgtgtaaatgaaccatattttctgtatcctttcttctgttgtgggacatttaagttgtttccaacttctgactatcacaaataaggccgctgtgaacacagtagaatacatgcccctgtggcatggtggggcatcttttgggttattcccaaaagtggtattgctgggtcttcaggtagatctatttccaattttctaaggaacctccagagtgattttcagagtggttgtcccagtttgcaatcctaccaacaatagaggagtgttcccctttctccacatcctcaccaacatgtgctgtcacctaagattttgatcttagccactctgattggtataaggtggaatctcagggtcattttgaattgcatttctctaatcaataaggactttgaacatttctttaggtgcttctcagtcatttgagattcctctgttgtgagttctcagtttagttctatacccccatttttttttgatttgagtttttagtggttagcttcttgagttctttatatattttggatattagccctctcccagatgtggggttagtgaaggtttttcccaatctgtacacaatggaatattactcagctattaagaacaatgacaatctgagttttgcaggcaaatgaatggaactagaaaatatcatcctgattgaggtaactcagatccaaaaggacatgcatggtatgtactcactaattagtggatattagccccaaaatgtacaaaatacccaagatgtagtacacggaactcaaaaaggtcaacaagctgaagttcccaagtgaggacgcctcagtcccacttaggatagagaagaaagcaatcacaagtggggagggagggagggacctgggaggaaaagtggactgtagggaggagagtgggaggagagggggacctaatcttgttttgggtaagggagaaggactgaagccctgaggactagcaggaagaatggaaacgggcaaccttgggaggtaggaggttggggggaccctccagaatgcaccagagacctcaggaatcaaagggaggggccttagatgaaatgcctgacattagggagagggaacttgtagattccacctccagcaggaagacaggacatcaagtgaaggatggggttgccatcccacagtcacacctctgacccataattgttcctgtctgaaagaattacagggatggaaatggagagaagcctgaggaaaagaaggtccagcaacaggcccaaagtgggatcttgctcaaggggaggccccaaggtctgacactattactgaggctatggagctctcacaaaaagtgacctagcatgattgacctccaaaagaccaacaaacagctgaaagagttagatgcagatatttgcacccaaccaatggacagaagcagctgacccctattgttgaattagggaaggctgaaagaagctgaggagaagggcgattcttgtaggaggaccaacagtctcaattaatctggacccctgaaatctttcaaacactggaccaccaaccaggcagcatacaccagctgatatgaggcccccaacacatatacatcagaggactgcctggtctgtgttcattcagagatgatgaacctaaccctcaagagactggaggccccagtgaatttagaggtcaggtggggtagggggtggggaggaggtatgggatgtgaaacagtcagagggtggatcgggggaggggaataaaatatggactgtaaaaaataagttaattaaaataaaaatataaataaattaattaacaaaaaagaaagcaaagggaaaaaacgatgcataatcttgagctggaaaggtggctcagtggttaagagcacttcctgttctcacagaggaatcagactcagcgtgcagtagcttacagccacctgtagctctggttacagggggttcagtgcgcatttctgaactttgtgtgcactacattcatgcgtgcacatacatgcactgaagacagtgcttttacatttagaatcagtactcatatccccttagtttgaacagtgcttctatcacttttcaaataagtgaatgtgtatttatctaaccttcattgcttcattttcttcatagataaagcactgccaagagtagtttttgtggggtggtattcaataaaaccatccttttggatgcttaagcttaataccagcctgactcagttaatactaggtgttattgttactggttaggagacagatatatctatgtgtgtgtgcatgggtgtgtatatttctatgtgtttatatctagacctttttccatgtgtgtgtatgtatgtatgattaatatgctttaaaaataaaaaaatattaataatttaaattttacttttacccagtatttaatttgaaagaacattactaatttagttttaaatgaaaatcgcatggtgttgttcccataaaattacatggataataatttccaaagccttatggtataattgatagtctcctcaattcaattaagtgttcataaagtattctcaattcagttaaccagtattcagtgagccattactttggcaaagtactttctttggaaagaaaagtatactagacaaaagacaatctttagatgttctaagcatttcttaagaaacagaaattaagaattttagtccaagatgccaggagtggtggcgcatgcctttaatcccagcacttgggaggcagaggcaggcagatttctgagtttgaggccagcctgggttacagagtgaattctaggacagccaagactatacagagaaaccctgtctcaaaaaacaaacaaaaaaaacaaacaaaaaaaaacaaaaaaacaaaaatctacatgtggaatggccatccacaacaattaaaaaataaaatcattaatatacactttgtaactaacccagcagatttatcataaaaagatgtcagaacttataaataaaatgtcattgccatgaaaataccggcaaaatattttgaggaaattttaaaatgtgtctatcaaatatcctatgtgaagaaaataaaattacaaatataacagtttatcatttgaatcactgtatcaacactgagtttggaaagataaaatataaaatgtaagttttttatcaattaaaattgtgtaagacttcttaagacccccccaaaccatgaatctaaacttatagaactcacagattttattgcatcaactttaatatttccaaatccatgaagaattattatagataatgttctcagatagatgatagactgagagaagtcattggtttctatggtatccaaagaactctggtaaattaacaagaaaaaagaccaaaatcataatagttacaatgggcaaagtatattcacaagacagggaagacagaagggaaactagactacccaacaggtctctgaaaagatgctttccttttactggtattcaaaggaataaaattaaaacaacagtgatatatttctctatactcttctggttgacagcaatgaaaaagtcaggcaacaccaagtgtttacaagcatgcagggagacaaaaggaatagccatatattacttgtggcgatgcaagtatacatagtagcatttgaatatatactctatcaacactcactcctgggcatgtatttgtctaaaacaatgggacactttcaatgatttcagaaacatattttgtcacataatagcatgcaggcaaagtaggtgtctatcaatatgagtgaagtatagcaaatggaatggaatataatatatgggtcataaagcagtgaagtacttgtattactatcaacatagatctttaagacactcttagagaaataagagctaaaatataaatagctaaaagacacttgtcttgatttaagtacactcaagtatagatagttgatagatatatgataaatagatatcttgaaaaaaaagagcatgtacctacatggcagcattagagaaggtgcccgtgaagggacagggatgggaatgaggatgacgatatatgacaagaatgaataagattttgcatttaactgacaggtctgattaatttaggtctctatggcttatttcttcccccaaaatagttatcttaagtgatatggaaaggaaaacactgactgtacccagggaaatcagtttggtagagatcacatctgaggtgaatttttgaggatgaacagaatgttgcttagagagttctggaagacaagagtgtctttagcaagtaaatcagttgcttcaaggccaggcagtaggagagtacaagacaggtttaagttatcaataaagagttatgtgtgaagtctagggcaagtaatggtatttaatagaatataagcctgtgaaaacaggtggaaaccgaagggctttcaatgcctgctgaaagagttcaggttttatttgaaagtaataggtgtgattcacagttttgaacaaggccacaataggatcataactaggaagatggctgtccagagagaaaatgtttgaagaattgcagctatggttggatacaaaggctgttgtcactctctatgtgcaatctaatgatggactgagataagcttcatttattggctcttaatgagaccaataagaaggaagtgggcgtggccttggaaattgagagtgcctgagaaacagatgagtatgtgatctcaggtgtacacctgaggcggtagaatcggcagacggtgaatgaaatcagaagtgagtggcaagatctattgagcagcatagtgggggccaaagaaaagagctgtgagaacacagatacctgaagagcccctgggataatgcattgaaagcccagacaactttcagaaagaaaaggaacaattactgcaaagaatgtctatatataacataacttagcatgttcactggttacttccccaagaattcaatcaagatacaggtgttcatcaatctagagtgccaggagtgggaaaaataggaaaggcagaaggagagtcgaggacttttcaactagtctatcaaacagcttattctcaaaaagtgatagagaaattatgttgcagcttatgaggatttgaaagggtttttgtttgtttggttggttggttggttggatggttggttggttggtttttttggttggtcagttagttggttggctggctggttagttggttttagtaccaaacagataaaaacatgtttaaagatgaaaagaaagtaagatacaaggagaggaaaggtagtcagtccctctactacactcctaagaggtaaaagccatagagcagcctttcaggcaaaagttcattggaagctagccttggtatatctccatttacacctttcttctccttttgccccttgacctagtcttcccttccagatggactcataatagtcatcaccccaacctctacacttgtttagattggttgaaaccacactaacaaagaagcctgtctttgtcactcaaaggagcaatttgagtgtctgaagcactcaaagcctggatggggaaagtccctgaggtttgtgttccactcagctgtaggggacaattgttgccactcttgactgaggcaggcttcacagggaccttacaagtatgtagttttctgtgaactttatctgaaagattgccagcaccatatctagaagctgtttgaaatcctcataaaaccagagaatgaaaatggggcagggaggaggggtcctgaactagccagctcctttctgtaattttttctttcacaagtcctggtctttggcaagctttgcttcctattttgccttcttctgtttcctgttccagtccatttacttccaggaggtaagcaccctcctttcacaattttccccttgaaatagttaatggattgtccatagctctttttgacctgggaaccagatgacatattgttgaaagtgtcttcgttgctccccactctaagtcaacagttaacaacagtgagttctgaccaaagtcaatgaacaagtggaagcaggaatacacaaaacgtgaagaacaaaacatgattctttgatgagactggagcatgaaagctgcttttctatctacatgggacagtgatcctgacctggaagtcagaattactatttccacagcagtgaaaaacatttctctttcaatgtactattagaccaagcatcaagttatccagtaaggggagatgtggcacaatattaataatagtccagtagattttctccagggtgttgtctctggttcatgacttactaaaaaatgactgaaatactaaatactgtatataacttataccaatgggtagttcagacttcttactttgggggaggctaaaattagctcctctccagatgactcttcaaccttaggcccaatattagctattccgacaatgctcccataagcctccatttgagtctgttctcctgttcaacttcattctcacctctgggactcttgataaatcttacagtccccaactcgggagatcccaccaaccacctgtttcatctattcttcttcttggctgccagctattgtttgaaggacatacacgcatgcacacacacacacacacacacacacacacacacacacacacatatatatatatatatatatatatatatatatatatatatatatatatatatataccaactctagatcagtggttctcaaccctcctaatgctgtgtccctttaattcatttcctcatgttgtagcaacccccaaccacagaactatttttcttactacgttataactgtaactttgctgctgttatgtatcataatataaatatttgatgtgcaggatatctgctgtgggaactttgtgaaagggtcagtctactctcaaattggtcaaggcccataggtcgagaaccactgttccagagtcagtggtgcttcttggcatgtcttaactctgctcagtgaccttgtcatgtcctctgcattttagtcaaccctagctcaaccacttcctctctctctctctgcttttgaccacaattcttatggtcattgaggaaatttagatgaatttgaaaccaattttcttcacttcctttttagttaccaagactttccctgagtcttttcttcacaatcacctttcactctctagtagggaggactcaagaaccttgtcctgagtcttttctttacatattgcctttcacattctagtacagaggacttaaggatgagatttccaagaacaaatcaatcagcagtacttgaactcagaatcatatccctcctgcccactttggccattgtgtatatattttatctttcttctgagttggacaaagatctatatcttacttacttttatttttaattttttaatttttattagatattttctttatttacatttcaaatgttatcccctttcctagtttcccctccaaaaatcccctatcccctacccctacccctgctccccaacccacccactcctgcttcctggccctggcattcccctatactggggcaaagaaccttcacaggaccaagggcttctcccattgatgaccgactaggccattctctgctacatatgaagctagagccttgaggttctctgtgtttctttgattggtggtttagtcccagggagctttgggggtactggttagttcatattgttgttcctcctatggggctgtaaaccccttcagctccttgtatactttctctagctccttcattggggaccctgtgctctgtcccatggatggctgtgagcatccatttctgtatttgtcaggcactgacagagcctctcaggagacagctttagcaggctcctgtcatcctaagtgagataacccaatcacaaaagaacacacatgatatgcactcactgataaatagatattagcccagaagctcaaaatacccaagatacaatttgcaaaacacatgaaactcaaaaacaaggaagaccaaaatgtggatacttcgatccttcttagaagggggaacaaaatacccatagaaggagttacagagacaaagttcagagcagagactgaaggaatgaccatccagagactgccctgccttgggatccatcccataaacaaccaccaaacccagacactattgtgtatgcttacttacttttctttctttttttttaaatattttttattattacgtattttcctcaattacatttagaatgctatcccaaaagtcccccataccttcccccctacttccctacccacccattcccattttttggccctggcattcccctgtactggggcatataaagtttgcgtgtccagtgggcctctctttccagtgatggccgactaggccatctttttttttccattttttattaggtatttagctcatttacatttccaatgctataccaaaagtcccccatagccacccacccccactcccctacccacccactccccctttttggccctggcgttcccctgtactggggcatataaaatttgtgtgtccaatgggcctctctttccagtgatggccgaccaggccatcttttgatacatatgcagctagagtcaagagctccggggtactggttagttcataatgttgttccacctatagggttgcagatccctttagctccttgggtactttctctaactcctccattgggagccctgtgatccatccattagctgactgtgagcatccacttctgtgtttgcgtaggccatcttttgatacatatgcagctagagtcaagagctccggggtactggttagttcataatgttgttgcacctacagggttgcagatctctttagctcctccattgggggcgctgtgctccatccaatagctgactgtgaacatctacttatgtgtttgctaggccccggtctagtttcacaagagacagctatattagggtcctttcagcaaaatcttgctagtgtatgcaatggtgtcatcgtttggaggctaattatgggatggatctctggatatggcagtctctagatggtccatccttttgtctcaggtccaaactttgtctctgtaactccttccatgggtgattgtttccaattctaagaaggggcaaagtgtccatactttggtcttcattcttcttcagtttcatgtgttttgcaaattgtatcttatatcttgggtatactaagtttctgggctaatatccacttatcagtgagtacatgttgtgtgagttcttttgtgattgtgttacctcactcaggatgatgccctccaggtccatccatttggctaggaatttcataaattcattctttttaatagctgagtagtactccattgtgtaaatgtaccacattttttgtatccattcctctgttgaggggcatctgggttctttccagcttttggctattataaataaggctgctatgaacacagtggagcatgtgtccttcttaccggttgggacatcttctggatatatgcccaggagaggtattgcggggtcctccggtagtactatgtccaattttctgaggaaccaccagactgatttccagagtggttgtacaagcttgcaatcctaccaacaatggaggagtgttcctctttttccacatccttgccagcatctgctgtcacctgaacttttgatcttagccattctgactggtgtgagatggaatctcagggttgttttgatttacatttctctgatgattaaggatgctgagcattaagctctctgcttctgctccagtactatgcttgcctgcctgctgccatattccatgccatgacagtcatagattctcagctttaatactgaaagcatagccttaattagatgcttcctttcatatgttgctttggtcatggtttctcattgcagcaatagaaaagtaagtaagcaaataacacactacctacaacaaagccacactccctattttctttttttatcaaatagatccactaactgaggaccaagcattcaaatatatgaacctatgggggccattctcatccaaactaacacaagcacattgggagaatataactaacatagaatcaggtaaccaacatatagaatcatggtttgtacattatagagattgatccataaactgatgagttcttaggggacagaatagatggatttcagttcctttgtgtattgacatagctgtttaataacagtggctctgaatggccagaaagaggaattttttaaaagatttaacatgcttaacatccagtgttttagatagaattttgcatggtatcttggtgaaaaattgtcagcatgactcgtcatttagtaaaagagtggtgtactggctagttttgtgtcaacttgacacagctggagttatcacagagaaaggagcttcagttgaggaaatgcctccatgagatccaactgtaaggcattttctcaattagtgatcaagggggaaaggccccttgtgggtgagaccatctcagggctggtagtcttggttctataagaaagcaggctgagtaagccaggtgaggcaagccagtaaagaacatccctccatggcctctgcatcagctcctgcttcctgacctgcttgagttccagtcctgacttccttggtgatgaacagcagtatggaagtgtaagccgaataaaccctttcctccccaacttgcttcttggtcatgatgtttgtacagtaatagaaaccctgactaagacaggaacataaggttcccacatcattactttctctcttatacttaggacacggtcattttgatcattagatggagtactggatatgaaaaacactttttgaaatctaaaagaaactcttctccaatacagatgtgtagcttttagttgcaatgccacaaagaactctggaacttctatttgtcatctatatcactgtggagagccctgcagcgagcaatcgcgtgcgtgccgtgagcaatcaccattataagatggcgctggcttccactgtgcctaactagtaaacaagccttatgcgcaagtgcaagagtgaactcacgcctagtcactgcccatctctcagcgtagtaatggggtgatgggcaagcaatgaatcaggagctgtcacgccacatcaggtgctgaaacgtcacgctgcgggctatataagcagcgccattttcccggttcggggtcttccctcctgataagtaagcaataaaagctttgctgcagaagattccggttgtcctgagtgtgttcttgccggcggggacaaaagctcgggatatatcacatctactgtggcttctgacttatcttccttgtgaattcagaacttgattccaactacccatcatgtaaaatgaaaataaatcaaaaatgtaaagtcttttctctccagaccccaccccaactcctgtctcctctttggcctaagtatgtctatctggatagttttactagtccacaggaatgactgtataaagtaggaggggaagaaggtaagaagagctgtaagtcatcatttcttttattcaaattcgttcttctgcttgtattagggacagttcttctcatactgcattgccctttctagccttaacacaagggggtgtacctaatcttactgcaacttgatatggttatgtttggttgatattcataagaggcctgcccttctctgaactgaaacaggggaggattagataggggacggcgggtagaggggagttggtggaggagggattgggagaagaggaggaaggggaactgtggtcaggacgtaaaaacaaggaacaaacaaaaaccaaaacattttttctttacaagcaaaagaaaatagacaaaacaattcaatgctggctggaaagtataatgtaaactaagtcagagtaccactggctttaccactttagcagactcccatggatatatgtgcattggggttagaacatgaatctattatctgcctgagtatgaatatgaatactgctctagttctaaaagaatagagggtgttcatttgcatgagaactgcactgggattatgtgaatatacccttttcatggtttccccctgagagatgtctgagttctttaatacatgagtcatggtagagaatttctttgattctaccatactccttgttaagaagcagtagttagttgctgtctgttacctctcagttgccaaaacacaaaggtgtctcttcagaaaatgtaggaagccaacatgggtccagatgcaatcatctcacaccactcagtattagcccaaagattgtgtagtaaagcaatgaaggataatttattgtcagagaaaaatgcttcaagtatcccttagctaatggactagacacactacagcaaaaatgtctggcaggttatattctgatgtgattttcattatagaaccatggtgttttgatagaaaaactgaaagaaaaaacattggctctcacttgtaattaaactgtatgtttaaaaataaaccacatattttagcactaagtctaatcacttaaaaaactataatgagaatcctgtgccagatcatttgtccctgcctttcactgctttaaattctgctccttgtttcattcaatctttttctgctgaaaactcttccttgtgaatctttagtcatttaagggcttattgccttaggagcccaataaatgagaattttgttttgaaattggactttgcttattctcttttgcccccaaagcaaagctttgcaaatgggatgaatgcacagctccttttcatatgtgtctctccagatgctcaaagcatcatagaaaaataggacagatagtataacccatttagttgatgagaagacagagacctagagattaatctttctccaaatcatacagcaagaaattgcaagtggggacttgaacacaaaactcatgttttttaaatgggagaagcagaagcgacaatctatgtttgctggcaagcattttagttgtaaataggcctgcacaatcattcttgaggtattcttctgaacactatgcagaaaaaaaaatgataacaaattaagtaatccatgtctttgcaacaaatgtactagttataggttaacttcatgccaaataggaccatatgtattttctcatacacactgggactctttgtatagattatgcatccattccaaggaatgtacagacttattcaagcctttgtaatacttgcagaggtgtttattttgtttctgtttatatgatcaaatgttgttcatatttaccattttgtttgactttttggttctttcaatgttcaattataggaaagctggttctgttttgattcctgatactgatttaagaactggtcatggagaagacagacctgcagattcatcaagccattcacctctatccagatattccccatggataagtgagagtttggcatttaaaaactaaatactcccattataaaataagcagattatgtctaaattccctcatcctctactaaattaatatgtaaccattgggacacttagagcatcaaaatatgcctactagagtctggtaaactatccattggccataggctttattattattattattattattattattattatatattttctttatatacatttcaaatgctatctcaaaagttccctgtaccctccctctgcccagctcccatacccaaccactcccacttcttggccctggggttccccagtactggggcatataaagtttgcaagaccaaggggcctctcttcccgatgatggccaactaggccaccttctactatcaatgcagctagagacacgagggaccataggcttcttaaagaggacattttgatttcagaacaaaagaaataatttataacatttaggtagtgtcactgtttgaggtacattttctgactttattaattctattggtacacttgtgtttcttagttcttattccagtgaaaatattggggtggagtgagataaacatctttcatatcaataaaaaattaacatttccttcctgaatacctcttactgtgggttttatttctgtacttggagcattgctcaatatagaaaagtgggaaaaggaactgagagtatcgatggaaagagttgcctagcaagagttaaatttatcattctgggatttgtcgttcccaacatttcaacatgctgacaacagccaatggaatggttatgtgtctgtgtctgcaaacagaacttgtagatgcatgtcttcatgccaggcagagctggctctttcaaacactgattgcagctgaagaactagaagagaagtgttttcacctatgctttgagagccagattctgatacctaccttttcctttgcagtgacacagacaatttgggagattcactctttgataaatgcccatcactgtctacatacaaaatctttgtgcagttctttgtttgtttagataggaagggttattcctattactggctgacaaaatgtggatgatagtgatgttatcaaatcaaaatagagctttgtgggtgacaaaattctgtataaccatataaggaggtttttgtttgttactatttgggtttttaatatttgtattgttttgtctgtttattcatttgagttggggttgcttgtgccccccccattgacctcacactacattacctgtgtagccaaggatatccttgatcctgatcctcctgcctctacctttcaagtgctaagattacaggtgtgcactagcatgcccagctaaactctttagttgccaaatatttccaccatccttccaccacagggatactccttcagggctgctacttgaaaaataaccttaaagggacctgactcttctcatctcaatttgttccgataaaggaacgtagaattgattggaaagccctaacactagctctaccactgagtagctatgggactttaaagtccaatggtttactgtttcctgcttagtgctcatagcctgtgtcacaaaagtattctgatgactcagaggaagggcagaaatcctcttaaatatgtctgtgctcgaacaaatattcattaatatttgccttatcatattgtatggctagtctctttgggccagattctgtcacggttttcataccccaaacccataccctataactaagataagaataagaattacagttatgaattaaggatggtttgtggaatccaagccacctcctacctgcactggagcttgaggatctttatagtccattcctcaggagctccaggggacttccctgcctagcaataattattcaatctcattttgcccctaattaataagagttggaggaacttttaaaataaatccatgtgcacatttaattttctattttcgtttatttcacagttaggcttttcttctccaattttgtttttagtgcacaccacaccttggatactgcagtccaaagatgctgcagcatcccttgccttctcaaatctttcaggctagtgcaaaagcaattgttggccctcgcctcagatgttccaagacttcttaagtacaaatggtccaaacaggaactcatcctctcgcaccacaggctctctgtctcctcaaagcagtgtagagatccctcagaggccatatcaagtaaaatggtagtcaacctttgcacctccctcaattttactcaataaggtgagtctaaaacaacatctttgtcacttttactctctgaaatattgctcaatgttgccttctccacatctgcagtcctaagaatctaatgcagaccatggaggtcatgataccgacgccccatctctggctctgctgcccatacacttcactttctcttgcagcaaaatgagaaagaagcagaagtgcattgagccataggaatcaaaggaccctgggggacttgctgaaatgtttgaactcctgatcttcacaagccatagtctattaaggaattttaatatgctaacaacttaattcttagtgcacatttattcttctaggtactatgcaaaattatcttcagcaggggttcagcagtgtagccatcattccaatagccgagtaccacctgggaatttattaaatacacatatttttagcctcacctaactagtctgaaatggagggtggggtgtggttatctgtcatttattactacattcgggtgaatctgctgcatgctaaagagtaaaaaccatgggtttcactaattattttgcataaaatctgtaagtaccctgtgaaggagacactaatttatctttatttgatataaagatgagtaacatgaggtcatcctttgtgccatcttcctacagtgatgaagaggggatgtgaacccagggattttttttctttttttttttccatttttcattaggtatttagctcatttacatttccaatgctataccaaaagtcccccatagccacccacccccactcccctacccacccactccccctttttggccctggcgttcccctgtactggggcatataaaatttgcgtgtccaatgggcctctctttccagtgatggccgaccaggccatcttttgatacatatgcagctagagtcaagagctccggggtactggttagttcataatgttgttccacctatagggttgcagatccctttagctccttgggtactttctctagctcctccattgggagccctgtgatccatccattagctgactgtgagcatccacttctgtgtttgctaggccccggtatagtctcacaagagacagctacatctgggtcctttcaataaaatcttgctagtgtatgcaatggtgtcagcgtttggatgctggttatggggtggaacccaggaatttttattctgaatctttgtccccttagctactatgccaggctgtctctctaaattccaaatccttgcattggaagccaatataaggattaaaatgtagcttatggacaatagtagaccttttaagacccagagttgcctgcatctctttcctttttcattttgctcaagctaagtctggctcttgcccacaaaagttgatttgctactttctgcaaacacattgttctctatattttgaatgcattcgctaccatattattaaacctttccttatgtctctaacctcttgctggaccacacatctctgaattcctctggcattcgtgcactacaagttttaaagtttatggcatatgactttatccccaactacttcttacgatgagcttgctcgttcccaggaagcagggtgggccatgtggtatgttgtcttatatattaccatttcattaactgcacatagatacatacatgtttagttcagaactctgtccaagatgaagactgttgaattaatttgggggtgggcaatgcacaattgttttcaagtcacaaaattataagtaccacaaatggaaaatctgtttactacttaacatcttcacccaagtgcctggcatagggtaggtgctgaataaattcactgttgtggaaacagcaaccaatcaatatagaaaaaaaatttcattctacttagaactcagaaaacagaaattactcatgatgtagtcactacatatttttataaaaacaccctttaaagtctctaaacatatcacaatactgtgtttccaactgtgtatagttgatattggatgaacttagacaattctctttttctcaaccctgaactgggtaactcctgggtcttaggcagatctattttctttggtcctttgagaagtcctttcttgactgcaactgtgtagacttcccaagaagatactatcctttctgagccactggcttctcagtatgtatattcattcattaatttctccatccactcaccaaacatttattgccaagcactatgatgagccatggacaagtctatgggaagtaaggcatgagtctcaaggagctcattttaccttcaacagggggtattgacatataatctataatatgtaacacataaccttaccatgttgtgggatgggaataatcatggagaacttcatgaagaaatttatatctttgctagaacctggaagatacgtaggaactagccaggacaactaaattcacatataaatgcaatgtgtcagggttttcagaaagaaaacaaaacaaaacaaaacaagaccgaggatgataagctaatgtagaaacaccacacacagaggagagatgaagtcctgacgtaagactattgggatagagacaagcacatatgtttggcttatatttgaagttggattgagcatccttgctggtgatgagttggatgtgagaaaggaagtgatgtggagattattggaggatgggattgcagagaaaacaataacccaataagctcttgttggagttgaattggaacatcatagtgcagggaacagtcaaagcattggccataggcttacagctcattcagagaagaaatctagcttagaggttcacactcaggggtgtgtattaaaatgcagcttgtgttgctttaggctaaagaactagcagacactgaggacccctaagtctgcgagaactaggacacaatctataaggaatgaagaactggtctctggtctcacagatgtgggttgtcagtagacatactccatcatcccctgacactccctgcaaaggtttctcaatagcatccatgcatctttcagtcaaacttcagattgacaagcatgaattattcagtcctaacttcccccactctatcatgaatgatacctaaagagttttgttctaggtaccaggtatgttttataatcattgcctcactaaaatgctaacaataatcctacacaagggtttggtatcatacccaaacccttgatattcagaatctctaagaaatttgcctaagaatacagctagcatggctgtgaggggctctgaatccagggccatatatcagcactgctgcacctccccacctcctagaatacagctggatcctcaagaaggctgccctcttccttcccctgctttgtaaatatcacttgcatccctggcttaacattttgttctccattaaaggacaaggctccccttgggaaaagtaaacctcaaagtcgtcaatcattcaagcctcagtgggaatgagtttcagattcttaggaacacattttaattttatgagagaggaccactggaatcttgagggagggataataaggtagaagtacagcaaattatgcagtcagattcttccatcgattttgccaacccacctagttttgggtatgtgcttctaagattcttagatgctgtttgtgcatatttctactatgttgtaggtacctccattaatgggtctgttaccctagttgtttggttctaatcaaaggtaaccttacactacacactgactccaaaccaccatgattaggaagagatagccagcttgagctgtggttgtagacctgtagttcctggccttgggcacaattttgaacccttgagaattaagtcctgctgtgcacattaaaaaatattgagcagatggagacaggagagcttgttggaacaatgtagaggagtcccttctgccctggatgggtccatctgccaaaataaatgacatgtatcagggcatggcattagtccaagcccattgaaattctgtgagccatccaaacagtgatggggcttcagattgggtctgtgattggacttagagagagatgatgatgagtgagcatctggctgctgtagccttctgatgggaacagtcccaggggaggctccatggtgagaggaagacagcctcaaggaccccctaggacatctgccacagagagaccaacaggacctagcaccaaaagacaatatagtctcatgccattcctactaactatgtgaccaaaagaaatcttccttttctctcagcctcctccacccagtataaaataaactctgggcaaaatggtctccaagggcctttccctgcttgaacattctgtgacttctttgacacaggtttgatttctctttctctgtgtgagaaaaggtccacccacccacctgtttatctgcagtctctgtgttctcacactgacctctgctggtcatatgggggaaaaatgcagtatatcatgtctgcagggaaaacaaaacaaaatataatgcagtctatcaatgattcagtatgaagcttaagtgtcacaccgaaactctgcactggagatgagagcgagtggaaaccaaagcaatgctaagcacagatcaagacatggctctttttctcggggcttccttcatctgttcccggtgctctgcgccacagtgtgaaaggatttccatgggtagcaagatttcttgtctcagtgcaagacaaggccttggcaccctgctggggaggcaattcaagataagcctccagacacctaccagacagggccctgtgctgaaatcaacatgagaaatttccttccgggctgctgacatatccaaccaacctaaactacctgagaccagcccccatcatctttgtttctccaagacataccttcccaaaagccccttttggatttgttttttaatctcatgggttctttagatgtcttacatgcaactttctgttaaatttagcgtgcccactcagacaggagaaagaaagccgttttctgaaccatctcctggtggaccaactcagagttctattactgccatcttagcatttcacaagcctaagtttcctagtttacccatgctggtgagcttgtgttcagaaatataagaacacagaagtggatggcgctggcccttgtgctcacactgggtaatgcttgaactcccatagcagtacaagcagaatgggaactgggtcacatgacaaccagctctcttcgtagctgtcaagcaatttatcatgtctatcttccctttatggaaaaaaccccttttggtgggtccgaggtttgggccaaacattctgtggtctgactggatcttctctgttagtagctccagcaagtccaccgtgtcttcaacctctcaccaaacagtcccctccgccaacagctgattcttatctgcttcccttgttcctgcctcatgcaggctgccccagtgtcctgatgaggctcacatgttctttaggatgccgcctgaggagttacaactctaaacagtgctttctgcccagctgcttctccaggtctgaccacaccacgccttcaagtttcctgccaaactctctaggcccattccaagctgaagttcacttggcctccccaagtagccgtgactccccagccatgggccaggtgttgtgctccataggcctttccactgtgtgcctaagtgcttgctccctgcgccatgtgaacggaaaactcttgagtgatagatggtattgcagagtgttgcatctccttgggtagaacattgttcatttctttgcaagagctctagggcttcatgggcctgattgacactgcaaattatatcccgaaggatcagcacagctggtgggaacaaatattgccagaacataactctaaacactgtgtttaaggcgctgttttcagccttttaaagtgtaaagcttgagggtgattggaaagggcatttccgtgggctttttcagagttttctctgagttttaggaaattatggtcactaaaggggtggggaggtgggactggaagcatttatgcaaacttgatttctaccagataccaggttctcagataggtagtgcacatggttttcacttttcagccaaaaagaaaaaaaaaagtccctattgggataatccaggctgtctgctttgtacctactgggattaattctcagtctcagtcagtcagcttgaactctcagacttaattattacggacattttatagccaaggctttcaaaatcttcaggctgctcactcctgctaccataactgatacctaatagatattctcaggctccttgtgctgtacacatttgggtactgtgcaaatagaaggaggggctgaaagggggataggaaggaagagtgaacaaatgagtgtgggggaggggtccctgtaagtatttagtgccaggtataatgatggagtcctgggatcagctgtaaaatcaagatgtattttgaagagttgggcagtttcagtggtcactgttctctgtcctccccactggggcagcattctttagacacagccatttctgaacttcagtgcaatcatgtggttggccatttggatgtgacttataaaatgccatgatgctctccagtgttctgttcgttcactattttgacaatctgatggatggcctggcattaactaggaagaggacagtcttatgcagcctgaataactaatctcctaagaagtacaaagttgaaggatcttggtgcacatgaatcttattaaatgtgcttataaaatgtgttctatccaaataagcttaacggcccctaaaatagccctttctgatccctgtctggaacgctggcatgcctcacagatctctaagccaaaattatttagtcaagtggtgcctgtactttgtacatgagaaaattggaaatgttgatgttaaatcttctgttgactaaatttcagtctttctgtccatctttaggggcaccctggaccaattggaactcaaggtccagccggtccggaagggtttactggtccaactggtttatcaggtttgaaaggagaaagaggctccccaggccctctgggaccatatggatcaaaaggagataaggtaaggaacatctttgatgcaagggtggaagtacaaaagtcaaatgttccctctcagttctcagaggaatagtgttgctcctaaatatcgcggtgccagggcacacattttaagaaaagctgagccaaagtacagtgtgtactagtgtgaaagtgtctgtgaaatataatatggtgtacaattggtatacaacattaaagtaaaactatgaagaaaacagaaagaaagaaagaaagaaagaaagaaagaaagaaaggaaagaaagaaagaaagaaagaaagaaagaaaggagggagggagggagggagggagggagggagggagggagggagggagggagagagagagagagagagagagggcatggtgatgcacatctctaatcctagcattcaagagacagaagtgtcaagattgccacaaagttcaaggacatcctgacctcctcaataggtatcaggtcagccaaaatccataaaaatgtctatctcaaagaaaaaaaaaaagaaaggagtgactggtgggcaagtgatggaggaagcgtttctggagattctcaaagaaggcagactatcaagtaaatatactggttgcttacgtgacaagttggctcattcatgtcaagtcatggggatttgaaatgggcttgggtggagagtctgatgagctgatcagtagagatcaagcatacaacagaggagactaacaagcaagaactaacaggcaagatttagaaacaacctggctcataaatataagggaatgcactaccaaacaagaatggtaataacatgatgactagcctactgaatttatcaactcagttgagatgctctgtgtattttcatcacgtcctgttaatctcatattttagggaagggattgccacactaagtataaggtagctgaagtataacatttatctgggcacatgaggttgaaggcaattttctactcacagatgaggtagatggcaattgatgaatcacaaatattcacatcttaggaaagggagccattgcgtagcatgtaaggacccaaagagttgtgcttgggaacagagtgaaccaagaggctgcaggtgacaggccttagcatcaagaggttgtggtggccctggttcctgaaagaaggtgtgacttgtttgaatatgtcattggcttagcttgaactgccttttgtggatgaacaagaattgcacttgtcccctgataataaaggtagagtagcttaggacctttatctgaaggagcagaatagggagaaactattttgttagatttatcaaagcccttctgttgttatacagatgtgaagactgcctgtaatgctgagtgttaaattttagggcttacactacactgcttaacacaagaacttgtctcagaacataagcatgctcaagaccattcttagaacaactccttagacttgggggtaggaagtatggcaacatgacatgaagaaggagatataaaacaccaacaacttaggtcatcaaatccagtcaccaaatctattgaccctaacaggcatcaatttgattgccatacacatttctctctcttctccttttttagggtcccattggagttcctggctttgttggcatcagtggtattccggtaagtgtgtacatggaagagactttaatatcacctttcaggttctgtctcctggctcaagtactttgaccttacatactgtgtgtgtgtgtgtgtgtgtgtgtgtgtgtgtgtgtgtgtgtgtgtgtgttgtacaagtaggctgagtgtcatgcactgagataaagtgtggtgaggtgagaagagcaagagtcccacacattttgattcaagtagcccttactcggatggtttaagagaagtgccaccaggcatggtggcacacacctttaatcccagcacttgggaggcagaagcacttgggaggcagaagcaggcggatttctgagttccaggccagcctggtctacaaagtgagttccaggacagccagggctatacagagaaaccctgtctcgggggaaaaaaaaaaggagagaaatgccatctatgagaaaacatctatatcttagcctaagtaagctaatactgggcaggggtggggacactgagcggaatttcagccaggcatagagggactgcctctgaattgcggaggcacattgaagcatgcatgtactcattacaggaaaagtaagaagatgcacagagtttgaatgaaatacattttatttcagtaatgtgttcttatcagccttattgcccttcagaggggactacccttcagataatttggttgatgcttgtttgtttacccttccagatatcagtggtggattggaagcttgtaacacagcccctttccaaattctattctgcccaaccacttagattccccatgtgtaacctatatccacacttaactgatggcttctggttccatggtaactgttcaccaacctctgaacttgttaacattggagcttactggctagttctttctgcttttgtctgtatttatcccataacctgggtcatgtttgtctacaagtttttctgacttatttaagagaccaaaaaggccatggacacttagactatacaaagaggaaatctccttcacctgagggagactttagcttgccctcatccttctaacaacccctaagaggtccttttgaaccctatcaaagcacagttggagatactgtagtctacccattgtcttatgtaatgctatacaaccttctggtatcagtaaaggtgattcagatctttcttgttccaatctctaggcaatgtcttgaacacctgctatgtgctcatactccactatgagaatatacagcaaggatatagttttgtgtttatagatactatcatctgatctatttttctctcaaatctagtagacatttgtagatctggagaataaaagacccactctttttgtgtttctaacttgaatcgagtcacccataaaataacacattttattcagctgcaatgtcaagaaaatgtccagaaataagccaattggataattgaatggacagggatagccatccttttttgacattcacctattttcttatgaccttgtttctatgcctgcatgagaaagaatccctgcccagagtgtgccttccaggtgcagaagatgagtgtaactgctaaactggaggtaccattacccaatcatcctacagacctggctaggtgaaagatgcacagtgattggaacttgcactgttactatgccctccccctattctctcttttgggctggaactgagagcaagtaaatcttgtgctgcctaggctgcttctaaatctaggctggaaccagtccttaagtccagatggatgcttcttatgcctcaaacttatggccaacgcaagcattgaccacttgtctttgtggcttcattgcttaggggaaagagttgcagctcttcagtatcctccaaataagctggctgctccccaaaagacacacccattcttagtcctttcattgaccaaaggttgtctgtgcttcccctcttccaactagccaagaagtatctgttgtgtgcctttcatttattacttacctcttccttccatcttgaagctcttaggagtctttgatgtgtggttcactactctacttccttgatgcatacagttccctggtcctgattgctttgtgtgacagtttcatctctgactcctaaaattcacagataagatcttctgtttccctcccccatccctgaggcccaagagtcctggaaatcctaaaagaaaagtttaaagacctgactcagagttctaatacctgcaaaagccagaattctccgactgatggagctacttcagacagaaaagcacagaacctacaggccttttccaactaatcaatctgttcaacttttaacatcacacacttaacacttcatctgaaaacaacagattctgacacatcttactaaactggaccactgtgaaaatcaagttcccctcctaataatagccaatcattaacacgggtcactggtttgggtctccaaattccaatttttgctattatatagacaatttcaaaatgaagtcactttcatgatagcccagttaattgcaccaaaggtcataacagtcaataaagagggcaagcagggcttgcctaccagtaggatgttcaatatcagcacaacagacactggggatggtacagctcagggctttgagatatcccaattgtgtgttagggctgttggcattatttataaaacactttcatttaaaatgagttgagcttggcgactctaattggagaacaggaggaaggattgtagcctctaaggggatcggagctccacagaaagaccaacagagacaactaacctgaacacttgagactctcagagactaaaccaccaacctaagaatatacccaggctggacctaggctttcctgcacaaaccagccttataatctcattttcctatgttttcaggcaactattgggtatcttagactatatcccacatgactaatagaggtcacactatcagaagaaggtctcatttacaatattcttatatagaaaatgttatcagagttatcggaggtaaacagactactcttacaaatgtgtgaatccagacaactaaaatgatggcttcagttttgcaggggaaatgggcggcatactcatgccttgactctttattaccaactagctcggttagtcccattgcctgggaagagctccagccctgtgtttttgctggcatagcttttcaggttgaggttggatcttaaaactagaacaaatttcctttcctggttcacagtttgaggggtagatttttgtcttatgttagatcagagtaacctcagagcacatgtcgtttctttgctcatgaagctaactttccctttttttcatttaagggatgtattttgcttctgtttgctatatccaaatcaccagcatcactattcttctagtttagggccattgttaagtaaaatagttatgttccacatgtactgtggaactgctgtgaaaattgatctgataacaaagataactatgtagtgactaataggctggtagagaatgtagcataaatattcatagatgtgctggagaaggggatgatttacactgcaggtaggattgagtggattgacattaatgttcattatactactcagcacaatgtgtaatttaaaattcatgagttatttccatggataaggagggactactggtcatttgaaaggctcattttgaacacatgatatgtttccctcaaattgttaaatatacattttaccctttgaaagtatatttaagggaatgtagaagtctacctacctttcattgacctgtccagatgatctattaaggtcatctatttgcaccatggcccacatacaactggcttttactagattgaaatattatgttctccaattctgaaatacactgaattcagatgagctctatgaaaatgcttttgaactcccaagctaaacaaatgccctgatagtgaatgtggagaaaaagagaagagatggattcttaactgaaccagttacctaccatgggattgtgacaaactgagtgcaagtgagactggctagtttttggccaagcagctttcagtagaggaagtgctgtgggaacttcctccgctcagttgaccaagatcaggcatctgctcccatgcagaacttccgttcagaaagccatccagctatctgtctggtctgaggaatctcaaaccttggcatggttctctattgatagcagttcagctgccagacagctaaaccccattttagtacatctctatattcagggaaggtgaaattgtagtgccttgactattgtatgtgttcaagtttgagccctttagtttcagcttggatattattaaagcaccagttgtctttttgagtgggataactcaagttgtgatcttggcaacatatgtctgagcacaaaggaaacatttgagaatgtacaagatgaagctaagggagtagacaaggagccagaatttagcagtgtacttgtctgttctcattgtgagccttttaaattgactaataatcctgtggctgacttgatcccttaatttttctttgaacagggccaccctggacagccaggtccaagaggtccacctggcccagatggctgtaatggaactcaaggagctgttggatttccaggccctgatggctaccctgggattttaggaccacctgtatgttaccagatctttgcaccttaatgcaaatgcaccttcaaatgtgtttttgtttgtttgcttgtttgtttatcttgaaacaccattaaggccttgtagacagccactgtactaccttgcccaatgcaagagtttatacggatggcaccataacagcaaaactctttaaaagtgccagttgaggggtgcacatgttaaatgactttaggttactttctaatgctaccttgggaattgtcaagattgttaaaacaaacaaataaataatagttatagcacatttccgagcaaagcatgcacttgagctatttggcattttgcctatcaggtaacattgggatattccagggctggagagatggctagcggttaagagcactgactgctcttccagaggtcctgagttcaattcctagcaaccacatagtggctcacaaccatctgtaatgagatctgatgccctcttctggggtgtctgaagacagagatggtgtactcacatatataaaataaataaaatctttaataatgggagaggatattcttggaagaccttcatgtgatcatatgcatattaaccaggacctaaaggcatgatgaacttggtttataccaatagtttcctgacttgaagaataacacatttcaagctcactattcatctaatttggaaaaacctaaatctataagagttgtcatgtgaggccatttgaaactagaaatcatacaaccaattatacagatctcatagttctctgagtagccttcaatgaccaagttgtggagtataagaatacatgcaaaaaatgacacagaggataggcagaatacaagccccaaactgccctaaaggaccctgccatcaatggtccagaccaataaacagcagagagataacagggaaagctatagtcctaaataatctacacaagtcttaaaggctccttaatgctgccatggcaacagaaaggggaagaaaatagacaatgaagccagcaaaggagagttccaccccaacaaatggaataaagaccttgaagtagcagacatcctctgaaagagagaaccccagagtggaaacctaaacccagcctgaaactttaccttaagttttaatagaaatgtgggcatatgtttttactaagttgaacctcacctcctgctgaatatccattcagtaagtccatttgaaacttctatgaaagaaaatggggaacacataaataaggggaagcagacaatattcagaaactgatttgcatgtctaggcgcttgttttactagaagtacagtagtccccttgaacttgaggaatccatcatcaatcaacaatgtattctccaaagtgtacccttaatactacctaatactaatcctgacttctccttagatgccaccatttgctactaagacaggaaacaaaaagaaatctgattgaaagactggaatcaggtatattgactgatttccatgataatgagacacaccagctttttcaaaggtttgaagctgaaattgtgttgtagaaacacgagatgaagttggtgtcatagttgttttagacccatggcctacgtgttggcccccaaaagcacctgtcctctagcctgtttttacatcttaaaaataaataacaagaaaaatatatgacagaccccagatttgactcacaaaactttaatgatctagaatcgtagaaacttttgttgacctttgacctagataaagatccagttagtgaggtaaggggtagagttttacctaaaccagtgttctccatagatagaaagtctgctgcagtctaaccctcatcatttcacagacccctggcatagagacagaagaatggcacccagcttcaagacgacctctttagaggttaggctattacctttaacacagccaagttttccacagcaaaagacacataatttcaggttcccattgccaaatcctctatctaattaggtaatattgctatgaaaactctgcgtgggtaagtggagttttgtttttcatttgttttgggtgtgtgtgtgtgtgtgtgtgtgtgtgtgtgtgtgtgtgttcagggattttctcacaggtttttcatattttatccaggggctgcctggtcacaaaggtgccaaaggagagcctgttccttttcaaggcagcattacaggaataagggtaagagtttctaaagcaggcagcggagtgggtgggaatcaaggtttcctcacaccaagccatttccaaaactaagaaacctgtgcgcctgcttaaggagcagcaccagctgactttcaaaggattccaagttttttggtggtagaaacatttgcagaaatgtttgtagctatgctgtctagaaatttgttttccaggatctgcaccaaaactaagagagaatttggcaatgagtttgcatggctattttctttgacaagccaaaacgttttctagaggcacatgcttttgtgtttcctctaaagccttaatacctatgcaccttagtttgagtctgtatatatccttatacagcttagtatggctactgccccagcatctgggttccttctctagactcctgaaagtctacaaatacttgcctgtcaactttcaactgattggaatctaatctcttgtcaataatatcattttattgagccttcctctatttgctaactggtagctttatgtgtcctcaataaaccctggttccaaatgattgaccctactcgtctgcagactgggaaagaatccatcactaccttgatagcaaataggaatttatgtgcctgcatttggaggggagaatacaccaagcttactgagataattgacactactctcccatcactgtacagggcctggaaccttagaaactggccataaaagcagagatggggatggaacatctggataactacagaagaaggaaatttgggttcttgacttggatgccatagcagaagatagaacattaaagttggcaagggcctcttggcttttgaattcatgtcactcattagacagatttaaaatctaaggctatataacttactcagagccagatggccagttctctgaagaactaaacctcaggcagtgttctttccatgctacagggagcttagaggtttttactgtaagtcaagtgatgtaagactagcaggtgtcaaagcacagccattgtcttagcaaacattgattaaatgatttttccagaaatcaaagaaaccttggatccagtggaacacagcaatttccacaagatggttatattacagattcatacagtggcttaagatgcctcaaagtaattaaaacgtaatcagagtctgtatgctctgttgattttcccttgaaatgtctgatttgcattgtatacatataagcacagattctctggggatgaaggcacaagggaaggtagctttgctttcctccaaaaggagcagaaaatcaccagcctgcagaagccttttctaattgataagttcctagcaaatgtgaaaattaattaatctaggttaagtaggaaatcttgttcagccaaggctataatatttgttttctagagtccagaatgttcatagggaaaaagtaaatgggtagatacagccaatttatgcattatttaaaacacaagaccttgataggggcccaagttgccgtaatttgtttctatccccttgaatctcaggttggttgtctgaaaccctttgggcttaatttttaatctcttccgtgtgttctctatttctatttctcagggagatcctgggctgcctggactagatggaatccctgtaagtcatgcttcttgtgttgacctcttaatgttttgtcaagatgttgatggtatctttccattcttcatggtggagttcaaaggtcttcgtagacttgctcaaagaaattctggagtattgcaatagaacaaatcatactagccacattttattttcagacagaaagtcctaagaagatgaaatgcacaactcgagttttaagacaggcagtcttcagagtttacattagatctatgtctgacacccccctccccccccacacacacacactccctgttcccttatggatgcccctgatggatgcctgaaaccatagataatactaagccctgtatgaaccattctctttctatgtatatagacttatggtagagttaaataataagttaatcacaggaaaatattagcaacaattgctaataaactatagcataatatgattagacaaagtaatgaaagttatgaatcccttgtcaaaataacttagtgtgttgcacttggcattgctcttgtgaatttgtgaaacaatataaagcttctgtggtgttataaagtgaggtaaataaaatgggctatgagacatagcattaggtgactatgtaacagttactttaacataaacacttccatacttctttctgttcactggtcttgaactgaggttaacaggaatatggaaaggaaaacaatagattaggagatccaccctactctcttgcatgtatcaggaaggtaccatgtttttcattcaacaacaatgtactgttttctatgtgtgttcagggttacatacacacttcttttaaagctatcccatagagaaatttccattagggtacatggaagtccacaagttaaactaataagggatgtctatttccttgcaattccatatctccattgctttcctttgaaaagatataagaactgtccctggcttgtttgttttttcttattttcctttgtcttgatagttttcgatacatacggagtatccagtatgagcaaagtgctatgagtgatccctcagacaatgtagacattgtccctcccacaaaggagatgaaaatgtaagggtaggaatatctcagaggaatcctagaaccccttagggaagaatactgtgtatcaaaaattctgataggagatatgtatctatgaaagagaatgtagtgtctaagaagcatgggtcaagtttagatgtgccagttgtagatggatgcttatacaagggatgtgaagtatgggagctcacacaggaaacaaagatgactaaggaccaaatttatagattcccccagagcaaaacaaaattgactttaaaagtatgtttattaaatttgtatgataacattcactcagtttgctttgcaatttctcttagggattcagcctccttgcctgtcaatacaaccatgaggcaatatgtatttagcttagaggacaggatgtctgttaactaaacaagtttatgatcaataaggagaccacaagttgttcctggttgtcaatccaaaattctattaagccacagaacattggcatcactccagaagattccctcctacctattcacagtcaatctgtccctatctcactgttgtgattattcttctgtttaaattagtagttcatagcatcaccatttctagagaaccttccaatccccttctcctcctgttgtctaaatcttgtcttctctttcttgggcacataacacctgtgtcctgctaccccactggaatggagccttacatttccacataacagcttttctcctgatttcagccttcctttgttactcaattcgacacattttctcatttttcatgtgaaattttattttctttttgacccatggaatatttagaagtgatgttttctcattccctagtatatgactgctttctgtctacctttcctttataaatttctagtgtaagtctataaaaattaagagtattacactcttatgtttcatcccattaaatttgctggagtttggtttatgaccaaaacttacagagaacacatactcagaagttggtgatataatgttttaaggaatatctattaggttaaggtagttaatggtatttcaatagccaatgacctgggattttttgtttgtttttgctttattgttttttgttttgttttttgctgttttgtgttattttaagttctacaaattactgaggcaaagatactgcattttgtttaaaattataacgtttttatctatgcagttcttttttttgctttatatatgttgaatctctgttaggtgtagatacatgtaatactatgatgtcttctagaattgacccatttatcattatgaaatgcctcctgcctatatctagttaatagcttgaagtctagtttatctaatactaaataactaggttttttccttttaaattttttaatagtaaaaattcaaatgcagagccaagtataatgaattttacaataattactcataactttaatattttactagaatctccttatctctcttctgtccatctatctatcactgtctatccatcagctcactgattttaatgaatttcagaatacattgcagaagtattccaaaatacaacaataatgcctattattagttaaactttagtatctgatttcttttgtttataagatactaaatgtatatttaatacatttacaatatagtaaatccacaaatactaaatgtatattttttcaattttgacagacacatactcctaggtaatctaaaattctattaagccacagaacattaacattacccccaaaaaagaggatcctgcctcttcgtagtcaatccctgctcctaccccatcctaaaggcaaaatccattgtgattactcttcagtatagatcagctttcacttgccctgaggagtcatatgtagggaataatatcatatacagtcttttgggcctaacatctcttgctgccgtgcgtttcagattcatctgtattgttctatatatgagtaaacttgcttcctttcactgttgtatgtcacagctcatttatcaatccctggaccagtgagtacttggaagagttctaacattttctattatgaataaaaatgctgtaacaactcttatacaattcttgtgggcattttttgtctttttgagaagttatcttgccttttgaccttaataaaaaaaaaaattctgtctccagggtccatcaggatcctccggctctcctggagatgcaggacccataggaccaccaggcttacaagtaagaccaacttaaaactagtgcatagttgcacatttttttaaccagtccatggatttgatgcagccctatgtgatttaggttctcttagagaaaggcagaagccatttctggaagattatacctaaacacgctgacttttttatccctccttgcctccctccctccctccctcctctctcttttagagacagagtctcatcatatagccctggctatcttggcactcacttttaaatgtttcaagaccaggttgtccttgaaattacaaagattcacctgattccaccgcctgagtgctaagattaaaggcacgttaccactccaggcttgaaacatgctcttgctaagagctatttgttgtccttgtttgttgtcattgttgcttccctaactgtccattctgtccccctaaagcttactggtatagctcaacatgaggtatagccaaaagaagacaaataacttgacacatctattggtgccttctgctccctcattatgtcaggcattgctaattaattaattataccaaccactatcatcattcttaggatacttccaaatttttctcaatgctacatttgggcaactgtacctacttgtttttctgatgtcaaaactatgtattactggtaaagggagaacatagctagccatctctggttctgggaaagccctgtccccagatcattttcatcaatacctaaatcctgctacttaatttactactgtgtttgaacttcaccaagtcaacttgaaacatccctaggatgttatgaggaataacacatgatatttttactaccttcacatgagtgtgactaccagactaatttggaagatgtcaaaggagaacaaaagaaacaatgagtgggaccgaaagatggcccaagggttaagagcacataccactcttgcagaggacccaagtttcattcctagcacccacatggggtagctgacaaccaccaactgcctgtaaaccccaggagccccgtgggatctaatcaccatcgcctagccttggtgggcaggcactacattcatgtgcacaaacccacactcgggtgcacacatgtacaaataattcaaaataaaattcttttcaaaaggaaccatgagaaatagcactaaaaaaccccactataacagagtcagtctgcatcagtgcattgagcagggagccagtgtatctctgccctctgtcatccaacatggccatggttttctttttgtttgtttgtttggttggttggttggttgattggttggttgggttttttctataattaagaaatactcattcctttcaatttcgttaatctagggtcccccaggcctccccggacttcccggtcctgaggtaagtatgctttgggagcatgtatgtcttgccattaagttctctgggttattttctttctttctttctttttttcataaagatactggtttacatctattttctagttaaaaaataaaactatcatattccaatttaagttgttggagcttattagtaattgattttctttttcttccctgtacccttgtgccccagggaaatatggggttaggtttccaaggagaaaaaggagtcaaggtaaatagattctgaatacacaatccacatcccacatgctccaataaatgtctgtggttactcatatacgcacacttgtggaaatggaattattttccaccttagaatatgacctttcctatctcacacaggtcccctatggcgtccattgagagctacatgttcgcatgccacacacatgggcttttggagtgtttttctttcaaaaatttttgtttccctgcttcctatgtctaaatctatattgcctcatttaaatatactctcttaaaatgtattctttcttcttcttccacataggtacttctctgcttgtttttgtacactattgcatgatattattttttgcttcctatcttccttctaaccttcttcccccttccccctcccctcctccctctacaagcctgcatacacacaaacatgcatacacatatttgatacctcttctctgcctctttttgtaatccctctttctctctcttgtaaactttcctttctatttgtgtctaatatgtgagtaaaggtgcccacaggaaagaaaaagaggatgtcggatcccaggagttggggttacaggcagttgtaagctgcttggtgtaggtgctgggaaatgaacacaggtccttggcaagagcagtatgtgctcttaactgagccatctctccaaagctttaatctctcttttaatattcacttcccttccttcccacctttgaaccaatcagatatcagggggaggatcgcataacgttttaagcaagtttacaattttgtgttgggacaaatccatagctccctttggtggcacacagccatatgcagcctatgggatgagtacaggttacacaaacccaatagagtcttatcactgttggcaggaggcagccattccctttgcccaaatctcacatggctcccttcttattacctctttgtgcatgatcatgcaactgtgaatctattttaactccccccccccttctcatccatctgccttttcccttcacaactcttgggcttagcattcttcttaatcccttaccaatgaaactttgttttttccttggcacaagggtaaagagaacagttcatttgtggattgcatccagaaacaagctgaccttttgcgaacattatttgtatgattatccttcattcaatggcctctttgattctacagggggatgttggcctccctggccctgcaggaccacctccatctactggggaactagaattcatgggattccccaaaggaaagaaaggttccaaggtagtaaatgtttactttaggaaaaattaatagaccttttcctgctaatactcaaattcaagtctaatattcaaagtaacctgagtcaattccaaaagaggagtaaggggtttttctttggaagggaaggtaaaacagctttcttctgtcctttatggaaagaattatgaaaattctgagggttttttttctggtgtgtagatagatattagtgacttgtatctgactattcatgtaggaattattttttgagtcttcaatttttaatctgccaaataacttgaaacaggcattatacacttgattttttttccctacaaactccagacctctcagtatttaaattgtctactaaatacatgaagtataaatcttccctttggagttttcacgttaaagaagttacttgccatcaaagatttagtctaaggccttaagtataagtcagtggtagagggcttgcacaaggacatggttgtattggagccctggaggaaaatagttgactttaaataccatgaatattgttaagaagcagcagtagatgatcgaatttgccttacctgaaccaccaaggattaaggttatatttcataatctgtccattaggataaaattatgtcgatgtttgcttttcaatggttctagtctgctgaaggccacagatatctttcaggggcctgcattcccttccttccttcctgagcttcctttaaattttgtgattatatttccatagtgaaggggcccaaatggaaacatatcaagtctcacttctttaattttgtttttgtggacaaccccagttccctctagctttatattgggaaaattcttgatttgggaccaatctaagtgtatgtaggatgattttatttttttaccccttcaatccatccctaaaccatagggggcttttcggtggcctatgtaagataaattagcagttcagagagagagagagacattagaatattatatgtctcttcccaaattttgattcttaacatctgtttgatgccattctcttctttgtagcctatatttttaaagcagcttcttcctccagaaatgcaacaactaaccatttttctatctcccagcctccctccccgccccccaggttgaaattatgtatcagtcattgaatttccatatgccaaggagctctctaaactaaggcatcccagcaagcatatagatctacaccactgtcctgtagtgtgatagtcacacttcctggctccctacagagcagtcaaagtagtttgaatgagcatctatccttcatgttcttgctttttgtggctactcattagcctttggttaatttttcagggtgagccagggcctccaggtttcccaggaatgagtggccctccaggtgtcccggtaagtcttaatttgtaaatatgcattcagggtctgattaaattaaaagcacagtatgcctaccaggaagatctcctcccatggttattgctgtgaatgttaccatcttcaccgaaggccttgaaagaaatagccttgttttctgatctaggggaacgtttaacctaactctccgtgaagttttttagatgctaacagcccaaactttagagttagaacagacctaggcttgacttctgggtcaagaatctcttaatacttctgaggacagcaatggactatatctgaagattaaatgagattgcccacactagagaaaagtttgtacacagctgacacttatcaaatgttcagtaaacagtatcttttctgagtaatcctatctttactttccgatctgcctttctagcttagatgcttacatgcaacagatgtcagaggcttctatgtgccaggttttctactgaactcagaggctataagagcaactaaataaaagttcctctctgtccttgagattacattctaatagaaaaccgataatgtggaaaatgagatgaatcaatagcaaaagcaggagttcatggcatggctcattgtatactgtttgccttgcattcccaggccctgggttctattcccaccagcacaaagaaaacaaagcaaaaacaagtccatacaatggtgatatataaaagatggaagagcactggactgagcacagggtccccaatgaaggagctagagaaaggagccaagaagatgaagggggtttgcagccccataggaggaacagcaatatgaactaaccagtaccccccagaggtccttgggactaaaccaccaaccaaagagtacacatggagggactcatggctccagctgcatatgtagcagaggatggcctagtcagtcatcaatgggaaaagaggcccttggtcctgtgaaggctctatgccccaatgtagggaaatgccagggccaggaagcaaatgtgggtgggttggtaagcagcaggaggggggaaggaatagggggttttcgaaggggaagccaggaaaggagacaacatttgaaatgtaaataatgtaaatatctaataaaaaagatagaagagggttgcagtgatggagtctagatgagaaaacacttgggagagagtggtcaacaagagcctctctgaaagaagtcctatataagctgagaactgtataatatgaagtaacaggtcatgtgaatattatataaagtgtttgtaggctggagggtaccataaataccaacacctgaggttgagttgctcagcacttcagaggcacagcaaggtgagtggtcagagcccagtatggtagcacataactatagtcccatcaattaggaggctgaggcagaaggatcaccatgatttcgaagaaaccatgcgcaacactgcaagaccatacctgaaaaatcgaaattaaatagccaagtggaaaggaaaggacaaactgaaagatgccaacaaacaagcagagactttggtgtcaggtcacagccagcttcagaagtcgattgtggcttttatttggagtgtcatgagaagctatttgtgtgtgtgtgtacacacctttgtttgtatgtacacattcatttatgtaaacatgtgtggaagcccaaatctggcactggatatcttcatagatggctcttcactttgtttattgaggcagggtctctagcagaaccacagctgtcctagtgatctctccttcctttatgttccgtatttctcaaaaataaggactttttgaaaacttgacaattagttattatataatagtaactgagcaggcagagatctgtgatcaccaatatagtttccaggttccttgtttacgtgagaacccaaatgaggccacagtattacatttggtcatctgttaacgtgtcacaaaatgtgttcagaagacgctgacaaaattttcaaagatttgggatagggactcgaagaaagtagaagaatccaagataacaagacctatccccccacctacctgcacactgggaataactgtggactctagtccttgctggtagtactttgaactacttggtgtctcactgagtgattaggaagtacagccagaggagccagtagtacagattgcttctagcagggttactgttaccccacagaaacaaaggggcatagagaatcatttgttctatgcctttgattttaattagttttgcagctagtgaatgagaaaggaagtgcgccctggtgtaggaggtagaacacccccaccttagactccactccagctctggaactttggaaaactgctgaaatattttctgtatgtgtgcaatacagcagcggttatagccagtcttctttctgaggcccaaattgcactgtgttgaagattttttttgtttgtttgtttttttacaaagctttgccatgtaacgatataatctgtagctatatatggctaccgagctcttaaaaggtggctcattcaaaatgagatgatttgtactgcaagcgaatacacactggatctcaaaaacaccagtggggaaagagtaatttgagacagttcctatttattgtggatttggataaccattaaaatcattatttcctttttaaaatacagctactggaaaattgcaaatatgatagtatatttgtatcacatgacatttttcaaggaggtttggagaaaaggattgcactagtctctgtggagtattttgtatagactctagtcacctggcaccatccctgggaagtgagtgagtgagtccaggttggcccctcttgcccggtagaggacaccattccctaagcagggaaagagccatctccaaagacacatagctacttagagagctgagactgccgctcattattgaattttgttgtttttgcttcatagttgtttttttttcttttctcagaatgaataagtgttgtttaatcatttttagccaattcttttttttccttttactgaaatggatttctttctcacataataagccctaattacaattccccttcccttcactcctccagtccctccccacattccttcccatttcgcttctattccctttttgtctcccattagaaaacaaacaggcttctaagacataataataaaatgtaataaaatagaataaaacaaacaaacaaaaagaaaacagtggaactgtacaaaaacacacacacacagagaagaaaaagagcttaagacagagatccactcattcacaaactcacaaatcccataaatataaaatcgctaagctagaagccataatatacacacagaggacctggtgcagaagtacaggccctgattccgttcagtattgttgaatgctggcagtatagaatttgttttctcataccatactgccccctgcagtccagttcactattgtcacccagaggaggtgtttgggctctaaagatttaatgatctctgctgctctgggatttgggattcactgactcacgctccctccctcctcttttctgtacttagacctgggagggtttcctccactgcagtatggacgcattccctttatgcctgtaaaagagactggctgactacaatatgcgatgagaaatcacagtactgttctcagcgcagtattttcaatgtttcacagttctggttgaaaaacagaaaccctagctggaaaaaaaaaaaagcatcaaagctgggaaatgcctctttttacatatcacatcgtattgcatagaacagaaaccaaggatgcggttctcagctcaccactacatggattcagtggttgacagtagctaaatcataaactgccttcactcataattctatctacctgcttactgtggatgctcgtgaatgccttactacgcctaacaggaaagttaccagaggaaagctgagagcacatgtgaactatcatgaggttttcaaacctaaagcctccatcacaccagctttccataaccaatgcttactgaaaaacaaggccctgtggaggacagaaatctcctgggaatccaaagtagtcccctttcttcccactgtagctggaatctttgcaggagataaaaatgcccaatctgacagatgtatgccttatctcttgcaccctcagcggttaagaaagaaaaaaaaaatccccaattttctggctttgtcccagcttcactcacttcacctcgcttgtctccagctgcatgctcacacttgtaggtccttccatggaggttgtcagaattatatacacaagtgccctttattcagggactatagacacataggggaagctaggatggcaatgttcagggagagatcagagatgaaactttcaaatcctgagggtttaagtagtcagtagatctgagggaattcctgagtagatggagctctctgagtctcctcagaaacaaaaagcagcaccaggaactggtgggatggggcagggggtctggaaagctaagctagtgcactaagaagtcttctgggctgtggaggagaaggaggacgggggacgctgtggcgggcctgtttgagtcaaggccaacagtaaagggtcaggtcccaggatatccatctagaacagcttgttcagcagggtctctaaacagtgcctccctgtgctgggaggcaagctgaaaccatggcccaggagcttgccaagtcatttatcttttattggctctaatatagagagaaagtggagagagaggaagacaagaaagaaaagaaaaggggggaaaggaaagaaatgaaaagaaaagaaaagaaaagaaaagaaaagaaaagaaaaggagagaggggagggagatttcctgttttcatttttcacatttatttctcttcatatttttcacaaactctggacctcaaaaaggtgaaaaagtacaggttcccccactctttgaagatgtaaaacacccccttctatttatactcctgggaaaaacagataggacatgttacagttgttaagcatgttgttgttattgttgttgttgttgttgtttaccatttgccatagttttattctttgtgtcactattattgcagttaattcagcaagtatttaccggaccactttgcacatgtgcagttggcaataacatgcttcacagggagacaggaacgaccataaggaaggttttctacttacaagactttcttacatttagtcttggtgactaaagagtttggggcagactagaacatttttggacaggtcagggaaggttattggattattcaaccttagagaccactagatatattccactaggtggcagcacaggttgtggggggttgttgttttgttttgtttttcaagtttttaggtttttcaagacaaggggttgtgtgtgtgtgtgtgtgtgtgtgtgtgtgtgtgtgtgtgtgtgtgtgtgtgtaacctgagccatcctggaactagttctgtagaccaggctggcctcgaatcacatctgcctgagtctgcctcctgagtgctgggattaaggacaagtgccaccatcatacctgtcttggtttctgatttgaaatatggaggtggaagaggctaagatttcaaagaagttgcatttttaaatcacattgttatttaacatttgagaatttcgtagaatatattttgattacattcattcccttcccccaactcctcccagctgcattcccaccttctactcatccaacttcatgttcttgtggctggccatggtggcgcacgcccttgatcccagcacttgggaggcagaggcagatgaatttctgagttcaaggccagccagaccagtcagagctatacagagaaactctgtctcaaaaaatcaaaaaaccaaaaaaaaaaaaaaaaaaaaaaaaaaaagtggatctggggagtccagactgggctgggtgaaatttattttaaattggacactgcatgagcactgtcttagttagggttttactgatgtgaacagacaccatgaccaaggcaactcttataaggacaaagtttgcttgccactggctttctggttcagaggcaggagcatggcagcatccaggcaggcatggtgcagaaggagctgagagttctacaacttcatctgaaagctgctggtggaagactgtcttctaggcagctaggatgaggatcttaagcccatgtccacagtgacacacctcctctaacaaggccacacctcctaatagtgccactctctgtgccaagcatatacaaaccatcacaagggctaaattctgtcaaggcagagaaagaaaaggagaagtagtaacagaagccctgtttgaactgtacccctcaaagataccctcccctcaatgaagaggcaatagaagacccacaattgattttttttaactcccaagtctacaaggagacacaggaatattcatccaggttgcagtacttgtagtaatacacagattatttaaaaagtagaaaaaggtacagatgtgtcctcataccagctgagtcaggtgacaccaaaggaaaagtgagagatatgccacatcaacagttagcatcttttgacaagcttatagttgagaaagctatatttcctccatttttttttttttttttttttttttttggtttttgagacagagtttctctgtatagccctggctgtcctggaactcactctgtagaccaggctggcctcgaactcagaaatccgcctgcctctgcctcctgagtgctgggactagaggcgtgcgccaccacgcccagcttcctcctttgctcttaaaatgggaataaatgcttcttgataaaaatctatgctccaataagtataattttaaacagcccaccaatgacttaagtttcccatgaaacactttattcactttggtaatgactatttctataacttgggggcctagatgttggctctggacccagacttgacaaggttctctctcagtctgcttcttaaatttcctgtttgtctctaggaagcccacaaatgaaatccatggctgtaagccctcagttattgtaagcaacgcaaaacgaactaattaccacttaacaagcccctttggtttactcctagcatgtgacaaggtacttaaaagtaccagtaaggagctgttgattgaactagctttcccatggaaaaaagatgctgtagttcttgtatgtaaatgtcttccttctagtagagattcccaaacatttagacaatcttccattgttttgtcagagtcaagttcctagatggcaaaatgcagctgcttctcatagaaagggctctggagtcatagaagacatagctttctcattgattcttatcctttctggaaattactttcctggtctgtaaaatcagtgtgggtgtttaggcacgttttttattccctttctgttagctcatgatactacaagagcatgcaacagtgttttagagaaaaaggagttacttctagaagcattcaatgaatagtctaaaaaacatagagcaatccctaaggaatcagtagagctagcttgaagttgcctccttcctttgaatggaaccagtcaaccggtgagggattgattgattgattgattgattgactaactaattgattcattggttgtgtgattgagatacagtcttgctaagtagctttggctttcctggcattcacaatgtagcccaaactggcctcagattcttcttttgccatctcacaatctttcttcctttgcctccaaagagctggaattacaagtatatgccaccacatcatcccaatgagaaaatgagtgttataatttgtgacttctcttttccttcaggaatttggatctactggagaaaaaggagaaaaggggattcttggtttgccaggacctagggtatgaacccagtgtcatttgcctgtgtttgtcaagtcccctaatctgtttcttttcttttttgaaagcgatgtagcactttcttgtcttcatattatttcttctttagtcctttgcttatgtaacttgatggctagctaagattcttttatttctcttctcaactttctggcaggcttgcccctccacttatccccattctcttgactgaatggcttccttgaataaggaatgatgtaaccactacacctaggtggctgcatagtctacttagcatttctgacattcatatataattttctcatgagctaaataatgatgcatatgctttcttgcttttattctattatgctctaagagaatacaggcaagaagtagaacaggaatagaagagagccaagtgtaatctttctaggacataaacaaatctggaaacttctagaacaaagtgaataatgtttggagtcagcactttctaaaattatcttattttgagtggagacataattatcattccttctgatttttagctctcagaaactgataccttggattataagaaattggtcaacttttattttacataagcatgttgtagaaaattgtgcttttattttgtctaagaggatattaagtctctttcagtatttagcaatacctcattgctctgccatttctttatctactatcccttatcttttgtcttgaaaaaactcataagcactgacagagaatatgtttgtggtagcagacaagaggtcgcctgatgctctatctagaatcctctgacttggaactgatacagctaagtataataccatccaatccctctactaagggccttctgatatttctgtttacttagctctttaaaaatgttccaggaagctattcatcctagtaaaataatgctcagaaagaagtcatttaagccaagtctaggacgattttcttacctaggtttagttactatgcataactttgttgtgtgagcctggcaggttttgttccctagtttgatctattcatctttctaaggtgtggttcttcgattcacagggtcccatgggttcagaaggaatacaaggccatccagggagacaggtattttgagtaacatccataaagccttgatatacaaaatctaatcaaaaggtcattttgctttccttaacctggccaaatggaaatattgcttataatgcaaatcatccactctttaataacataattttataattctagggactctcttttttgttgttattttgttgtttttcacccaaaaggatagataaccactgttaggttacattttctgttttgccatgccatagtacagtaatgtatggtagcatgttttcaagggctagcaaggctagcctgcttgtacctacactccattgactcttgtgcactttaatatgcaagttgactaccagatgctatattgtcatctggagaaatttacaaagctgtacatactctgaatgactgagaaatccctgtacaaattgccctagcccaaaccacaggccagcagacattatgtactttatgtggacttggtaatacctatgtttctattacagggaaagaaggggacttcaggttttcctgggattaacgggttcccaggaattaaggtaatatcattgggaagtacaactcccagatttgagaagtgaaaaaatgagtgattcctataaatgcctacttatgaaatagagtatttttaatatcttgatgttttagatgtcatcttattttcaaaagaaatgcatataccccatgctgtacataaacctggtaaccattccccagatgtcaccaacacttagcatttaaaatcctctactgacaatgcatcctcttattgcttaccttaacacccactctgggtatttctctgaataagattttagttgctgagtctgtatttgcggagattaggactctttcgactcccttgccattattcacacaagggtagtagcctttagaatcttgggcctgctgagagcagaagaaaaagattgacattcagttttctccttagctattttatctgtgttgtgatacatttcccaggtccagaaacagactgtcttgcagtggtgttgcaaaacaaaactgagtgcactagttcttggcaaatttgcagatcaaatttgcagatctggctaccttatgttaccttcatctttgatttattgttcttagaagttaacctctggaaatcaggagtcaaggagcaaaggactttctacttttctggggtcttgctttgaaggcaagtagattttaggtgatggagtcaagacatcttttgtgttcaatttatttaatattttcagggtgaaaagggagacattggtgttcgaggcccagacagtttcactgatgcagatggcgctgtgatctcaggtgcaattctttgttgatttgattggagaagaaaagagaaagtgttcaattctgtatctcctataattgttgaaaagatacattgtcagccactggattgactggatttctgacagtatcaagggccactcacaggtcctgaatttactgaatgaatgggattacaaattcttaagcagacaagccaagtcaagcctccgtttgtgtgtgtgtgtgtgtgtgtgtgtgtgtgtgtgtgtgtgtgtgtgtgtgtgtgtgttgatccatcaagatgagattttggactttcctaagcctgaattaagttggcagaaaggttcccctggcaatgcttagagagggattgatatcctcctcagctgggttgcctttagcctaagactatagagtatgcagggtttcatgtagataatcccaagcaggctgctgatctagttgctaagagacctgagaaggatgatacttagaaagtttgttcttcagtccttatcctagtcactgggtatggtctactcttcctttctgcctctaccaaagatctaaacactcaatgttgataacagctttgtgagctctactcccaggaaacctgtggcaataagtgtttgctaaccatcttaatctcaacagtagacatttaaggcaagaacagtagaagaaccttcctagtactttctaggtcttgtcagaaaagtaaggctctaacaagaccaggtttgaggtactaatagtaacttgctatgatgatttgtgtttgtaattccagaccttggaagtctgaaacaggaggaaagtaaattcaaggattctatgagatccagttaaaaagtaaaagagtagcagagccttctctctggtcaattaagaccattagcatctcttatcaggcattttgcagcaagtgtgatccactatttactccttttttcactgtaatgtcaggttatcctggagaccctggtgtgctgggccttccaggccttagaggagatgaaggcgtccaaggccaacgtggcccttctggaacccctggcctcccatcattaacaggtgaaacagactaatccactctctgcattgaatagtctgtactctaaatcctagcatcttcctctgtaactgggaatccaataatatgtctagccaaggtcaaaagaaagatagactggtcagtaaattctccaatgactagctcaaagctagtgtatgtgtagagagggcctaggtaagcagcttcccttgagataaatgaggatcacagatggaaagacaattccagagtgccattgaggctggaagtaactagagatctgggtggggtggttgaagccctctcactcttcactggatatgccatctaatcttatacttgccaagagtttttaacagacgagaagctggccatgcctgaatcctcaaggtggctactaaaagccttcatggggcgggggtgggggtggggactaaaggtatagctcagttgaagataattccttggcttgtgcaaagcaatgggttctattctcaacatgagacagttagaatatagagatatggatgttatactagatagatagttagatagatagatagatagatagatagatagatagatagtagatagatgatagatagtagatagatagatgatagataagataggataggagaggagaggataggtctgtacccaggccctcctatggacttagatgtagcacaaaatgcccccagcatcctatggatgatacccttgaaccacacaatgcaggagctgtaagccattccatatggcagagaaagagcatgccagaatctagaagacagagctgtccctagtctaaaccctcagatgtggatctagtaacatcactagtctctaaattccttagagaggagcttctgtaaggatatttgtgtttctaaggcagccattcataggagacccagctggacccagcacctaagtagaacaaatggaacagtgagagactggaaacctagctttccctcacatgttaacaaccacagtttctcaggcagttaggctaactgatccccaaaaactttcctaactctcatgaaagagaagagcaattggtttcccaaattcttcccttgtgttcttttgtaaacacactgctgatcagaatctacccaaatagtagggtgctatggtgagcatttttgtgtgggcttatccttccaggtcttccaggtgccctagggcctcagggatttcctggcctgaaaggagaccaaggaaactcaggacgtaccacctttggagaagctggcctacctggcagggttggtttaccaggtttaccaggcctgccaggcccatcaggcccacctggtaagttattccttctttaaaaaaaatttttgagacagttatgatctagaaccactctgatttttaggggttccctcacaggagaaacagttcagccatgatagctaattgcagtgggacagtgtatcaattagaggtttagtccattatcataatgcaaggaagaatggcagcacccctccagacaaggtgctagagaagaagcccggagttctgcaacctgatccaactgcagccaggaaaaagactgtctgatgggcagcttagaaggaggatatttttttgcatagggtttagcctgagcataggatctcaaagcctatgtgacacacttcctccaacaaggccacacctcttactatagtgtcatttcccatgggccaagcttattccaaccaccacaggcagcaatgagaagtcctacttcatctgtgttggcttcacctttactgacagcaacagcactggagtgtgcatttggttacaagatgaccaaggtggcaccctgatgagggagcaagcactagcttctgtactcatcatccttctgtcgtacacagctcttagtgcccacagcaccccctgcaccactctctacccgtcccactacatacccccctcaccaccaggactttggcttaccaggttctagggaagcagaactggattttctgggtttgctgtactcaacagagttacaggtaggtgggctgagaatctgaaggaggagaagctatgcctagatcctcaaggtatctgctaaaatcctttatgaggctagatatgtagtccagtttgataaagttttcttggcatgtgcaaggcaatgagttctattcccagaatgagatagatagatagatagatagatagatagatagatagatataaaatatgcatagataatagatatgcttatctacgtaggtgggattctgggttgtgagaaaaaggctagaagtattgcccagtttatttgcagtctaatcctctgacaactgctactggcacctgctccctctttttcccagaggaaactttctgggatagagactggcactgctgagttattgagttactatgttcatctctgagtgcccagaatctactacagtgtgtggaacataacagtcatcattctgctagtagagtgaatgaagccaaatgagagttcttccctgcagacttggcaggaatcttaggctgggatttttttttccctcctactctactctgtgtgttgagcttcaaggacccaagtcttcaagattaaggtgagtacttaggcttacatcaacctctaaccttttgcattctcttaaactctgcaggtcgcacatttgagactggacatctgtccaacatagagcctgggttccctggtctccaaggagaacaaggtccaaaaggacatcaaggcctcaaaggagtaaaaggtcattttgtttgtctcctcccccccccccacccccccccccacacaaatccctagagaggctttaaagggatctatcacagcaatagccttgagaatctgaatgtaacctcttgagaggttatggtataagactgttagaagtgctctaattagggctctcagaatgaagctggcaatggaggtcacacaggacaaaaagaagttttccacccctcaagcctactgaagctattgttagcatctcagggtgctgaccatcacctctaatcccaatttgcaagactttagctaaacactgcttcccaacaccattaatgtgaggactctatgtaggttaagagtgaggcatagaaaaagccacctggctccaataaagtgaacagggtcctggcaagctgccttataaaccagtatcacaagtgctttatccaaattgactatgcctattccaaatgcttgggatcagaaacgcttcagaattagtagtctttggactttgaaatatttacatagactttcccagataatcattcctaatatgaaaaaatccaaaatctcccttgcttaggatttcagagcatttgtgctcagtctttctttactagtctgaagaacaggaaatgctctcagagtttccaagatctcagttttctaagagtaagaagagatcctttggaatcagaggggaatgcagccatccacagttgtcacttctcactctggagacaatgctcatgcaatctctgtagattgttaggttgcgtacttatgactcctttgcctatcttccaaagtgctttgctgtaactgagttggatggtgcacacttgtaatcaatcctgctagaagcagaaggatcagaaattcaaggtcatcctcagctacatgagtttgaggccaaccagcacacatgagacctgttttgttttttttttaatgcacttctctgaaactcatatcatcaagtatatacataagtacatgtatagaattagattctagcttccaagttacctaagtagcaatttatggtcctcagcatgtgactcactaatagccggacctcatctcagactagtaaaaacagactcagtaacacagatgccttctgatggcactgagcttggtctgagtctcggaaagctgtctgatttccacccaagggaggctaactaagccactcttttccatgagtttatttgatgtagtctgtttttccttcaggagactctggtttttgtgcttgtgaaggtggtgcccccaacattggaccacatggggaaccaggtctgcctgggatacaaggtcccattggtctacagggttttaaggggactaaaggagatccaggctcaaggggagcatctggtcctgcagggacgccagtaagtcttccgtaaggtctttggcacagagggaggaatggaggatttcaagtgttcttcgctccctatcaaccactttcctaagacacatgaaacaaagaggagtaaaacaaatctgtgacaacaatctcagggagatttttgcttaaactcttgcagttagtcaaataaattcttgtttacccttggcaagtaacaaattgcagtgttaatcgggtacacaagaaactccctcaacaatggaaaagctacaagcactcatttttaagtctaagctctaattggaaattgtgttgctggaggaaatggaggaaaatttttcacagggagcaatttgagagcaacttagaaaatgaacaaaaccaaaacaaatctatgggcttttgatgtgtcaacatgaagaaatctgaccagaaggtctctaaagtctctttgtttccctccttcctttcctcatgcctgactgggtgatgctgcttaggggttaacataaagctcagtcctcatagatttcaaaatttagaaaagatacaggaaatgtgaagtaattacccaagacagcaacataatcacatgcccagaagagtgttaacaatatcctcaaagtacctgttttaggtcatatctttgctaagctatgaaggctgtacctcccgattattgtcttttgtttcattgtcaggggctatttggacctagaggtcagactggcctcaaaggaaagaaaggagaaccaactgtcagtagaggatcaaaaatgtcaggggacaaaggtgaccctggtcctcagggtaccccaggtttggcaggaactccgggcaaggatggaagaccaggtttaccaggcctcccaggcattcaggtaaatggatcattcttggatggttagccctatcaaccaccctactggacttagggacaatctgctggttatcacctcatggaataagatagactagggaacttgagtcccccgaaatgttgactcaatgctttattttctataaatatgacatttttttcccagaatacttattgataagtgctaggaagagttgaacacgttcatttaaaacaactcagcttctcaatagctccttcctccaagatcaacagttgttcattccctgctttcttcccctagaccagcagttctcaaccttcctaatgctgacaaatctttaatacagttagttcctcatgttgtggtggtccccagccatagagttatttccattgctactttatagctgtaatttggctactgttatgaactgtaatgtaaatatctgagctgtaagtactctgagggtcataacccacagattgagaaccactgacttagccccatctagaaccttttataaagctagattatccagagttgataagatccgttttctctaagaaaattcagaggttgatcaataaacaactagagtgatggagaattttcacaaaacattgttcactaactatctctttcctgtggttagaagccttttcagataagtcttaaaatgatcttttgtcttctttttctttgttctctagggagatggtgggtctggcttcccaggtgaaagagggttaccaggacttcctggtgaaaaaggccatgatggtccaattggaccaccaggaattgggctgccaggacctcctgggccccgtggacttcctggagataaaggagtagatgggttaccagggcaacaaggcctccgtggagctcaaggtgagtcatgtaatcagatagttttggacttggaaaatcaacctttgtaaaatgcctctgactcatattatgaaatgcgtcataaaaaaaaaagagagatctggctagctgtaatcactccagtcaatcctcaagagttttaaaataggaaatggatcataagtgttatggtaagttcagaaggtagaacaatgtggatttcagctctgcttaatgaggaccctgctacttgagctgtctgaaatgtcacagagctatctagacactttatgagctcatagtccatagaaaaattcaaggagagggtggatgactgtgtttctaatcaaagtagtttgtggagagtttgataaatagtcctctaagttgtatgatcagcagacaaaaatgctttcctatctgacagaatctcagattggtcagagattctaacctaatctttatatgatacctaacttcctccctttaaataaattattttcccacttggcattttgagaatataataagcaacactcctgattgtatattatgaaggtcccatactataacttgtattttgtgcagtcagtacactccttcattgtttccagtagtgacattacacttcttactattagtggcatcacacttgtaattgtcatcaaagtttaaaaaaattgaggttatctattctcacttggaaatgcctcccattatttcctttatcttcttgctagtaagttctcatgatcccatacttagtttatcaaatacctatgcgcttttggaaaagaaggatggatggatgggcaaaagaaatttcctaagtagtttctcttctattccttgctgagtttccccaattaaattatacttatacacattgtagacgattaaataccttttgccatctagccttcctttgacttctacatgttgttattattgaaattatgcccacttctactagtggtttcccctttaacaacgtttcaaagtctctagcttctaaagatgatgatacatcttactctcacaacctgccaacagagtagaacattccttcttgcagaagaaaagcccttcctaataaccttgaatgattaagaaataaaaaataagatattatatcttatgtgttcatattttaaaatctatcttgatataataatcatgatggcataggctaatactgcattcaagattcttgaaaccaaagcccttgaacaagtttgggaagcattctacttccctaggccatatcttatcaaacaatattggttttcctttgagaacttctggtttcaacaatagatttacttctactgtattcctcagggatattagtcatgtattttctattgctcttcagctgttgatggatcaatcattctaggtcagcccattttaaaggcaaccagattctaaatttagttacagtgcatgatacctataaacttgtacatcctcaagtcttttggatattatcaatgttctatttcttggtttgagatgaggctgcatcaatgggaagaaacctatgggatcatttctatctcaaatattactagttcctgtacacagaaagttctcaggaagacagagctagtgagcctagcctggaaggaaccttatatagaaaaatccactttttgaagtacctgattttcaaacaaatactttatttagattttgtgttggggtgttatatggttggttggttggttggttggttggttggttggttggttggttggttggtttgagacagggtctctctacatggtcctgggtgtcctggaactcagtattacagactgggctgaccttgaactcacagagatcagcctgcctccacctcctgagtactgcgactaaatgtttataccactccacacagaaaatacttcatttagaatgttaccttgttttttctctatagaagctgaatataactcactaaaaatagtattctttccaatcatttaaacataaattttgaggcttctagtttatgtgttatagccatttctgttagcacaaaaagtaagatgttgttcctaaatgttgcctacaccttccagtggtaacccagtattaaacatctccattggtagtgaagggcatgtagtcaatcagaagctcttcagcccagtgatgtgaattattacaaacttgggtacattgatagcttacggtccccatagaggctatggctccatcttctcaacgtaatctatcattcaagttatttctccaagtgacttctgtatacttgatcgtgtatgagtaccaacactccactcaatcctcacgattgaatgtggttgacaggcatatctgggctgtacacaagacctcccttaggattcagccaacatgtcttggtttcatttttttctttccttgattggtctaggtgattattgctgtagcaggggggaatattatttacctattcacctttgtctctgaccctcagagtgtcttaaactacattgcacttttttttttcttttgaggcagggtagttgtgaggctgggatgcagaggttgccactggcaactgatactactttaatggttctttagcacatactcctgggaactatagaaatgggtatgcagactctgagaggagctgatttcctttatctcacatgttgatggttacccatctcttaactaattatattctctgaacttatggggtataacttgctttccaagatgtatgtgcaaggagtcaaataattctgatctctattatttggtctcagaacaaatagaaaggatagacttgaaaactagagttgctttatattctaaagatgaattttggcattaatggtgaaaaatctgaataatgtggtcatctgttgcacttctaaagtataatacggctagagctgacttctgctttattgagagtggtctgaattcagaaatgggaatcccaaaacatggcaataagtgataaaaaccagatctggtacaatgtaaaatctttaaatttcccaccactttaaacccctccttgtgaaatacaatacagtgtagtctatgtccaaattatgagggcataattttttcctttcattaaaaaactctgggccccagaagaatataggattggagtctctccctctctctccttccttccttccttccttccttccttccttccttcctcccccacccccatctctctctcagtgaagcacctcaccaaaaggtgcctttcaatgccacacatttgtacaatgggcaaataactctgagaaacagttttgccacctcagtgtctggcataacggaggtgggtgtgacgacacatgcaggaggattcatgcttcaggccatctttagacctgtgggaatatggccacaggagcacaatgactagcaggcaggaagctggggagttgacttacaggagcgcctctgaagctctctccttaaggaaggtaagacctgccattcaccgagcatgcagcaggatggcaggcactacatcaagtgcctctgtcttggtctcacacacttctcacagatgccactggacacacaaggctcagagaccataagttttccccacacaggtgtattataacagaagtaagttctgttcggctcctaggtccagtataaccagtacattatactgttcaagtctcgatgttgacttagaactaaagcaagtgatttttttttcaaagcaagatttcatattagaaagcaggagtgagtggaaggaggagtggcagctacttgaatgagcagtctgaatcagaggctttatgcacagttttcaaaaataatctgaggctgtgctggttacttttagagccatgtgtttggttttttgtttgtttattttttaatacaaacaaatgctacagagttttattggaactgttggctctgtggtttaagacagaccttggtggattgttctaatagaacaggctaattttagttagcatagcacttgaggaagtccatatgtacacagtctgtcactggtagtttattaaacttcccatctgtgatcctatagactctttatttgcagtatgaatgagcaaagaatttcccacagaaaagactgtgcatgctaatttcaacattttaaatactaagattgactacttctattcctttagtagcagagtttatagtttccaataatgatctgaggagtcataatttgtcatgactaggggtcttatgtgtttccctagtttagatatacacatatctgaacaaggatggccaatacatttcagtagactcaaaatgaactgcttttaaaaagctccatggtttggggaaaacctccttgcaagaaaagtgttagggctagagttagtggtttcaagcgttgtctcctctcccagaagactgggcatctagtcccagcacctacatggaggctcacaaccatctatgactccagttccaggagattcaacaccttcttatggcttccttgggcaccagtcacacatgtggtacacagacacacatgcacgcaaaatgtccacatgcatgcaaatttaaaaataaaaaagttcagatgtgaactctaattgttatggcttcaaattatccactctaataatacagcatcatggacccttagtgctaaaacccaagtgcccacgctagagagagagtttatctaagggactggtgaacggaaaattgctgctcactgctgttcctgtgcaggccacctctaggagtacttgttaggtaacaccctctgcctagatgactgcttgtctgtcaggcaccagcggttcaataagtaatattctggaaccctgaacactcagaacaaagataagcatttgcactggtattgtctcccaaaagcttctcatgtcaagctttctgtgtgtcctactagctgctgggtggggagaatacaattttccactaaatagaatggggggggggggaccatgtaaggggaactcttctctgacttgctgagctcacagttccacatgttatcatttccaggagtcaccttgccttgtatcattcctgggtcatatggtccatcaggatttcctggagctcctggattcccaggtatggaatgtggccagagaaagtgagcacactttaagggcttttaatccaaggaagcaagaatgccaatagcacatgagagtcccactgatggattcctcagcaactgaggtaatggcttacagagagcgtgttatgaggaaatgagactcgaggaagccagcaagagagtagactacttgatcagacatcataaatctaacttatccatgctagcgttcctttctactcactatacacatttggggtttcaggctctaagggagctcggggcctccctggaattccaggcaagcctggcactcacggaagcaaaggagggcctgggagtccagggttaatgcatctcccaggattgccaggtaaggaaaagggtcatcaacttcctcctgtgttatgtttggactgttttcattctccatcgaggactgtaagctaggtctgctccctggattagccgagatggtttgaatttacttccaagcaaaaatgccatagagcaaagaacagaccgtggcaagaaaccaatggaagcaatcccttaagtctcagataaggaaactgatactttacaaagccactagtgacaaagccaggaggctgcagttgtctgcttaccactccagtgataatatcctagataaacttcttagaggccaaagaaggaagttcacaacagtccaaaaaatgctacccatttcttttccttgccagagttgttccaacctgagctccacaggactgcagtgtaccactggtcctccagctgcattccctggctcagcacctacatcacctgggaacctgatagacatacaaattctccacctgttcacaatagctagtgagcagagactttaggagagagccagtaatctgtgtgttctgaaccaccattgccctagtagtgtttgagtcttatctggatgtatcattgcttcatttctttctactctcttctgcccactcaagaagaggaaggccatggcagcaaaaggtttaaaactgtaggagatactgagctttggccaaaagacttggtgtgactgtgttcttagcaaccattgagccccaggaacagaaaagaaagctgctgagctgtacctattcctagtctcaccaaactagagcctccttccactcgtgtggtgtagtccctacttctgtacaagccctccatggagtgaagatcactaatcatgattaatatatgggctttgtattagagaaatcggtctcagatgtctaccgagatagcttggttctaagcatccatgttctttttaatttttgcctctttacatttagggtttcctggagttcgtggggagaagggattacctgggtttcctgggcttcctggaaaagatggctaccctgggaaagctggcagtccagggttaccaggtttcaagggagctgctggtgacatatttggtgctgaaaatggtgcttcgggggagcaaggcctacagggattgccaggggacaaaggatttcctggagactctggccttccaggacccaagggtgactcactctacttgaccccttacttagcattatacagacagcattctagtaactgctgtctttgcatggatatgtgtgtaaaatgcatgtctggatctggtatggttaattagggagcaaaaatggcattctattctgtgtctctttggggggcgggaggaatttccttatgtggttgcagtccattttccttttgtagaaattccaagaatagctataaccaatagtcacatttcttataatgctgttgttgagagaagacaatgtcatctgaggtgaatcctggaccaagcccttctattggaagatggtttgatgacccagcacctccctgttaaccagactataaacatctgccacctcctttttcttaggtttgaatgggaaacctggtatgctaggccccaagggtgagcggggcaaccctggaacatcaggaccaccaggacagccaggaccctcagggtctactgacccatttggcatcaagggcacatctggattcccaggagcaccaggccttccaggcatctcaggtaaatccattgaaggaagaatcctgacttggcagggccttacttagacaaaggcaccccggggactaagagtggcagtatgatatgctcagcacctaggatatttgactttcctaatctctctagtttcaaatcccagatcatcctggctgggccagaccagaacacattgctactgtttaacttctgatccatgacaacaaatctctgtcacctcccttttccagggcctcctacatccttttggtgtttttggcctgctgctggcctttttctattaaagaaatcaccctgtgttgaatggtgttaaaccctcgctgtggctatgttaagcctgctttgagctacagagaaactggagctgattgtgacctcttccctcccccaccagtagcctgcctgtcaggagaaaatgcctctgagggtccataggcaaatagtggctttcactaagcaatgaggactgacacccactggtttcagcctaacatttgcagttcacctttttgtttgtttgtttgtttgtttgtttgtttataccatcatccttactctgacacctagactgcatcactgaccaagtgactgaagctgggttatttgcagagctgttaatatcccttttatttcctctatcctgtttctggggccttcatataagttgctgaggtgaaggttaaaaacaacaacaacaacagcccacaagctcactgactaagactccccatggggaattgtgtgattgtctgctataacaaaccttgcttacaaggccagagatccctgaaccgctgctataaggtttgttcccactgcattcccttctcctgttgcagacttatcctcattgcttcctattagattcctgcggctcacagctacttgatgcttttcatttcatggaaagctaagtcagccattcattgaggtccttgggaacccaaatacttctgtcctcagtgatgtaagcctttggatttttcatttccttgctttgtacctggacattcaacttcggcagcagctcaggaggttaatcccattgaccaacttcaagccctggtgaaagaagactcagaatacctaagagaccaaatgggccttgggggtttctacaatacttggcactagggggtctttcaaacctaatgccaaagaactggctgatttaactgcttgtttgagggattaaaagggcaaccctagatgcaagactccctggaaagccagaacaacagttcagatttaacctctatttcatgaattggctcaggaaacaaccattggaacttgattcagggttgaagtcccagggaaactagagcccacttgccaccctggcttcccagagctccatttagaggctcctctgtgaaccacattcataaaggaagaagttataattacaaggtacttgcttttcctacccaccactgtgccatgctggaagtgatgagcatttagggaggtgctctgggtggtaggtactaatgctctgaccaactcagcaccaggcttcttggcatctctttttaggtagtgttaaaggaccgtggacaaacccctcctagccagccaaagagaacctctagaaataaacagtggcccaaacctgaccagagcctgactaagctgacctgtgtcctcttctataaccattcagggcaccctggaaagaaaggtcaaagaggagacataggtcagcctggatcaactggaaaaagaggtctacctgggataaaaggccttcctggtcctcaagggtcacctggcttcctggggagcccaggtttgtcaggcgtcactgggttgccgggcatcgaaggccaaaagggtaagtgaaataattaggaagaccagtaaagtagtcagggtttacccaaagggagtgtgccacaactgcccaacttgcctcctcccctcttctctgcccaggaatagaaggtaggcaggggtttggggggggcaaggctaatactaaaggaaacctgtcacctaacatgaatcactcaacctgcttgctgtgtggaacaatgggctgatcaacagaaaaggccagctacacatagatcactcagtctgacacataccaaggagcctgacaactctcacttcccgtgactgacacagcagtggttaggtgtatggcatctgtgtttcaaataggtgaaaaaatggctagtctcagagcagcacacacagctggttagtacaaagaggcaagatcacacactcatctcttccccaactacaactaggtgtttcttttctgtgcccctacacgcattctgaacttaatgaattcaagcagaagtgcccacgtcttcatttctgtctggtgttcagtgctatgtggctgtttggaggaatcctagaataggtaataactaacatgcttggtaaagactcagactttggagttagagaaacctatgttcaattccttcctcttcaccatcttagctctgtaacattgtacaagcaattcaacctttctgtgcttccttttctttacttgtatatacaatggaaatgataatgaaagaaagtcttacttttcaacaggtgaaaaggggtcctctggaccagtaggatttcctgggttacctggtcttcctggtcttcctggagctgatggattaaagggattttctgggtcatttggaaaggtgggacaacctggacagactggtacttccggagaaaaaggtaagggggtatggggagacagaggcagagagacaaacagagacacatacacacacacacagagagagagagagagagagagagagagagagagacagagagagagacagagagagacagagagagagacagagagagataaagagagagagatttcaagacaaccactttgtttttcaatatgcattttgcttgtcaacttggtcattcatctgatgaatgccacatattaggcaaaactttggacttccaaattaagtcctttgagaccaaaaggctactcactttagagtcaacagtacatgatatggactatgtgacaaccgcaaaagaaaatcatagcataaatagtttttaagaaggaaaagagttatattatatatatatattagttatatatattagttcttggtttcagaggagtccattggtgatcagttgaccttgttgattttgaacgggtggtggcccagtgtatcatgggacagagcttccttcatggcagctgggaaaacaaaaccaagaagatacattcaataacttgcctttttcccactgagctccacacataaaaggcccctcatctcccaatgaagtcagtgcctgagaatcaagtctttaccaaccaaatctttggggaacacttactcaaattaaaatggagccctccacaatatactctttccttgaaagagaatttagagtagggcctaaagttattggtgactttgggtctggagaaggagagagcagactcagaaatgcaaagttagaggctggggtgtgaaagaggacaaaaaggtctcgaaactcggtgtgtgtgggaagaaacaatacgaaaggtcatatttgtgtgtaactttgtgcataaactgtgactttgtgtgtaaactgtcactctcctgatgactgtctgatctgccttccttcaggagacagaggggatccagggccagttggcatatctagtccaagacctccaatgctaaacctttggttcaaaggagaaaaaggctctcgaggttctgctggatcggatggatttcctgggcccagaggtgctgaggcaggggatatttgggagtgattctcatgcaaggatttgtttatagccatcattggtttccttcccaagaaaagcaaagctcagacccaggaacagcagtatgggaacaacaatgaggttcaaggaggctgtctttcttcttcctaaatttcccttgctcgttgagactgactcatactattgtagaactgaaggttttggcccatagtctggtacccctgaaatagcctggtaggtagcaaggcatagatactgattgcccaatactagagctgagatgataccaatggaaccactttccaccaccactacccccaagccagcctctgccttagctaagagcacatctggactatgattttgagcacctgcacctagacaaataggtcttttcttgcctagcctttttctaatagattttgcttctttcccaggtgacaaaggagagcctggcatcccagggttaccaggtccacctggagctactggacaaaccaataccatcaaagggctcaatgggaggccaggttctcctggatctatgggaagaaggggattacctggcctgaaggggtctcttgggattgcaggtttcccaggaatgccagggaaaagcgtaagtttatacagattcttgtttttttaccataactgaacctttaaagcatgggcacatgtcccacgtccccatgcccaacccctgtcctcaagataacctcaaagtgcttgctctccatgtgtatatgacacagcttcctacctcagtattccctcctttatgtctttgttccccttattgatcccacgtggcaaagcttcctgcctacttcctgcagtctccaacacatctctgcctgctcttaaaggcaccatctcatcatgagttgctgggctcctgctaggttggcacttttcactgctcatatcaaagtgctcctagttggatcttcagagaatctcacttcttcagtgagatttctgggacttaaaaatagccgtttaagtcttaatttgcaccccatggccagcaccccacagcccacattaagctggacatattgtaaaactgtacagaccgtggagaaggttgttaaggcaaggtcttgctatgttatcaagggaaaccttgacctcataatactcctgcctaacctttgcaaattacaggattagagagaggtatgcaccaccacacccaataagaaataagtgtagggtttttgtttttacttaggattaaatatatagcctgaaacattctaggcaagtactcactctattgtaggcttagatttttcaaaacttacttttaataggggttcttaaatgttttaccctcccttctagcccatcacccaccagaggttgtggaaaagaaaagttattaggatatgggagaagtgaacctgttttcaaattgttttttggagcaaatccaatctgtgttgtcaggatatcagcagctcagttcacacaaatcagcagcggcagctccatccactctcaaacaccattcacaattcagaaacagcaggtagagccaggaaaagctgcaagactctgctgtatgctattgagaagaagttccttggggcaatttcaatctccaattgtcaggatactagcagtctagttcagtagtgtcaggatagcaaacaggaatcagcagtactggcacaatgtagaagaaaccgccaggctaccaccaaatcagcaggagtcagcaggagtgatcagaaccagcagttctctgcagtgcctctcttaaggaaggggaagatccgcaaagaagaagacaaaagacaacaaagcactggaaagttagttgtgcaagcccaccctcactgttccttgagtcctatttatactccctccaaacctccaatgggtcttgcctcagaaaaataccacgtgagtctgtattagctgacatattcagaaacttccacttcactctgccaatcagccatgagtccacagaagtggcaagaagctgccagaacaccaccagaagtttttgggtgcttttctctctgtggagtcatgacaaatgatgaccaataaacaatgaatggcaaggcgtaccaatatcatccagcattgtccactgtctgttgggttatattccttctaaataccacacgccctttcacctgtgtgccccagcaaatatcatttgacataactgacttttcaaagaaaccagaagtttccacttcactctatcactgagctatatctttcagcctagcattcagagatttcttgatagtttaataggaaggtacttgaagtaccacaggggacaagtagcaaagaatcaagtctagattatctggtcttttaaaaggcaggataggggctatagagatagctcagtggttaaaagtgcttgctgctctaccagaggacttgagtttggttcttagcacttacaacaacctacagctccaggcgatccaaagcattcttaggccatgagcacatgcacatgtgatgctctcccccctcctccctcccgctctcactccctccttcttctccctcttcctttccttttacctttctctctcactcttactctttctcacatacatgtagacataaatttctctcaacctactttaataaggattcaacctctccttgagctcgctacccaccagaggtagcagaaaagaaaagttatcaggacatggataagtagacctgttaagaaatagttccttgggggtgagtccgatcttcattgtcagtgtatcagcaatccagtcctctagcaaaacaccaacataaatgagcagtggcagtccagttcattcggcagtcaccactcataaatcagcagctgcagaccagttcactcagcagataccacacaaaaatcagcaagggcagttcaatccagaagaaactgcaaggctcaccaaccagcctgagtccaccatggaagtggcaagaagccataggatcctcatgagaagtcctttggggagcttctctctgtgatgtcaccccaagtggagctcagcaatggaacctaaagtgaaccaatacgtgcatatccttagcgaagaatagtgaagtggagcaaatcgaaggaaggttcgagctcccactgtctgtggggtcagatttattatattccttctaaacatcatccatcctttcacgtgcttgctatagcaaaaacatcctttcacccatgtctgcttcagcaaaacatcctttcagctgtgtgccccagtaagacatcatttgacgtaactggtttttcaacgaaaccagaagtttccacttcacactcacgtgcaaatgaaaattttagaacataaatcttaaaaggcagagtaaactagagtaggtttgacacagatggacttgaatttgaatgtcagacacctccattactcatctgctctgtgatcttgtgtaccttgcttaattaacatcactgagccttattgttttcttcctattctttttgttttttaaagtagactaatatccaaacttttttggacagtagtgaaggttaagtgagatgagacatgcaaagaacattgtggtcagacacattgcatgttctatataaaaaggagtctgatcactgggcccagaatacctgtagtccctacaggcaaattcttgtctttcaaaagcatcagtcaatctgatagagagactagacttacatggttgaaacattagctgaagaaatcattctagatttaaggtcctggcaactcacaaaggagggatagaaataaagtgggaataggtttggggaggtgggagtcccagcataagcagagactcacattaggaacatctgtgtctacagcagtgtgctacatgaagccaggccagaaaacaagcagaaaaatagtagggggcaccctgggtagtggtccaaagaacacagtgacccagcccattactcggcctcctgttcaaagcattacttgaagcacatttttactgggtacatctccaaatacctcaactcatacaaggcaccctgaaaacagccgaaagcagctgacatgaacactccccagattcagagtgtgtcagaaacctgccaataactgtaaataaagatctatccatccaaatgcagactagcacctgcgtgtttacagcctgttacctggtagcagggcgacctcatgttctttgtggcgcctgcagcagagttctggcacagcttagtaaaacaagactgctgctgtttcgattgttttgttttcccagttttgacagagtctcaataggtaacatgaagtttctgcctttgtctcctgactgctgagataatcagcatgtatgtgccttcactcctggctgaagcaatgattgtgtgagatgactctagagctatggccagaaaacctgcagagcagattgagtgccttgctcaggggtcatgttctatgattcctgtgacttaataattaatgcagccatacatttgactcatcaagatgggatattccccctgaaaactctaagcgtgtatgtggctcagcacctgcccatgtctagaatatacctcctgtcctgcctaacacagtgtataaccagcatctcctaggcaatggctagggattgggggagaggaggaggaggagcaagagcatctctgagctctaggcagaaataatggtttccatattgctttcaagggttcacaggggctcactgggacttctggcctcctgggagcaactggtatcccaggtttaaaaggtaaggaacattttgtcttctgatgtgtttgcctagaccaaggtgatgttctaccaatccacaactcaggagtagtgggagctgtgttaagggagaaaatgaattttgtttgtatttcccgtttggctaaacacactcttcactccttgttcttcaaagacattgcaaacaacagtgtcacatgccaaaatctcttccccgggctttcatggacaataaacaaacaaacaaacaaatcaacattccattcgcttcgtattttgatacaccgaaacagcaacatagaacttcacctcgaaacacctcttcccctgatgagcacagccccataggcaggaccaattctcttgtttaaatgaatcaccattccattctggtagtatttcagggctcacttaccatcttctcacatgtgctggaccatgtttccagtacaggggtgctgtgtataaatcatctcattctagtagcttgttagcatcccgggtccttttacccagtggatgcttttgtcaagaagcccctctgactgttttgaatctgaatcgagggggaaaatatattgaaaagactgggtgaaaaaaatgaataattgtttcttctgaccatttgaaaaataatatttttcatacctgcaggagatcaaggccaaacacttggcatttctggaagcccaggacccaagggacagcctggagaattaggttttaaaggtagggctagtacatttttgtccatacctcacaaatgcttcagaactgaagactggagtgacttttggagatcattcccaagttctttagcttccatccagtggatacctatagttttcgaaagcaaactgatttacaccactgatacgtacctttggcatggtctaccaactacctcaaacttcatttacctattttcctctaatgtttactgcaaaatatttcagcccatcatttttgattctagaaggaagccagaaactgtctactcacttctcagatgggtaacactttccaaatatgaaaacaactgccataaatcttttcccgagtttcttcactgaatcaagttccctcaacatctcaaaatgtttttaccttccaacttatgttttcccatggaggagtgcaattccagaaatagagattaatcattcagcaattgattgatcttctaggtgtcaaaggaaaagatggactagttggtgatagaggttacccaggaaacaaaggtgatggtggaaaagttggaattactggagatcctggcttccctggctccccaggtaccatgctacttgaaaactttattttgaagaagttaggattcacttcaagccatactgtattctaaatgtccaccttggtttcacacttaggacttcaagggatttcaggtatgaatggagacccaggcctcccaggttcctctggccatctggggtcaattggccgccctggaccctcaggcttaataggacctaaaggtatgtgtgtttgctagcaaggagtgggtgaagtgtctttcccccaataacagggggcaactcctcaatcttagaatgtagcagctaggcctaagccaggtaaaatggggtgttatatgaggattaattaaaaagatgggtgtagaatgagctagagagatggctcaggggttaagagcactttttctttgcagaggatctgagttggattcctagcacccacatggtgactcataacaatctataactccagttctaggtgatccagttccttcttctaaggcaccaggcacttgtatagtacacagatatacttgtagaaaaaattctcatacacataaaattaaatgagtatcaaatattaattgaaaagccagagaagtaaaaaggagaattataaatcagaatagaagaatgtcatacgcctagcagtggtgacccatgcctttaatcccaaaacttgggaggtagaggcaggtggatttctgagtttgaggccagcctggtctacagaatgagttccaggacagccatggctatacagagaaactgtgtctcaaaacaacaacaacaaagatgaagaagaatgtcagatccatgaagaaaagaattaacaagaaaaacattagttgcccattactaaaatgaaatccctgtggttgattacttagaaagaaaataaatttatcttataatttttgaggctctaattccaaacagctacggcgctggctttatggaggaatagcccctaacaatatcacctcacggggatgccatctatgtcaccccaccccacctcatgggtgatggcatcatggcatattatgacagacagagagagagagagagagagagagagagagagagagagagagagagagagagagaagaaaaagaaggaggaggaggaggaggaggaggaggaaatcacaactcaacagaaagccaatgtgaggggtagggtgagtcatactcttctgtagcaattcataattttgagagctcagggtccacgagaattaccttattaccttattccttctctgtggaaaatcccagtgaccaaagtaactttcactaagcctctcttgttaaagatcccaccacctcataatatcatcaaaatgggaactttggggaccacattaaaaccacagccaagtgtgatggttaatatcgtcaacttgatcagatctagacaagctttggggataccttttaagggaaaatacggattaggttagcctttggatatgcccgtgaggaattacctagattgggttgagttaggtagaaccaccttaactttggccattcaattggtagtggtcagagactgaatacaataggagaaagtggtctgagaaccatcattcaatgccatctgcttcatgattatggatgcaacataaccccctgcctcctcaagctgctgctgccacattttccttgatacgatagatagtcccctcaaactacaagccaaaataagactttccttttttaagctgtttataaagtatctgatcatggaaatgagaaatgtaactatgatatgaagccatagcagaaagttattactctggcatatgttgtctttctctgctttaatggtagaaccagtttcggggagaagacaactcaagggcctggcattgctactcctacattctattaaaaatacctactgtaggtggggggagcaaggttgtggttcaattggtagagtgcttgtccagcatatacaagtcccccccatgttcacttcctagcactacataaagcaagagtgatgacacatctgtaatctctgcactctggatgtagatgcaggaagatgaaaagttcaaggtcacactcacctacgttgagagttataggtatcccgggattcacgagactctatctcaaacaaacaaacaagcaagcaacatcatcaacagcaaaaaccaagaaaagcaggaagtcatatttatttggtcttgtgattttagaggttttagtccacagtcatcccttggcttcattgtgtctggacctgtggtcaggaatggtatcatgatagtgtattgtagagctgagctgctcactgccttgcgatcaagaagcagtaaaatgcaataccagaaaaaacaataccccctttcaagacatggacccaattaactacttcctccaattgcaccccactttgtaagttctaccactcaagaactcactaatattttaagtcaaacttgaattaatacatttctaaagtcaggatcattgtaattgaataacttcctaaaggatctagagaataaaccttcaatatttggtcttttggtagatatttcagatccaagccttatcagctaattaactgccatcttactctaaaagctacagtagcctttataagaatatgagaacccaaggttgcagggtgtatgttagaaattggctattcttctagagaacatcaagtaatgtctcaataaagttagagccatttctgatgttttctctccttaggattccctggagctcctggtttacatggactgaatggacttccaggcaccaagggcacccatggcactccaggtaagaaaggccctgaaggtcaaggtcaaggttaagggcataaagctcttccagaactgggaggagttggccatgtgttcttgactgtagtacaccccatatcctgggagttagatctcctcacttgtcttcagttggagaaggaaagaggatgtttcacctttctgtaggaatgagctcttcttctagaccacagggaagtcaactaggcctaaggactgtctccctctgagctctgtctcctccctctgcatttcttcctaggagccagtatcactggtgttcctgggccggctggcctgcctggtcccaaaggggaaaggggagtgccaggaattgtcatcggagatccagggaaacaaggttcaaagggacaaaaaggtgaccaaggtaagtaagcccaaatcaggacttgcagaaactgattgaggccttggcagtggatcagagtttgggattgttttggagccaaatggttcgtagggtagacttgtgcttatctaagaacccttaacaatgactgtgaagaaaatgatgatgaatagtcctaccaagtgccctcctagccttcagttagttccccctggctctttccaattcagctctggaccactttttcagacttgggcaaagccaagatgaatgcttctaaggagcagagttattccatttagtaagatcttaggtccaatttccttcgtgatccatgaggatgctagactccacctggcagaagaaacccaagaccgagagaacatggatctcctgaggccaagcctacaggctacactcaaccaggataggttgtgttttcattaaccaaagtccaccctgacctcagcttcccacactgcttgaagttttcctgggtgtcccattctagaactctctaaaatcatgaaaccattcttcagcttccttggcagtgttctggagactcacctgtctcccactatatataaagcaaaacatgactgcagtcagtcaggactaaagcatattccagttctccctctcattgagctgtatgtccccaagcaatgaacttacacacctgtctctcaatgccaattggacttaggttttttttttctttctgtaaaatggatataacagaactgtctcacagatatttctgaggactctgtgaatagtaaggtaatatgagtttgctgagcatatctcagtgcccagcagatgccccagaaacactgggcaccatgctattacatgccagttgggaagtagtaactgcagtatatttggagcctgaggtctcatcgtgtgtgtgtcccaggaaccagggtcatacattcattcatttcctgctgcaatttgatttgaggcatctgttgtttctgtgtttaatccttcctttggtctgggcaaacgtgttcttttggggaatctagagaaggctcaaaggacggtctgagcctgcaaagcaactgtggcttctttcccaggacacagagaagagggaaccagatggaagcatatggcatttctccttctgtttgtaaatcttgactgtgaatttctggttatcaaattattcacttactttagctgacataaaattataattacaattatagtaaacagcacacatcaagatggatatattatagaaacataattatgaggggcagcaagtcacaagggaatactcttggtgtggttctctcattagatgttcaaaataagcaaaacaaccaacatactgtctagggatgccaatattcatgaagaaattatgacaagaaggaaagaagtgaacatagaatttggaaatggttctctgagaggagggagtggaatctatggagactacacacataattaccaagataatgccatcttcgtttttctttagtgggacaatgaagtacagatgtgttcatcatacttagattattctttactgaagcaatttgtttaaaaaagaatacagcatgtattgtgcccaccagaggaaacgatctgtgatttggtagtggaagtaaaacagactgagcctgagaacactccgttccctgtgctcacaatacctttcactaaatgatttgcaattatattgttgttttcatacttgcattaaatctttagagcctacatttatgtatttaaagtttctcagggtttggcattggaaggagctagcaaaatggttatttgtcatttgcagctccttatttagaacattttagttttaataaaaaaaaaaaacatacaagcaaggactcacaatatggctcagtggataaagatacctaaattataagcctgacaacctgagttccacttctggaaccaaagtaaagggtgatggagagacccaactccacagagtgactatctggactccactcatgcactgtggcatacacacacacacacacacacacaatagtgataagtttttaaagacatgagcttttggcactattttagtttagtatatttatttataaagtcaagaatcagataaagagcatgtgtgtcttttaaaaattgacatggaggactctatgattctgtgagcagctccattatatggtgttatatggtatttcgcttgttggttttgcataattctaggtgatataaatacatacatcttctatatgcacatatacacatataagcctctgtttcaggggggaaagcgtgcaaaacatatctttctttcagttccttacctcaatgaaaaagaaaagtacttcagaaactcgtcacgacacagcggacaacacatgtagcttttttgtgtgtgtttgtttttccctaaagttaacaagagtgttttctcaaaatcaacgttttcatctctagtttcccttgtgattcaaaatatcaatgaactacttttaaacacctgctttggctaatctaccatcttttgacacatttacaaggttgtcccagcttttaaaagatcgatataacaaggaaaattgggtaacaatatttttggatttttcctctcacacacaaaaaggaatctcaaccaatgggtttttatcaggcagattccactgaactttcttttttctttttttaaatatttttattaggtattttcctcatttacatttccaatgctatcccaaaagccactgaactttcttattggactctccatcagaatatgccagttaacacatttgttccatacttagcatacagcaggaactttcacctgtgtatagatagttttgatgtttccccttcttatcatacatgtttttagcatacattaaataaatatctcgtcgtttggtgtaagtttttgtttttataacatatagtagaattggttccactaacgaaaaacatgtaaagtaatatggaaacctaagcaaggaacataactatatactttggccaaagggtgacaggtatctagtataatgagatatgttcaacaggcgactaagcagtaattccactaagtcacctacaaaagactggttgttgttgttgttgtcgctgctgttgtttgcctagatgtgccagaagagagcagggaatcttagggcacacatgagcatccataatctttttgctgtctccgttctggatgatctggtctcagtcatacataactttggagcagcatcagccagaactggcagttaggaaagtttgatgaaccagtgtgtatactaacaacactttgaaaacttaaattccagctgctcagccaagctttctttctgatctggaggaaaaacagcctaaaagatttccatccccggtgaaattggggagctagaaatttccacagctccgtctcaggaaaatgaagctccagctggaaacgaagaagctgagcctggtttactgttgtcagcttgctggaagttcggatgaatggaagacagccctctactggtgtcttctggtcttgcagctatttcatggcttccatttttctgaatgcacttggccatttccaggacgtgggaagcccaccgagccccattttatttattctttgcaggttccccaggtcttcaaggtcctgctggtacccctggagccccaggcatctccttgccctcagtcatagcaggacagcctggtgaccctgggcggccaggcctagatggagaacgaggtaaaaataagaaaccccaaacacatctggccaccttactttaatgtgggcagacatgctgtatataacgcagctctttccctattgctggaaatacatggatctgcttggcctcaatgtattccctctcatcaagatttgagagactggaactgactgtatttttgctgaagtgttttgcaaagtctggacatgtgcgcttcagggacctgtactaggagtgggctttggctacctgactccctaggccttcagcagcttcctatctctttgcacttccttacttctcccatcttatccctaggccgcccaggccctccaggtcctccaggtccccctgggccatcctcagatcaaggcgatcctggagactctggcttccctgggattccaggccttcaagggttcaagggaaaccaaggacttccaggtttctctggcctctctggagagctagggctaaagggtaagtctgttccaccagcttcaagacccatcagtcaccactgcacagtccagtcgccctgaagaggctctcgatggtgctttttctgactggtccccctctgtcaccatcatgccaacacctcacatgttttcctttggcccttaccaggcatgagaggggaacctggcctcatggggactcctggcaagatcgggcaaccaggagacccaggatttcctgggatgaaggggaaggcggggccaagaggtgagtgcagggccaagcctgagcctcagagggaaggggtacagcatgaagttgaggtttttcggaagccatgttgtctaccacaccacaaaaccaagtagggtatcatgctcccaagcccaggaggtagtttccctcctttggagataccaccatgccaatctactgccagaactgaaggtccctaccattggtacctgacctccctctgtattacttctgcattgcacctagaccactaagctcactttctaagttcaaaaaagaaacaaaattctttctatcctcgagccaaatgtcaactattcagtctatcagccaccccagagggctccttctcctagcatgccttgtatctgctcactttctatcagttctgctgctcccttgaggtctaagccatcagcagttctcatgtagcacccttcctcccccaacaacaattatttgtcccatatagtcgccggtaaaaagcaaaccattctattcatggcatagacaggaaccatggcccacaaaatcctgtgtgacccctccctctttatctcatgccagctcatgtcccttttactgtccattgacatctgaaatattgtcccaattatcctttctgccctcctccccttcctactagttccctttcccctaattagcccctcctctgtttttatgtcagatatgatgttctccaattgtatccatttgcttgtacatggcgtgcttcacttttcatcctgactgaagaaagttccttcatgtatatgtgtcctatttcctttgtccattcatctgttaatggacatttaggttgttcccaaaccttggttattgtgaatactacagggataaacataaatgtgtatgctggcttggagtcctactgggaatggtacagctggatcatatggaaattctagttttagagttttctaaggagtcctaatattgatgcctgcactagtttaccttcctgtcagtactgtatatgttttctgatgcttgcttgcccttcaatctttaaatgtctagctccccctgatacgtctgatgtttgaatagtttcagtgtaactgtcattggttataagaagccactggtagctctgaagcagacccctttacccaaaccactccctgctccctctcattgtcactacagcacttatttcctccccagtccttcttataagatttgaacaatggggttaacggtatttgccaaatggtgctttgttcatcttcatcactaggccttaggctctataaaggtctatcactgctcttgtttctcatctcccagaatcttggcagatagtaaggacccaagaattactttattaatgaattagtgaacaagctattctatttgtaaagtggctgacttgggtgggtctcttagactgggatgccaactgcacctctgaagttgaatacatcgatcgctacagtatctttggtagtgcattctgaccagtgtgtaagttataactgcttcatccctgacccaaagctcagcttgctagagttgcagtagagatttcctaactgctttccacctagtgaattctatactgggatatggggagccacaataagtatgacttgctccctgccttgcctacaggcactaagaagaagatgggaaaggaggttctatcaagggttgtgtattctatactggaggcctcaagtggggattgtgagcacaaaaagaaagaaaatagttggcgactgccaggcagagagaaggctgcctttgttactcctccagcctgacaggtgctgtttcactacctgtcttcaggcttttccggcccacagggagctccaggacacacaccaattgctgaagctatgcaggttcctccaggacctttgggtctgccaggcattgatggtatcccaggcctcataggagaccctgggtctcaaggctctgtgggtctgcaaggtaagaatggcaccagagaacaggtactcactgggaagctgaaaggccttggttgagagactgaagctactggcttgacacaggtctgagaaagtgccttcatcaaacatttcccaagctacttcccgaagctcccaaactctttgccagggaaggaaaaagctagaaagccagtggggcagtggttatacttgtcttcagagaacatgtgaatctctcccctagacagcttgccatttctaaagagtgtttggagctagagaagacgtgagtgacaaaggagaacacagggtagtggagaaagcaaaagactctggacaggaaatgtggtttccaagtcttagctttgccccaataggagtaagttgttattctccctgtgacttcacatgagacttccatattgagtgctcctctgccttgtgcattttctctcttacaggttccaaaggcctacctggcatccctggtaaggatggccccagtgggcttccaggcccatctggaatccttggtgatcctggtctccctggactacaaggacctccaggatttgaaggtcaggttaacaaaacttggacacttagtcaaccatgtggtaaatttgccactatgaggtcgctcacaggctgagttcttgtctctctttatgttctattactatgaagagacaccatgaccaaggcaactcttatgaaagaaagcataccaggattggagtattgctgtgacaggcatgatcatgcctttgttgaaggaatatagaagactttgggactttggactagaaaagtgattggatacattaagtagggtgtaatgagccataataacaggaacagggaagatagtattaagggcaatttgaactttaggggcctggctgaagaagttccagggggaaataatattagtaagtaggctagataccattcttgtgatatttggcaaagactgtggctgctttttgcccttcccataaaaatctgcctgaaactaaactgaagagttttggattaatgaggttcgcagaggaaatttcaagatagcctagtactgactgtgctgtgtgggtttgatagcgcttatacagatccacaatgaaaaggagcaggggaagcaaggggaaaaaaacaaaatttacagtttgacgagaaaaggagtaccagtaaatgttttgttggagccaattctagtgctcaagaagataaaaaaaaaatttttttaatcctgctgctaaatgaaataaaagaagtaacatcagggcaagaccccacttctggcacaatcttatgtctttctcactgttctattcctgtgaagagacaccatgacaaaggcaactctgaataaaagaaattatttaattgggggctttcttgtagttacagaggtttagtccattatcatcctgaatggaacatggcagtagacaggtaggcactggagcagtagctgagagagatacttcctgatccataggaagacagatatacagacacacatacacacatacacacatacacacaaacacacacacacacacacacacacacacacagagagagagagagagagagagagaccctaagttgggcgtgagcttttgaaacctccaagcctatccccagtgacacttcctccaacaaggccatacttcctaatccttctcaaatagtgacattcctggtgactaagtgtcttagttagggttttcctgctgtgaacagacaccatgaccacggcaactcctgtaaggacaacatttaattgggactggcttacaggttcagaggttcactccaacattgtctaggcaagagcatggaggcatccaggcaggcatggtgcaggaggagccgagagtactacatcatcatctgaaggctcctagcataatactggtttccaggcagctaggatgagggtcttaaagctcatacccaacagggccacaccttctaatagcaccacaccctgagccgagcacatacaaaccatcatattaagcatttagctatatgagcttatcacagtctttcttattcaaaccatcacattgttcttctcttcacactgcacaggctccagcctatgatgagaagtccttcatacttcagtaaggcaacagacttctcctccttgtctgggctctcctccagctatctatctatctatctatctatctatctatctatctatctatctatctacctacctacctacctatctatctatctatctatctatctatctatctatctatctacctacctacctacctatctatctatcccagtatcttgctgcaagcccagtttgccctcaaagtcactatgtaagccaagttggcttcaaactcttgatcttctgcctttgcttcccatggctttctgtcctgtcctgacatggatgaaagaatacaacaaattacttgtccttggtatagaatccttctaaagctcagtagtaaaatattgaagtacagtggtcatatccaccatggacaagagaggcagatgcaactttgcccttctaatgctaacgttacttataatgcttctgattcagcagctagttatgtcctgtgagagacgccaagggtggggatgagaaggattccactccatttactcttagaaccgaaggccgggaggctgaagaaggggaatggatagtgtactcttttaaaatgggaaatatttagctgggcacacacatgacttggagttgtaactccattagcttctagctgtggcagctcagaacctcattttcctcaactgtagaacagggggtatcaggatcaagtgtttgaacacacgcatatgatgcgccttacaaatgtttaggatcaatgagtgggtagtgttattaccatctgcagcatgctgacttttatgtccttttcttctcaggagctccgggaaatcagggccccattgggcagcctgggatgcctgggcacggtgtgagagtgggctacacactagtaaaacacagtcagtcagaacaggtgccactatgccccactgggatgagccggctctgggtgggttacagcttgctcttcgtggaggggcaggagaaagcccataaccaggatctgggtaagtacagctagtccttgctccctgaccctacaaggattgagaactgaccacttttcttctcacagccctttcgactcatggttatgaaataggccacagctctggggtcaaaaggattttgattcaaatgctggtcctactgcttcaaagccacaggccctgggtaaattattcaacctctccaagctttcatcctccctcaatgggactaagctatttctactatctgtcacatagagtgctgtaaggaattcatgaatcacccaatgtacaatatatttaagcctccattaagtattagtgattagtaataacaatagtaacatgacctacagggcattgatgattgcccaaggattaattgcattagcagcaggtgtgctacctcttagatgtgaattctgtctactaaatgtaggttttacaaagcagattaattagggagtaattattcactttatcaaaagattctcatcattattcaactcccctggtaactttatgatacaatttgatcctcagactccagcacctaccaaagtcataggactgtaagagcgctgtactctccgagcaagcatttagaaggaaattcacatctttggctactccaggccttgtgcctctgccctttagccagcacttagctgattcttgtccatcttctcttcccaggatttgctggctcctgcctgccccgattcagcaccatgcccttcatatactgcaacatcaatgaagtgtgccactatgccagacgcaatgataaatcttactggctctccactactgcccccattcccatgatgcctgtgggccagacccagattccccagtatatcagccgctgctctgtatgtgaggcaccctcacaagccattgctgtacacagtcaggacatcattgtcccacagtgccctctgggctggcacagcctctggatcggatactccttcctcatggtgaggccttgaaccattctgtccctcaatggagaaacagagatatatagggtaggggtgaagagctcaggaaaggacccttcctttgatcccaggctcaaggggacaaaggatagaaaatagtttaacaggaagagagatgaagatgggaattacaattttgtggtttgcagggtagaaggtggggttagatagcaatttgaacctggtgttctggactgagaacctgtatgtgtcacaagtcaaggccctactctatgtgtccttcagttttctcactacgaagggaacactagaactgtaatctgaacagatactgagagaaatactgtcctcaacagaggccaacacgtaattgtactgatcaggctgagaagaatatttaccaccttgcagtctgccctcccagatctgtctagcttctactatctctttttgatatctcctcttaaagattggcaaggaggcatgctgcgtttgtatggccttcattgcttctccagtttttgtggtgtgaaggcatgctgtgtatctagctaggaaagagaacatcagtagtaccgaggagatggtcccataactatctggggaggttttttcaaatgaaatcaggagtaagactaaggcaactcccaggaaaactacagtgtaaagctcactgaagtcccctggttgggcagagcttctcactgaatcaccaaagactctggtacaacagctcccacccaaaactgacatgttttcgtaagccagagccatcagcaaagtatcactctctgaaagttaagcaaactgacagcctgctagccacttgctgatgcagattgcataaagcctcctcttggcctcctgtgcttccagctaatctgaagggagatggctggagtatagacaggaggtctggaggtctagtgactagagactgccagaacaactgtggcctagaaactgaactccaagtaagccctctgaagtgaggcctgagacattttaggtcctttgtcaggtaacaaatattgtgtgtcactctagagggtatggcacaggttgaaaatagaaatagttctagtagaggcagtcttaaggatgagaactataggggacatgctgttacaagaaagagcattggggactactatatgcttttccttcttagaagacagtgcccagcaatgggcttaaagctttgttaattccacaacctaaatccaacattgttccggtgtatatgtctgaggaccaagaagatggacccctaggaaaaggcatttaccatacacacacacacacacacacacacacacacacacacacacacacacacacctgtggaaatggggagctgaaggtaaacctcacacagctgtgaagtccgagggaaacattggttggaatgggatcactgatcacggaggtcccaaaggagctgcttagagaggatggccagtacttgcctccgaagcccaggttcatcaggcaggctagaaactgagtgatctggaggggtccagagttctagaatggtgcacatatgaagtcctgtagaaacaggccatggagcatctctgtgttgacttctggcagagctcacacagacccctcccttctgtttcagcacactgctgctggggctgagggtggaggccagtccctagtctcccctggctcgtgtcttgaggacttccgggccactcctttcattgagtgcagcggcgcccgtggtacatgccactactttgccaacaagtacagtttctggctgacaacggtggaggagagagggcagtttcgggaagagcccgtgtctgagacgctgaaaactgggcagcttcacaccagggtgagccgctgccaggtgtgtatgaaaaccccgtagggtactgcccgtcatccagcccacctcacaacactcacctcaacagtctgagaaaggaaggcctgagcccatctgcctgtcaagttgtacatcaatgcctcgtttggactggactactggacaatggtcatcccaaccctcagacccaacagatgagcccactgtgctaggatttgctttcctgtttccatccatctggtgctaacattccatttagatatgtgtgtgattactcatggctaccttaggaaggtgtgctaagctgtcacttgcgaagatggctagagctctcttcactgccttaagctggaagttctttataacagcgaagttatgtctttatgacaagacgtcaccacacatcatttgagtcaaactaaagctcaggatttccaccctaaaaatacgtttctggctgaatatgatagataattcaagtctgcctagggctagccctccctactgaaggcagcctattatatttagacaggcagtagtgttggaatgagaaaccagcctatagccagaactgagctgtgattccttgcagagttttgttaagcccatgccccatcttgagtaggaaaggctgaaaggccagtatttggtcctagacaaatcactgtcccctggtcccacatctagagatataagacaagttggcccagtccaaagtggaaccaagaattcgataagtgtgatcaagcttgtcacagaaagacatgagaatcacttctccttcttcttggcctagggcagaaggagaaatacatatagaggtagcagttttgcttctgagtccaggaaccaaaaggtaaagctcatgtccccattcctcagaagtccctagttattccaaatgccacccagatttatgcagggtgacaaactgaagctgcagtgtgttggctccttgcatgctgaggctcttagaggtgttctgataaaatggccatccaaacaccctcccacgggtagccttttaaactatttgacagggttttttttttttaatttcataaaaatctagcacacaccaatgttagcagacccgaggtacattctgagctggccatgaagtatactgccttctgtttgaagcagttcattttaattaccagttgcggagaacacaatcagttccactgacatgaagcgctcccttgcaggtgattggcttccttgagtactatgtaaaccgtgcccacgcaggcaaagcataacaagtacattctgagctcttgttatcacctcctagataagtaacaaatggtgtcagctttgtacatagcaaataaaattaatgaaatacgaa

SEQ ID NO: 683 - DNA, 213851 bp, mus musculus
gagggggcggtgcagggaagagagcgaggaaagtagatttgtaggacgttgagtgaggaaagtttgcaagtcccaacagaaggcaaagtgctcctgagagatcggctttggggaggggaggggggagggaagaacagctttcttttcttgttcttgctctccctctctctctcttattttaatcgcttccctcttataaatctcttcccccaagtgcaccagcataaccgggacactcactgtcccctttctagctctcttctcaataacccttcaagattatgtcaatcggtctgaagggacctgggattccctgcgggtgctgacggagctgcgggagccagagaagaatgcaagtgcgtggagtgtgcctggctgccggctggttcttactggccctgtgtctgtgggggcagcccgcagaggctgcggtaagtcctccctcccgccccatcactgctcgctccaacagaaaccactggagcctttaccttccctactctttgaccttggccagggaagtcaaaattggctttaagtagaaagaaatataattcccaactctggtctgagggaaaattccaagtgtttaaaaacagggccgcttacttctctgtagctacctcttctggggcaagagtgggcagagggtgtgggaggcacattaatgggtcactgggctctggaggatatttaaaacttttcttcctctctatcccccacccagggtagctgtctaccagctagcttctttcactacttggacccagcccaagcacgatttaaccttggtttatagtttaaaatttggttcctctaaaattgaactgtggtcagtgtggtaatagccttgatggagttcttctcttggcatatgctcttttcttaagccacatgaacccaccccccaccccaggtttgtaaagttctgccctgttttctgacctgttgacatcattcttttacaaaagataaaataacctatcaaccaggacgaagtaaagaagcatacatagtcttatgcttcaggagttttgcacattaaaaaaaaaaagttatgggtttctgttggcttgcactttttaaactcataaaggcacctgaacaacttgagagtttgcctttcacccatttaaaggacaagaagtctcagttttccaatgggaatgagctctatgggttagaagagtgggggaggatgctcacacgaaatgacagagcaaaaagttccacttgcctttaggaatgtagactggataccacagcctgttcctgagcaggaaatctgggtagtcccaacacccactctccttctggagataagaggtaaatgcaaaggaatgaagggctttgctgcagaaaatattctccagtttgaagtctaccctacttaatttcatataaactgtgaacaactaaatgtgtgacaaattatttaagtattatatttgagtacacagaatggatgtttaaaaccacttaaatatggcatcatagcttaggccttcacatggtggagtgactatcaatcctttagacgcagctacaatattacagacatctgggtctacatcaaagttagcttccttttggactcagcacacctcagatcacattgccctctgtatatgctagaaaaactgtgtatactgctgttacaaaaagtaactttgatgttattgtaatcacaacataattatgatagaaaatctgtgggaaaacttgcacatctaaaatgttttagttatgcataccatcattttcctccatcaaagtagatatacgacttaataatgttcttttggtgcagagcatttttgatggggtatggtttccgcagtcaatatggctaaagatggttagaataaattataattgggctatagaaaatagttcatttgaagctcatcttagtgccttttgtttatagcatttgccctatgggcaaaaactttgtggatgacttctgaagcaatccttcctcttagttaccatttatacttgtgtgtataacaacactgcatgccagttgaaattcatttatattaaaaataagatttttttttattgacaaaacttatgtgcaagcttactttcgtattcttaaagtaacaagtgtttgtgaagtaattgggatttccccctcctatacagttttgaaaggactttttagttcacactttcctatggttagaattttgttcctcttttaaatctaggggtttgttgttccttcctcacaaataaatgccctagttaaatgaaagttttaatcatctcaaaaatatgaatggtatctgctctccatacttgtgctgggggtattggtcaccttctccagagtgaaacttggctgtacttggcttagtttttcaccaatgtcttctaatattgaggcttttatatcaggaagaacattacttcttaaattaatttactttttcatagttatatgactttactatctctggagtcatgccaaatttagataacaaaaatatgtgaactttctttttaaggtagaatgtttattaggtagaatacaataacccaggtattgaatggtcagcagcaagaaaacagggtaactttagtctgtaaggatcatttttagtgatagaaaaaaatcatatttttaaatgttaaggtgactatggctatacaaactctgtcaaagagataagcttgtagatttaatgatatgtctataaataatatggagaattatactacttctaccatacaaatgtttgtaagttatttttgtttttcttggaagttatagtattatttctacaatttaaaccatactgtgtaccttgtgaccatttataagaacttgtcaagggtaatagcaaggcttttggccattttttttctatgaaatgttctattctatagaaaaaatgctcatcttgctttcattattgtttgtgtttacattgttcagtgtttattatgtgctaagtactatgttaggatagtaagacaaattttgatatttagtcctttatgtgatgctagggattgaacccaaggttccaagtgtactgaatttgctctgtgatttgttttcttaagagagtactaatgtatttgtgtgtgtgtgtgtgtgtgtgtgtgtgtgcgcgcgcgcgcgcgcattaaaagctacttactagatgagaaaactataaaacagaggttaagcaacttgctaaaaatcacataggttgtgaatttcaaattcagagtttgcccctaagtcccttatattgtctcctttgcatgtaatctatagaattatgctatgttaacatatatatgaatctatattacatttttttagacacagaagatgcagtgttggtgataatggggtttgcttctattactgcttattttatgtaaagtagtatagcataatgtaaataaatttactttttaaagattaatttgatctctatgtctatgcagactgagatagtttaaatgcaatctaaaagcaatcacaggttaaatgattttatgtaatctcaataaaatttagatttataaaacacctacaacttctgatagatgatttttccatgaaaataattgacctatgtttcttttaagcttcctcagttagtttgaagtatgcagaaatgtccagaaatatgcctgttgtcataaataggaaatatatggtggtacagtcttgtcaaaaatgatcaattcactttgttgttttttactaactttcctacaccttcatatgttgttttgttcactcaaccatctatctatctttatatatatattattttgtagttttaataatcaaattcaggacattgcacccactatccgaaatctttacaatatacccccacccccagctctgtgtctacagtattatgtatatatttctgtatgtacccatcgtattatttttttaacagtgcataattttccgtgtttttacttgactcttgctgtttgcaagatatgatactctttttaccttgaattacccttgacaaattggttagaatagtgtctgccaaatttgtccactacaaagtcgttttctttcctttataaataagctgatcttattagactgtacagggtgatattgggagagagtctaggaagccaaataatctatatctcatgatagtttcttcagaaattctagcatctgttaatgtttctggcattagtgattgttgtagttaaatttgccaaaggtgctttcaattttcaaaaaatttctacataaaatatcaaattttactataatacattttcactgttttaaatttactatataattatttattcgatatgtaacaaaaataaatattttctttatttttatttataataaattattattttattacaagtatttactgaaattattataaatatatacagaccaggagtctattcacagctgtttctatatccttcaatgtgtttccatcagctttgagcatttcctctattactagcatcataaaatggtcatctcctttccttcttctaatttaggaatgagccagttcaccaatgagtctattcttttaacaaaatagaggtatttagaaaccaaggtgtggatgcttggcatgctcattctgattgaactgtcattttatagcccttttcagcagacaagcctaggaaatgcatactatcttagttttatctataatcctatcacacacacacacacacacacacacacacacacacacacacacacacacacacagagctgtaggcaatgtacctaaatggaacaatacatacatataaatatttgcttctgacatcaatctattagaagctttctatatgttggaaattataattcataacaatatctcaaattgtagttaaatatcactgaataaacacacatatttgctgtggtggggtctcttgttttgggggctttggggagagggtaagggagatgctgggaattgaaccccagaatcttgaacatgctaaacaagtccttctgcagttagctacaccctcatctacaacttgctaagtctgctccttcattctctacatggctttaaaggcatgtcatgatatttcctgtgattcagctttcttgtacattactttttacagtatactctttccattgtaccacatgaaaggttttctaaaacacactacaggatagatattttggttctctttcttgcttatcagcctttgctcagttctaacaaaatagcatgttacattttcagcagatgcatattgaactcctaataacaaaagagttgtatttatactgttctattcaggtaatatgcccacaacactatccctgcacacatctctctctctctctctctctctctctctctctctctctctctctctctctctttctctctctgttagacaattatcaataaaattaatacaatttcctgctttaatggagcgttcttgtttctccataataccacagcaattgatgattctacctttctttgaacaaatgtaatatttagcattttttagactagtctgtgcttgatcattttattttatagaattttttgttctctttattatattatcattatttggaggcaataattatatgctccctatttaaagagtttttgctgactgttttgtctatgacaagtgatatttgatcaacattgggaaactagaaaataagaaaaaatataatggaacaaagaaaaatctgactacaattctactagcagtctagaaataccttctattacctttggtgatttccccttttatagacatagtttttaaaaatagtttaagtatgggctcatactttgtgcaatttaattttagttttaagttacaaaatctttatcttagagtatgaaaagtctagtttaaaaacattaattttaagtagcttctataaatacaatttatatttctgcagaccacaatttatgcattcaacttcttgttttcttgttaaggcaggatctttctacttagcccaatcttccctccatcttgcaacccttcttctccagacttctgagtgtttgaattacacaatacaccctccactgtcttcctacttttgtaagatatatttttaaaattcaagattttcactattttaatcagttattccatgaacatttcttttttatttttatttattatatctaagtacactgtagttgtcttcagacacacaaggagaggtgtcagatctcattacagatggttgtgagccaccatgtggttactggaatttgaactcaggaacttcgggagagcagtcagcactcttaattgctgagccatctctccagccctccatgaacatttcttattttgtattttaatctctaactattactgcctctatcctgagtaattaatgtgttaaacacttttgctactttaattctttgaatcattaattagatgctaataatcaggaaacatatctacacataaactaggcaaacttttttagcaatgacatttgttaaggaaatagtgctatttttactttttaaaaattatattctctgaacactagaggaaggcagggggaccctgaatagcaagagtaggattctgggaggcagaggagaacacagcatacagaatcaactaacctgagctgatatgggctcacaaagactgaagtggcagtcatgggacctgcatggatttgtgctaggttccctctgcataaactctgtggttgcttagcttggggtttttataggattcccaaaagtgttgggggaggtgtctctgactctttgcctccccttgggacacttttcatcctaccgacttgccttctgaagccttaatttgaaaggttgtgcctagtcttattgcaatttgttatatcctattaggttgatagccctgggaggcctgctaattttttttctaaagatctaggggagagggtatattggaggggtggggggagtggaggtatgggaggtttcagtaaggatataacatatgtaaagtataacaataaaaataaaagcactacaacagcaaaatgttatatttatttataattgacacataaagcatatacataaatatactgctgtgtggtgttttaaaatgtctattcagtttccctatgtactttctgcaacctctggaaattactctttgattagcaaattctctgatcttatttatagactgtgtaggggagatttttagtatgtgtcttaatgtgccttacttttttcacataacataacaaattacattcctcccatgttgttgtaaggacctgtgtttgttcttttatatgaatggataatattcagtgtatatgtgcattgcttcttttttcattatctaggaatggacacttaggttcattgtattctgtattgtgaaccatgctgcagtgaccactgatgcatagatgtcacatacagatttaatttgcttctgttatatactcagtattgagactgccgaatcagataataggtctacttttaataattgaggaatgcccatacattccataatggctggtttaacttgcactctacccaacaatgttccacctgctgcccttttctctgtatcattgcaagaacttactgttttgcgcatgcatgcatacgtgcatgcgtgcgtgcataggtgcatgcttaggtgtgtgtgtgtgtatgtgtgtgtgtgtgtgtgtgtgtgtgtgtgtgtgtgtgtccgtgttcatgagcatgcatgcagaggataaaggagggccttgggtgccttctttattatctccatgtattttttgagacagggtctcttgctgaacctgaagttcaacttttgggtaaggctggtcactgtgtttcttgcatccttctgactacatttctcagtttgtgagttataggcatgcaaagtcattcttggcattttttgggtgcctaggatctgaaacaaggtccctgagctttcatagcaagcactcttatccactaggtcatatcccagctccccccccccttgtttctttttttttttattatgtattttcctcaattacatttccaatgctatcccaaaagtcccccacaccctcccccccgactcccctatccacccattcccattttttggccctggcgttcccctgtactggggcatataaagtttgcctgaccaatgggcctctctttccattgatggctgactaggccatcttttgatacatatgcagctagagtcaagagctctggggtactggttagttcataatgttgttccaccaatagggttgcagatctctttagctccttggatattttctctagctcctccattgggggccctgtgatccatccaatagttgactgtgagcatccacttctatgtttgctaggccccggcctagtcacacaagggacagctatatcacggtccttgcaacaaaggcttggtagtgtatgccatggtgtcattgtttggaggctaattatgggatggatccctggatatgacagtctctagatggtccatccttttgtctcagctccaaactttgtctctgtaactccttccatgggtgattgtttccaattctaagaaggagcaaagtgtccccaaaggtcgttcttcttcagtttcatgtgttttgcatcttataccttatatctcgctacaggatctcattctgtagcccaggctaacctcaagatcatgtgatattctcctttttgcccctcaagttcctggattacaaatatgctcaatttttatctgggttaattgattttgttctactgaattttagaactcattatatattctaaatattaaccacttgtgtgatatatccatgtaaattatcttgtctcactctgtatcgtatctatttattgtcatgattgtttcattcctatacctaaagattttggatgatataatgcttagtctttccttatgtgtgaatgtttatgtgagtcacacagaagtgaactgtccaaggtaagtttgtaaatgtgattaggacaaggtttaaagcgttctgggattatgatctgatcctaagattattccatacatgttaaaacagaggaatcaaagtatatcaaaaaaggtgggggtgtatttcattggttaggctgttaaattctctccaaccccccataattccagctccaggaatccaataccttctgtttacctttatcccttccataattcctccctatgattggccattttacttgtgtcatcatttaacaacattttattaaaactatctagggtatttattcacaaggacctagattcaaattctgcaaattttacattccctcagttttcttccttaagtgaaagagcccacccattttaaatggcactttctttttacctataataaggctattatgaatctcaatccacaaactgtctacctctcctagggaagttttgtgatgcatctggaatgtaaagcttttctaccttcctccctgactcttttcactactccaccattgaagcctagtaggtttttccttaagtagctgtgtatttgtctatttctttttctctctttcaccttaccttctgcactactccagaagcttcactctgttagtctatgttatccttgaggcaggaacagcagaattaaacttgtcaggatgtttggaacatgtggctctctatccattcgtaccattcctacttggttttctctctgtgttttctcaatacataaatggcttcattgcttgcctgccaactttgtagcttctacaattaaaatgtattcctctacaaagtcacaaactgttgtgtaattacttctccaggtggcatttaaataggtgaactttcagtgtctgaatgataggtatctgcttttgccaaattacttttcaaaatgattttaccaaataaacttctacccataatttataagagagcctaggagataatcttaagattattttctatctactacagggactatagagttgacgctcaatttacagccacttggttggttgatttggccctatcatctaatgattttctttttaaaatgtaatcattctatcatttcatccccttatttaacgtagcaaacacggattgaaagtcattttccaaaatatactcttgttaattaacattataaatgaatcacccagacacttagctaaatctttattacaaaattagtttgggatttttaagagaagaaaatcttaaggggtattggagagacatcttgactgtgatgtctgtcacataggctcctttaattttaggaatccagattctcattttatgcatgaatgcttgaggatatttaccttcataatttgtgcaggtccaattgtcctttattcctttagcagcttctgctggcctttaaccaaaaggcaggatggtgcctgccactttgttgaaatgggactcttgaatcccttgttatttgctaatggaagacaatcaaaggcaaattctacaaatgaagcaggtttctactataattaattctttaattgatcatttagtcacaaaaatctagcattggttacaaatggatatagagagcaaaccatcatttataaggaagtaataatctatttaatcaaattgcatttttcatagtgagtaattaaataagactaagcaattaaatcaaaatatttgaatattcctcctacaagtcaaagaattaggtttaattctagagttttttataatgtatataacatttagtcagatatttggagaaaagtggccttaagaaggagagactagggactggagaaatagctcaatggttaagaacactgatggctcttccagaggtcctgagttcaattcccagcagccacatggtggctcacaaccatctgtaaagggatctgatgccctcttctggtgtgtctgaagacagatacagtgtactcatataaataaaataaataaataaatcatttataaaaagaaaaagaagactctaaacagatacgtggtggtgaacatctttaaattccaatattcaggaggcagagacaggtggatctttcagaggccaccctatggctctctaagccaaggcccgagttgtcaaggtacaggcatgggcattttttaagtcaacttagcagcttatagacatggaaaagggttgcctgactatattttcattctctagccatagtctgttagtctcacactcttagtaaacgttggattctggaagagatactaaattttcataaattttatcatttaccactaatttaatattttaagcaagatcaaattattgtatgaatttgaagacatgagtagatataattttgtgagattaaaatgtactcacttgctaaacttttaataaatgccatttaccaaataatttttctcctaattgaatccacttttttttttttaaaagaggccagcctagtctatagggtaagttgtaggatagtcaggaatacacaaagaaactctatctcatggaccactccctaaaaaaaccctgagacatcatgaaaatttatgatatttcctatatattctctatttataagactattctttatttcttaaagaaagggaagtccttctcacagtctcactatttaataaatataatatgatttccttttgcatgcaagaaagatatattaatgcatttatatcagagtgctttctgattttagggttgaatgtttaaattttgtggatttattactcttttaaataagtcttctgtaaggatctactaatccttttccttttatgtatatgactgtatggtatatgactgtatgatgcatacatacacacatgtatatgttgttgttgttgttgggaaccaattattggtctctctgcaaaaacaatacatgctcttaaccaccgagtcatctctctagcactgtaaataagtcttttaaatgttactatgttttaattttaatatgatggtgttagttactgttttattgctgtgaaagacactgtgaccatcgcaagtcatataaaataaagcatttatatgaggccctctttacagttttagagggttagtccattagtccatgatcaccatggtggaaagcaaataggcttggtgatggaacagtagctgagggctttacatcctgatcaacagctaggagagagtggaggggaggggggcctggtttgggcctatccccagagacacagctcctccagcaaggtcaaatctcctctaacaaggccacacctcttaattcttcccaaacagttccacttactagggaccaatcatttaaatatatgagcctgatcctgggtgcagttctcattcaaactaccacaatggaaccaagtggtagaaatctttaatctagttattttaagatggcaagaaagtccagaaactacaacttttgtaatcatttgctctacagaaaacaactaaattattatacagagaacacaaagaggttggtgaaatatgatgctagtgccatgcagaggcagctgtggaagatgtctgttcagaaacttgtcctagctcacaacagtttagtgattagaaagctgtgaatgtaatcttgtaatcttatttatcttggtggcacagagccaataccagacagaaaatggaaatattgagttatgcttatcttttctgctactttcaatagaatttccaatcaaagagtttgttctccatgctgggtattaaaagaaacattctgattttataaagcatagcagaagtagctgttaggtgatcatagcaatttttaagttctaaggtggacaaaagtttatgaaaccagaattcttgtcttgcacaacatatagatgggtttcttatttataatttagtattagtagttgttaagtgagtgcatagtttgtctggggaaatatcaatttatttgaaatatgcccagaaaaaaaatgcccacctaaaaaaaaatcaatagattaacttacgggaactttcaatatcaaaacttttctaaaaaggcatttttgtatatgagacaagtccattaatcccaggaaagtaaaacacaaaatagctacctaacaactgcaccaaaactcaacttcatgtaccatttctctacaaattttatagtcatattaattcatggattttgtatttattctatagtaattttgtatatatctttccccttttatttattcttttctcacatattacatctatgcatgtcttatatgcactgtattaatttcatatctgcatgtatttgaatagtatgaatagtattcagtttttaattattaatgattaggaatacaatagatttttacctattgacctatttgctgtagttttggtgaaattaattttaacatattttatagggttttcatcattatgtgcatgattatgtcagctgtgaatcaatataaatttaccaaccctcccccacagccttaacaatagaacctaggactttatgcatcctagggaaggtccctaccattgatttccaaccttagctttctttatagtgttctccttttgcaactgcttttttctccctgattttattgtccatggtatggcctttataagaagttacctttcctaaggcttaaaacaaattttccacagctatccagctttttttatggcaaaagacaaatgtagaaggaattattggagcaaaatctgcttcagcattaagaatattatagagttatctgtgttgtatgaagaggttaaaggtcaatgttgggtgtctttttcaatagatctccatactatattttgacatagagtagatgggtggccagtaagaatatggctatgcctcgctccacatcaccagtgttgaggttacaggttcctgtcatcagacctgtgtttgacatgggtgctgaggatccccacttgtgcatcaagctttgcacccactcagccatttctctattctttgcatttacacttttaaacataaatcctttttatttgtacagtcttacagctagaagttgtcatcaatgtgtgaatgcttgtatgtatgtatgtatatacatatgtatgtatgtggatatgtgtgtatctatttctatttacacatctactcatacctatagtataagaattagctcaagaacagtgatcatattacatacttctatactttgcatcatctagcatacttacattaaattaatggaaaataaaaacttagggttaattacttttctcatactcaaagtatcatttttaactataggatagtgctatgtgctgtgatttttataaaaggagaagattgggatcattcacataatatagagaaacactgtatgctttaatttctttttatgcatttattattattattattattattattattattattattattattattattatttacaatccagtcattgaccctcctggcttatttctatgaggaaaatgtatcctaacatttctttattttgacttagctttatcttgtagtgcttgaaaaatgtcctatgttaatatattttgagccagttgaagttaatatagcctcatgaagctttctacaataaaaaggtatatttcagctttgttatcttttctgagtagtttttctagctggctataaataagccagtttgttcagggtctataccaatggtaattttcagattttctttctctttttaaaataatacagtcatttccttttacatgagatttttaaaatttagctaaacagtctcctgccccatgttaaatcttttatcttgtaaatgtttatatacccattttgtgcattttctcattaacacaccatgcttattttctaaagacactttacaaacttcataagaagagagataatatatttctcccttcctgttctcaaaatcgagtgatcgttttgggttcaatgtctttgcttcagcaagtatattgaagttataggaatttggttaatggtaaaaagattcatccttaacagtaacttctctcaattctatttgcttgcttatcttttatagcctatttgggcattccatttttctctgcagttccagcagacttcttttttgttacagtacaaactcattagaccttatcactgtcttcatgctttcatttatgtctagagtataatgggaaaaccacaaagactaatgctggcaactaacaagtgatatcaaactgaaaaggtcaccatttttagaggctgaaataaaggttcatcctcagaggctcagatttgttatccagactaattgactgccatttttggatttgtagcatgacagtctttccattaaggatgttgtttgcattacctatacttcattatgcagagacagggaaaacagagacatggtattcctttagatgtgtgagtcattataatatgaaatctacaatcaatctactgaaaaataatggcagattcaaaattaggcattactgatttttgaggtactgtcaacattatactactcagggtatgttttaaaataagacctcaattgaattgggaaagactggaattttttagtggtaaaattgtattacaggctgtactctttcttagctttgcttgcatgtctacttttaaaatatatgtcatatgttcatattgtttagaacatatttttaaattataagagtgtttaaacatcaatagactggggaagtattacaagagacaatagtctcaatatagattctgacaaaatcagttaataatagaaatatacattcattagaactgtaacttggttgcttttaggtaaaatattatggcacttaaaattttagctccttttgtaaatttagaaagccatcacacacacacacacacacacacacacacacacacacacacacgcacacacacatgcacatgcacacacacacacacccgtaatagattgacagtaaattttctatattatcttgtatctaagtttttttttaaattgttgtgacaaaaaatcgtgatcaagtcaatttgtaaaacaaagagtttaatttgtggcttatggttttaagaccatcatgacagggaacttggcaataggtagtcaggcattgttcagaggctccagagatctaacttagagcttatatctgatccacaagcataaggcaggaagacagtttgggaaagctcaaaaaccacccctagtgatgcacctcctaatctttcccaaagaattccaccaactagagtaccaaacattctaataaatgagtctgggggggggcaacattctcattcaaacaaccacattccactccccatatgtctgtagctatatcatagtgaaagatgtgtttagaacaacttctaaagtcgcacctcatcatgaaacttctttaataagatagaaatcctgcgaaaataatggattcatataagtgggaaggagtttgctccagagtcttggctgaagcgtcttcaggtgttatgcgttctagctcaatgaacattttctgtgaagattgcgtgcatagaaacaatatttcttttatatggagtgattttatatttttagtgtaaagcagataaagaaggtttattccttttggtcaaactgagtagaggcacacagaggacaagtgaccacccaactccatcttttagctacgtggagatattttaaagaatgttaaagtaacaataaaccatgtttaaaatctaagtttgtactatattttacatttcctacataggaattgaattagaaaaccaattttttaaaacacatgttaacctccttgtgaaactcttatggcccatggttttatcttatgtctgcagatatggttgactattcatccctaaacaaggtatttttctatgcccttttaggcttagggaaatacagaacaggaaattaaaagaatttaagggctaaaaaccaggggaaagggctgctgaaaaaaaatgaacatcttctgaacaagacagaattataactatgcactcataatggcttcagatacacacagaataggaatgtcaatctaggtatacattgaagaaaggtttgcaagccctactactcatctctaaactagatcctggaagagggatagtcactgcctccagttgtgtatataccgaacttcagtagatagtccaaatccagttgttatataagctgccttggttaaagaaaatgggtcacagggaaaagaaaggagggaaaaaaatagaagtcaagagttaggaaagggaatgggtagagggaagagagaaggagtaggctatagcagggaggatggagggagaaagtcatttcaatgcaatatatacatacaagaaattgtcaaggaactaactagatgaaaggagggaaggagcaaagtttcttagcagtcctttgagatgaaactcaaaagccacccaaatggcatacatagctactgctatatttaaagcacagctttatatatagtgaaaagtcagcagccttgttcttggatatgcttttttctttcccgagagtctttacttctgttttcaagaaactccaacattgtatcatactgaccagtagtaaccccagttgatatcccttttgacagtatctctgggctgggtctcttgatgtaacacatctgactaaagacatttatttaaagtgaaacagaagaccaggtactgtggcttatgcctgtaatcccaggacttggcaggctgaggcaggaggattatcatgaatttatggtcagcctgtgttacatagtatattctatgccagtctaggctttgaagatttttgttttcgttttttaaattaaagggtagaaacatttaaaggatgacatgttttgacttctttctttccaatttgtatcccctagatctccttttgttgtcaaattgctctggctgggacttcaagtactatattgaataggtagggagagagtggacagccttgtctagtccctgattttagtgggattgcttcgaatttctcaccatttagtttgatgttggctactggtttgctgtagattgcttttataatgtttaggtatgggccttgaattcctgatctttccatgactttttgcaaactttatatgccccagtacaggggaatgccagggccaagaaatgggagtaggtgggtaggggagcagggcaggaggggggtacagggaacttttgggatagcatttgaaatgtaaataaagaaaatatctaataaaaaatcaaaaaaaagggaaacagagctaaaaaaaatgacatgtactaataaaatactgatcctaaggttatgagtactttttgccattaaatgcattttctcttttaatagctattaatttttccataaaatattcttaaatattgattgcatttgattatgtgaatatttattgagtattgaattattatttgatatttctatatttttggacgttttgaaacagagctcactcatttgtatagtcttggatggcctgaaactcactctgtagactagtctagcctcaaactcagagatctgcctaccttttgccccaaagttctgggattaaaagcatgtgccatgtaacctggcttagcttaggatttagacagtttactcattacttttgtctggaattgttttcatgacatcagtgtaactaaagggaaggaaaagtaggtttacaagcaatacaaagttttgttttttcaatcacgatttccagtaaataacagcagctttccaaaaggaagaattttaaacattttggattgagagcatttgtaatttgaaagagtcatggtcattttctagtagacacattaggatgggagcttagcagatgttaggccctgtgcttagttctagtcacaccccctcaatacaatatttattcaaagtgttgagccatattacctcctgcaacctttcctcatctcaggtatgaattatcaaggaaaataaaatttcaaagcaaacaaaccttgatgaatttagttgggaggcaattctataataaagctgaaaataagacctcagcatggccttttccagcactacaggatttccctataataattacctctttaaaaattaaaggagagagaagggttagaggatggtagacactaagacaggagttttccttattatacccattctcttagttacagtaagaatttttcaacacgtgctgtttaaagctaagtacaacaaaattttaaaggtttgaacaaagatctctattgtcaagaggatgtagatttttctcattgggtcttgaagtgtataggcaaacgcagctgggagaaatgagagtggcattccattagacatgccatgtacatgctctttgaggattctgcacgtctcttcgccattcctttgtcaggtactcataagggagtgtgggagggacttttggcttttccacattgctgccttcatctgtttgatcacagcaagctgttaggcttgactttattaatgaagcagagagggaatgctcagaagctatcttggataccaaagaatgagtaaatggatggacactctgctttagtagtttggtgttgtgcactaggcaggaaatagtcttgctctgcatggctgtccaaaatatatgaaagagctagctttgaagtttccagggcagtgtagtgtagtgatttagtttagagcattgatatcatacttgattttagttgtttctcctcttactaccaatgacactattattagtagattaagatatattaatgcccgacagagttaatatttcataaatgaaataactgacttcccatgggatatgtaataatttttcaaatgtaatttagatcaaattataatttttgtgtaatacatattaaaatattattagggttggtcttagacctagtttatttgtctccctttccagtccatttttgttttctatgacactttaccataggttgaaaagatggtgctaaaacaggtttttagtttatcttatgaatatttgttagtcactttgtgatttgtgtatatatcaatatttgatatatttaaaacacatgcacttttggaaaggtggtagcttattggaaatgaaatggctccaaaatagaaataggaaaacagggaaatgggaataattctaaagagaaaatcagaactaacatgtttgtatgcagctccattgagggagaactgttgaaagtactttctcgcaatttcttaggaaacgtttgtagactttacattactagattacttttggttaaactgagtgataataacagggaagctatgaatatctctgtgcatatatgttacgtttgtgttgattataccatcttacccaaagacaatttaagtaaatactttaaatatttcagtaaatacagcatggcatttagcaaattttaaggaaacaagtgaataacttagctattccaacaatgttttgcctccgcattccttggcacaaacagagacctcaatgaagcatccctcacgggagttgcctggggacatcttacagaaaaagcccaggtctcaattcagcctcctcctttattattttcttttgtaaaatcattattattggagtataatttacatatgttaaaacacaccaagtcttagtgaaaatgttagcgaattttgacaaacatgtttactcacagcatcagagtactgaccagtttcaacactctaaatagtcagactcgcagttttgcaaatcaaactctatctgtacactgggaaaatgttgaactgctttgtcactatgaagatctacgtacaagccactttggacatgtgattttcatttctcttgtatgaatgcaaaagaataaatttgctgggtcatataagaatatatttaaccttataagtaacactagaagcatttgctgaagtgattgtattatattacatttccaccaacagtttatacatttttttaacttactgacttactgggtatgtaatgcaggacttacatagcatcaggatttttcctttttctttcttttctctctctttttccaactggatattttttatttacattccaaatgttatcctctttccaggtttcccctccacaaaccccctatcccatgccccctgcccctgcttctatgagggtgctcacccacacactcctacctccccgccctggcttttccctacactggggcatcaagccttcacagaaccaagggcctctcttcccattgatgcgctacaatgccatgctctgttacatatgcagctggagccacgggtccctctttagttggtggttgagtccctgggaactctgggggttctggttggttgatattgttcttcctatggggttccaataaccttcagctccttcagtctttcccctaactcttccattgaggtccttgtgctcagtctgatggttgactgcaagtatctgcttctgtatttgttaggctctggcagagcctctcaggagacagttttatcatgctcctgtcagcacgcacatcttggcatccacaatagtgtctggttttgatgtctgcatatgggatggatccccaggtggggcagtctctggatggtcttttcatcagtctctgctccacactttgtctctattttgttcccccttctaagaaggatggaagtatccacactttggtcttccttcttcttgagcttcatgtggtttgtgaaccgtatcttgggtattctgagcttctaggctaatatccacttatcagtgagtgcataccatgtgtgttcttttgtgattgggttacctcactcggcatgacattttctatttccatccatttgccaaaaattccataaatacatcgtttttaatagctgtactaatagtttttaatagtagtactccattgtgtaaatttaccacattttctgtatccattcctctgttgaaggacatctgggttctttccagcttctggctattataaataagatcagagtcacatcatgtagccccgcctggactagaacttgctgcataggctaagttggccttgaactcacagagatccacttgactctgcctctctagtgctgggattaaaggcctactccaccacaaccaactctcaatcaggatcttttatattatggctatcttggtaatggatatgaagtaattatcttggttttttaaattgcattttaatttttgttgatcttttcatgtggttattgaacattcaaatctttttgtcttgagacaaatatcctcttaaaatgttattaatattatagtaactgcgtgtatttgtgatgttaagaacaatttacatattgtcattgcatcttcttttttatttatgtttttatatgtacgtgtatgatccaaggatacccaaactattttgcctagtctgtggactatatttttttttcttaattgtatatttgaattagaagaacttaaattttttgatataatgtcaaatttatcatttaaaaatatttatcattgtttttacattatgtacaatactcctttaattattaaatgttgcttatttttattctacatatttaacttaatctctataattagtacttttgagccaatcagaattattttctgtacagtatgaaataaaggccctacttaactataaatatttttattttttcaaaatactatctgacatccgaaaagtacattgtgtccattttgtccttccccagcctcagaaacccctcagtcaccttgtgtaatgttagctttatccattctggatttttcatagagttagaatcatacattccaacctatacatctctttaccaacattttaaaactttttatggccattataattaaacagtatttaatgtttctttgttatagtttcacttttcattttgtaatctgtaaattttcacatgttttgtatgaatttgtccataatttttgtaacaatatctctattcaaagccttttttaaaaaatgggtcatatgtgctttttcttttgatttaaaagagaaatgtatatattctggatattagacaagttgattatttgcatatattttctcccatttcatagttgtcttgtcatttttgtgataatgtctctttattatattgtcttttttttttaagaaaatgtttcttttagcccatgcttgtcttgaactcactatttggacaaaactggccttgaattcctgtgtgttctatattgctgagttacaagtgttaactgccattcctggtcctaatgtcttttgatatgtaatttaaaatttttcttaacgcctatttttttattttgttgcttatacttttgatttcatacctaagccacatcaaaggcaatgacgatttggctctactttctcctaagagcgttctggatcccacgcataaatccaagtcattgctctatgttgtgaatgctgtggagtagaggttcagttttattattttgtgtatagatttctttttgcccagcactatttgttaatattatttccctattcaatactatcctcacttttgttagcaatcagtttatcataaatatgtgggcttcttactggattctcatcatcccagttccccacagtttggtgtacttatttctctacatttaaatttgtaatcaagaatcacaaatcatacaagatctttttctttttctagatagttttgagtctttgggtccctctacaattccatgtgacttgaagaatggcttttatgcggtttgaagattagcttaccatttgtgtaaaaaaaaagaaaaaaaagttgttgaaattttaacagtgttttcattgaatatatgaattgctttggatattggtgcaattcttaaaggcactaaatctttcgatctaagcactaaattattcaatgtaggagcatacactctctttccatttacttgggtcttttgaaattatttttctcaatgtttggtaggatttctgtgtctatgtcttttatcatttagattaaattttatccctgcataagttgcttaaattattttgtaagtgtaatttcaaaattttaacattattttatgtgtatgggtgttttgtctgcatatatctatctgtacactacatgtgtgcctgctgcttgtggaggccagaagttacagattgttttgagttaccatgtgtgtgcttgtacttgaacctgagtcctcttcagtagagactgccatatccagggatccaccccataatcagcatccaaacgctgacaccattgcatacactagcaagattttattgaaaggacccagatgtagctgtctcttgtgagactatgccggggcctggcaaacacagaagtggatgctcacagtcagctaatggatggaccacagggctcccaatggaggagctagagaaagtagccaaggagctaaagggatctgcaaccctgtaggtgcaacaacattatgaactaaccagtaccctggagctcttgactctagctgcatatgtatcaaaagatggcctaatcggccatcactcgaaagagaggcccattggacttgcaaactttatatgccccagtacaggggaacgccagggccaaaaagggggagtgggtgggcaggggagtgggggtgggtgggtatgggggacttttggtatagcattggaaatgtaaatgagctaaatacctaataaaaaatggaaaaaaaaagaaaactcagtattcacaaccactgagccatttttccagttcttggaaatgttttcttgatttcagttttattgtaaatatgtataaacaattctgtcatggtcttatataatcaattgtgaattttcattacttattaacagatttcaatcaattgtgtcaaatatgctcattgtttattttgtaaaattaatagttttagttatgccttttctttaaattattttattctgaatgtgtgtgtgtgtgtgtgtgtgtgtgtgtgtgtgtgtgcaggctgatctttgtgtcctttgacagttggattataatggagctctctggatctctttgaggttactctatgtagaaatttttgaatgtccatactcatatcctttagcatacaagtaaatctttttcatattatttcttcaaatgatttttttcctgaggcattatctttctctttttgttgcagactaccatcatgtgtatgctggactgtttaatggggtcatttaaaatgtctctagatcttctcaattttcatgtttttgttttaaacaggataattttgaatcttttatcttcaaatttgtgggtagtctcttctgctaactaatttttgacccctggattaaaattttcatttcaaatattgtgattttttttaacttattaactttctctttgattcaaggcaatgaaggtctacatatggtttctaaaatagataattctacaaatagagactctctcataaaactttctgtgttctttataagctttgttgatattttaattttctcttatactgctattgtggtttccactcaactttataatttagtacagaattttctttagttccttgaacaaaattaagatgcctatttcattgtttgtccagtaaagccaatgtctcaatgttttcagaaatgaaagttcctgatttggccatagttctattttttcttgtacttttgtgttttttttttaattaacaaatagatgtttgactattttaactgggagtcaaatccttacactctactaatgttgttactgaatgctgcagttagccatttgtttaaactctttccaactatcttttgcaaagaccatctctatttctatgtcttttgttgaaatcagcattcatttgctggacttcagcttttatttttcttttgcaatgctgacactcaaatctaatgcctcacatgtgctagacaaacactgtaccaactcatagcttatgctagaacaatgtttttatatacagctccttgaaggaacagaatgacagaagaataatgaatgtttaaaatgaagaagtagcttctttttagagtattgattttgcttttgggtacttctttaacatctctaggcaatttgtgtagttatatgaagatcagttaaggtgaaagttttcaggagttttcttgtgtgcttagatttttaaatatctcagtaccccgggcatttttcattaccctaatatttaaaataagccttcttagctttcttgacctcgttttggtgctctatagtatatgtcttacctttaaattttacccaaggcaactgaatattgttctcttaaaaggtttccaaagatgcttactgttctttttatgagttaataaaaaaatcagtgttttgcatcagtcttttaagtaattctcacaggacttggaactgataatttagaatgaaagtttgtaatgctctttcaggaaataaggtaagggtccttaactacacacatggatgatctctttcagccacagagtcaagcgaagtagatgagtcaagggcaaacaaaaccaaaacatatgttctgtcaaagctgctgttggttagtgcttgattttctgtgtttctatggtgagatatgtgcctagtcttgcctagtccaccatttcactgatgttccaggtttttttttttttctagtttcaacatgcagttgttttgcactgctgttgttattgttctacttttgaaaagatggtagattatatatttaattgtatattggttttgttgctctttaacaaaccatgtatggatagcctcaatttctggaccctgtagccttattttgttgtttaatctctgtccttataccaatatcacactttcttgattgctataattttaaattaagatcgaagtaaagccagtgcaagtttatcttcattatgaaaacttccttgtttacatataaattccaggaattgtatcctaatttctgagaagttgcatgggattttgtatttgtcttataaataaattcacacatttcctgatcttcagtttgctgtttctttaagctttctagcaggttcttttatattttatgcactagttttcttatttattatcttataaattcttccggatttttttgttttgtttttttgtttgtttgttttttcgagacagggtttctctgtataaccctggctgtcctggaactcactttgtagaccaggctggcctcgaactcagaaatctgcttgcctctacctcccaaatgctgggattaaaggcatgtgccaccacacccggctttggaattttttttatttctatttgcacaattttaaaatgattggttttgaacaatcctttgaaatcttcattgaaagctcagtgcattagtattcagagatgagcctccaaaagatgattggacccataaggactgtaacttaatcagtagttcattccaaatttttagttcaaaccccaaaggatttaacagtcctaatggagtcatggcctatatggaggaagttgattactgatgacttcattttaaagggtgaagtcctttatcttgtactcaatgtctgccaatcccaattcacatcttgcttgctgtctggccaccataaggtgagtggcttctccactacatgtaccacactctctaccatgatattcttctctgctttaaactcttagcaattgaatcccccaatcgtgaatagatagaagcctgtgaaactatgggtccaaattaatctttcctgtttaatattaacttattttaatatgctttcattattttagaatatcatatatatgtacatgtattttgatcttatttattcctcactcctctctgtaactcctcccagactcactcctcatttactataaaacagttggacatatctggagatattctttactgttaaactgtctagtgagtacaggctagtgatgctgctgagcattctacaatgcccaccatggctaatcactcagtttctatgacaacgaatcaaccagcctgcaatactgcttctgtagctaaatactgcattaggtgtagggtttaaaaacatgtactgtttttaaatcttttatatgaatatgttgtatggagaatatatttgttctcatagcccaccattctttccttttatctttgatttttacaaatgcagactctatttatcaaatcataagcccagattagtaagcacttttctttgacaattgtctatcaccgagaaacagaactttgtgaaaaagcactacacacattttaccaaaaaacatttttacatgtttgaaaatttaataattttgagataccatgtattgatcaatgaaattttggaaatggtgagttctttataagacagtggtcacacctgtctctggagctcaggagttcatatcctaaaagaggagctagctatcaaatgatctttaagctgaaatttgatttattcatttatttaaaaaccttggatagttcagcagttaagaatactggcaaaaaacaaacaaacaaacaacaacaacaacaacaaaaacaaaaacactggctattcttccagaggactcaggtttaaaaacccttgccttatgaatgaaaatattgatcagaaggatatgtgacttattttctcctttttgacttatcctaaaatttctgtttgaaaattgagattacaatatatgtcagaacctcatggattctgattattagttatttttctcatttctgtgacaaatactgggcagaatgacttagaaggaggaaggactaatttgaggatgcaattaccaaggtagatggacagggcagagcagagaagatcatgcccaatgcatagaagctgtatcagagagtccttgtggttgctgcctttctccttttttcatttacttctcccaggtcccaaattagagcatagtgtctttcagattcaggactgctctcaatccttagtcaattctctcaggaacctgcctcattaaaccttctacattctacaggtattcttaactaattaatcttctaggtgcttctcaaatctatcaagctggcagtataaattaactatcacattatacaacgtagcactattctatgagatgaaatggcaacatttgtttatatgtgatatataatataaaacatattatatatgtatatgtatatgttagaatgtatggtactgaggggaaacttagggtcttacactaactgggtcaggctctacactaaactagagccccagccctttaaaaaagtcttggactatgattttactaaagtgctcagtctagcctggaacccactatagtatatgctgtcttttaatccatgttttttctgacctaacctccaaagcttaatttaattaattattgttacatgtatatatgtatatgtgtatacatacgtgtgtgtgtatgcagtcataaattcaacctgattagcctgtataataatacttatatgaatgtttttgcgacttagccaatcagtactataaaatatattcacattttacgtaaaatatgtctttaacatagtccagtggcccagcaagtgcaagtagatttgagtatattttaaaataaatttttacaactccatgtaaattatcatttggaggctgtgtttaaaattagacaaaaataaatccaagaatttcaatctgagacattacagtggcctctttttgttgaggaatgcttccaggagttggagagtaccaaagactaaccttggaaaatagctaagacatagaatggccaagtgagcatccatttctgtatttgccaggcactggcatagcctcatacaagacagctataacagggtcccttcagcaaaatctttccagcattgtgcaatagtgtctgggtttggtggctgattattgggtggattcccgggttgggtagtctctggatagttataactgtcttgtatgaggctatgccaatgcctggcaaatacagaagtagatgctcacagtcatctattgaatggaatacagggcccccaatgaaggagctagagaaatcacccaagaagctgaaggggtctgcaaccctataggtggaacaacaatatgaactaaccgtacccccggagttcgtgtctctagctgcatatgtatcaaaagatggcctagtcggccatcagtggaaagagaggcccattggacatgcaaactttatatgcctcagtacaggggaatgctagggcctagaagtgtgagtgggtgggtaagggagcagggcagagggaggttatagggaactttctggatagcatttgaaatgtatataaagaaaatactaataaacaaaattggtctttaaaaaaaaaggaaaaaaaaagaagaatggcaagtgaagggatgtaatgatggagaagatttgagagagaggctggattcctgaaacaaatcggagaacagggctgggctgcatttttgagactaagctgcccaacagagcttcatgtttggtaatgtggaaaagaattattactactttcttgaatatcttaccacaattgggctgtcaatcgttgggatttttctagtgaaagtagtgctattaatacccactattttattgtcttgggtttggttgctcaatttttccatgtgtattaaattctgagggctacatcaacagcacaaacttgttgacatgcttcccatgatggtcatagactctaaccctctgaaactatgagccccaaattcaatgttttcttctgtgagatgctttagtcatgatttcttgtcataagtaagacaatgatcattgtcaaagtaagacaacgacctcatctagcaataacacattttcaaacttttttctcagaataagagatcacaaataagtattcctggaaaaggagacatttactcaatggtgtaaatgaattatagtaccttttgtcctaagaaaatattttgttgttgtttgggttcctagtcacttccctgttgctgtgaagaaacaccataactgaggcaactcttaaaacagaaggcatttgatttgggcttaaaatttcagaggcttagcccattctcagcatggcagagagcattgcaatagagagcatggtagcaaggagcaatgcccgtaggcaggcagatatggtgctggagaagaaattgaaagctacatcctgatccacaggcagtgagagagaatgagtttggcctagccttttgagacttgcctttgcttgtggagtataagaattataactttgataaggggtaggagatagagataggaacatttttattttacattttagaggatgtttctactttatagtgcaaaagcaatttctatgtacatactgatatgagttttgttgttcctggttgatctttggcctagattttgcttgagaagaatgctagtaaccttgggaatctatggacttccattacacagagagattacaacttgggaaaagttcagaagttaagaagaaaaccaaaaacacaataatctcagaggaacaagaaagaatgtctacctttgttctgatcccctataatgtaggccaatgatggcctgaaagtagcagttgtgttgtagttacttctctggcctaccaaaatgcttgctttttgaataaattgtatttaaattaatcaaaaaagaaaaaggaaaaaaacagacatatgcatcacacagttctggaggtgcaaagtctgaagttgatggactggcagggctgttctttacctgattgctcctcttcctcacttctaatgatggtcagaaattcttatattatggtttctagccagtgagtctctcatcttggtggcattctacatgtgtgtatctctgatcaaattcctccattgtactcaggcctaaggccctgaatcaagtatgaattcatatgggttcattatatttacaaagactcttctttcgtttaaaataacattctgagatagtaaagagtacatgaactgggagacactatccaacttaatacataatatataagacttcttccttccttccttccttccttccttgctgtttttggcagtactgagaattaaactcaagccaaaagcgctttatatattctaaacttccatcagattctaatactacactcattgtacaattaacatagcacaatcaacaagtgaattaaaattccctataaatttcctttaaatatttgtttgcattgaatgggatatcagataatttgcaatggtttaaattatgtaagatatttatcttaaattttgttcctcattgatatatcatacttataaaatatattttatattacaagaaaaatagaattttccctcatttagaagtttaccaagtggccagaattcgcatagaatggtttaaagtcttgctatgtctcataatttttcccttcaatacctaagccatgttatagggaaggttaaaagttcaatgtgtatttaaatgtattcattgattcataaatgcctctatacttttttttacatcaagtaagaaattgttattatagctttgtctatggcactacagataacttccattacagcacttaacagagtcagtgacatttcatcattaattacttatgcgtctatctttctaactaaattgtgaaatcatagaggatgtaaataaattcctcttcagcactcattaaataaatgaacttggatacagcttttccataatcctaacaataaagaggcgaaagtagatagatacagtaaggccagcctaggctacatactgattttgaagccaaccttggtcatgtaacaaaacttcctcaaaaccagaacaaatccaaaaataaacaaggcaacccaatcacaaagggtactatgctacattattatatttaatataacattttcaaatgataacattttagaaagaagattagtgaattccgtagttgaggacagtatcaagatgcatgtttttaatgtggaaacctttagggttgtaactgcagtggcagccattgtaacacacatgcatgataaaattgaacataactaagacacagatgaaaatcagtacgaataaaattggtataatgtatgtaatatctatattcaacacatatcctagctatgagcatagtcaatcattttgcaagctattactcttggaggggaatgggaaatttgtattaggggtgtctacatcatttctcataactccctataaattcaaaagtttgctattataaaatgcttaccatttgaaaacatatttaatctgatacataaattggatttgattgtcaacagtgagcattttataaaataaaactcagtgtgctgacaaggctcacatccttattgttgggatttcaggaatgtgccactgtgtttccctagttttttttttccattttctaaaactgctgcattgcattccatattccatatgtattaatttgttaacttacatgttgaatgaaatttatgccaattccagtttggagctctttcaaatgcaagttctataaatattactgcaaaaatttttgtgtgaacatgttttctgtctttagtataaatgactagggctacaattgctgtttcctatgacagttacctatacaagtcataagaaactaccaacctactttaaggaatggcaatccctcattcccttcccaaattcaccttgtaatcctgaaatctccccaccattatcaacatgttatcctttcactacatagtgatgtttcagtgtgcttataacatgcagttccatggtagctaacaatattaattatttttatgtgttcatttgccacctgtatttccagttctatgaaattgccagtcagcgtttttccaccatttttaacctggtctgtctgtcctttgtactgtttgttgagaaatctttgtatatcttagatcccactactctgttggaactgtgatttgcagacaccttccctgagtgtataggctttataatctttaagtttataatcgttcatagaaagattttaaatatgatgaatacagcaaaatctaaatcaatactatttccttttgttgattttgtttgtggtgcaaattaagaactctctacctggtcctagatagtaaagatttccttctagattcagttttctacataatttacaattgtagtcctaagtctgtggtccattctgaattaatgtttttcacagattctattttttttttttggaatttagatcagcaaagtggccacactgagatcttttcatggtagatatctttaaaaaatttattattattattattattattattattattattattgttgttgttgttgttattgtttcaagacaggttttctctgggtagctgtggttgtcctggaagactgttgctctgtaaaccatgctggtcttgaagtcatggatctgtttttgcctcccacgtactgggattaaatacttgtattaccacaccaggctcaataaaatatttttcaaaaaggttgtcaccatgtgaagatgatgatcacaggggcatttgagaaggtgtgggaggcaggatcagtacttaacagagtaggtacaaaggccaactctggtgtgtgcatactcagcacttggtggcagacaggtagctgtgggccccaggctgaccacaggcagcatagctttcttgcaggcagtctccagagcttggaggttcctaggaacacatgccttaggatgaagagacaatgcccctgacaggaatgtgttccttccagggaggagcctttgggctgcaccattgggatgctatcgggctgcctgtgtggagatcttcttgccttgctgtgtacctactttcccccatggcttaacttttcactgttgtgcaatgtttttagttgttcatgtgttaagatgtattcacgcatgatgagtccagcaggagtggcaaagtaggtcctgagacccttctttaaatatctgaaacacactgggaaatactaaccccatcaacttgtcaacctctcagagcataatcaaaagattaaagcaaccaagaaaatacttgagggttaaaaataataataacagttgaatttcagttacagagatttgtaccattatatgtaccctgatttgtttgattctctgccctcaagcttgaaaagtctttgaagataacagtctgcattttactgtattcgtctgtttagtatagtttcccaggacaggagaaagtagaagtgaccttattattaaagaattctgtttttctcactttgagcagtgtagaagtctcctaaagggtcagcttacagggcatgttttggagaattcagaactctctgaagaatgaggtagtttagttgccttggtgcatttatgacaaatatttaagaataatacattatctactgttcttgggagtacgaaggatgccatttggacaaacaattttgaaaacgtgatatgaaagcccaagaaataatatagtttgaagaatcagggcaaagttgctcagaggagacctgcaatggcttgaaaccttctagttctgcatgacagatagtggtgtctaacttagtataggaaaatttttgtgtaagtaatgggactatacacatttaagaagacaacactgttttatgcattataggaagtctgtctccgatggttaatagctccccagtaacacaataaggaaagattttagtgaccacacataacatgaagtctagaatacaaaagaagcttagaaaagtcaccaaaaaagcagtaatgaccccaagcattgttaagaaatcctgtagatggatgtgaatgtgattttatatttactccactataatattaagaatgtactttcctttcttctaccttatagtcaagcactgcatgcccgtgctacatttgtagccaaaagtattctgtttttatagaaaagaggcacacacaaaaaggagaaaatgaatagtataaaaattaacataattttctcacaaggtggtccacaaatcctatttactacgaaatggcattatatcagcatggagagagtttgtatacaaagatctcagagaaactttcaggatgatctcatactcaaaagaactactcaagaactattcctgccaattagaggacctgcttgtaatgattttggacatatacccaggagtaacacgtcaggattgcaagataattccgctcttgctctttagaggagctgtcatactatttcatagctgtaccatttttatattccaaccaataatggataatggtttctagttttttctgcatccctggtcacattatgcttcttagagtagcgaatctcatgtctcaaatggtatcttctttgtgtctttgacatcatttcctcaatggttgttgacagtatctttttgagtgcatgctgattgttttctgtatgttctgtgaagaaatctacttgattcctttgttgacattttgtatatggggtctttctctatccaaaaaggccttaaaatcacaaccttcccaaccccacctcctgcatgctgtttattatatagttggattttttttacacattatcatctccttttctcacgctccctctcaccattacaatctccagcatcctttctactttcatgtcaaatgtatagtaaatgtacttggagaagtgatagatgagatcatttttatcttaattcagcccctttggggaggaattcaatctagtggcctggcatctgttttgcagtatcatatgctgccttttatttacatactccacttgatgaaccatgctgtttgtagagatcgtgagtcaatatatgtactgatttttcacttccattatgtttattaaaggagaatacatgaatacttcatgtacataggaactaaacagcagctcatgttttaaacccacttctttctaataaaaagatgttaaaacgaatggtgtctgtggaacttttgctgaggggggaagagagggataaatgaaactaagaatgtttggaaaagctataggaaaatattatttcatgttttcctaaaacaccacacacacacacacactttttggacatttatttggagtgaggatgtaattaaagacaaagggccttaatgtcataggatttgcttccttaaaatgacatacatgcaaaaacctttgcttcctctcggcaacataaagctgataccaaaaaaattaaaccctgaaagaacattgatctttgagttttaagccttcccaacagtgacataataaattaattttggttcagacagccagtctgtgatattttcttatgggaaacagaatgaactagcatgattgcagtgttagtaaaaatcaaacattccaaattacaaatttatgcacttcatattgagagcacaaaatagtgtagcttttaatattggcaagccagaataacatttttattaaagatatttgcttgttcctcatcctgtgagcatgacagattctttcctttgtgtaactatgcactcttacacctatgtgaatgggcttcagccagtattaactattcttatgactaaaacaaagtatcctttatctgtgtaactggagtgttgacaagtctttttataaagaagttatagtcttgacagagctttcttacttaggctctggatatcatggctttaggagataattcttatgtgttgtctttcattctgtgagttgtctcttctctttgtgaactgttttctttgctgtatagcagcttcttagatataatcccaattttctgtttttgcttttgttggtttctttggaactcatatccaagaagttattgtttatacttatacaatcttaggaaagtttttattacagttatctatttaatgtgtgagtggataccctgatgcacaggtagagtttcgaggtcaacttaacaggagttcattttcttcttccaccatgtgggtgatagagattaaattctagtcattagggttagaggaaagcgcccttacctgctgagccacttctctggcccttacactgatatttctaagtgttttcttttagtgtggtggttctcaaccttcccaatgctgtgacctttaatacatatccccatgttgtggtgacccgtaaccatacaattattttgttactacttcttaactgtacctttgatactgttatgaatcaaatataaatattgtgttttcccatggacttgggagactcccgtgtaaaggttgtttaaattcccaaaagagtcatgacccacaggctgagaaacacggtcctagaagtttccttctttaaacacatttatattattttctcaagaacttcatacatggtattttgagcatttttcaccttcatctcctcccatatgtacctttactccataaacacccaactttatgttaaaaaattttaaaacacattagtgctatctatatacttttaggtggatggtcatccaataaaatacattagacttgtcagggtctgcacccttgaagaaaactcactctttcttttctcccctggcatctatcaactaccaaaaattctttagctagggatgcagctttacagtcaagtcctccttccatgctgagattttctcttgctgcatgctgtcacacctgctgggaatttggatgcacaaatgtcctattgtgtcaggaaaacactgtttccttgtactcacccagggcccctggctcttattctcctacctcttctgcaataaaccttgatctttgggaggaagaggtgtgatacagatgtcccacttagggctgagcactctgcagtctccctattctctttactttgactagttatgggtctctgtgttaatttccatctattgcctaaaagagaagcttttctgatgaggtttcatatatatgcctagctatgggtacagcaaccagtcattattagttggtttattactatgtctcattaccagagtactagttgtaggtgctgcttcagggcttatgatttgtcaaactataggttcttgactctgataactatatctgtgactctgataactatatctgttatggcctctatcttgtggaacagaccttgaatctaatgagaaaatgatttggtacttctatgatattcttgctactgttataccaggaactgatgacatcagacaggttttcattatagcacacaaagttcacagttaggtagtattgatgaatacatttcttctcttacagaatgcatagtcccttccagcactatgaaatttagcctgtgggagtgaagcttcaaaaatttcctagtttaaagttgaaatctgttagaacctgtaggttatgataaatttttatttgattttttggtgccagttggtagatatgtgttatagatagctcttcttcatttgacggtccagtcttcctggcatcatctgctgaagagaatgtttcatctctagtctatttttggtgactttatcaataatctttttgttttcagtgacaagagccaccattaggagctggcatactagtttgatgtcttaccattaatttatatcccagctcatatgatgtgtcttgaaattagatactgtagtatttctaattttcatctttttatttcatatttgtttgaccatccgaggtctttttgattgtattgaacttacaaagtcatttgtgatatgataaacagcttaaattcttctggtgatgaatatacttttatatagtgtgcatgtgtcttcagtttgttatgttagtgttttgtaattttcattttagtcttttctgttcttagtaaattaatttctcattattttattttgtattgctttgaatggtactaatttcctaaaatgttgttattggtgcataaaatcctattgacttttgtttcttgactttaattttgtcaaatttctgaatttatcaattttaattgtatattaagagattttatatattaataggttttatatatcacactatgcataaatagggacaatttgattttctgcttcatgtttgcatgatcctaattccttttttcttgcttaattgctctggataaaacttccagttatatatgcaataacagtaatgagagtagacatcctcacttagttctagatatttatttatttgttctttagttcagactttattcccctccctgtctaccttccaactgttccccaatctcctcccctggtctccaagaggatgtccccactgcccctatcccaccccaccagaactccccactccctgggttcccaagggttaggtgcatcttctctgactgagtccacacctggcagtcctctggtgtatatgtgttgagggcctcataactgctgatgtatgctgcctggttggtggctcagtgtctgaaagatcctgggattccaggttagttgagactgctggtcttcttatggggtcaccctcctcctcagcttcttccagttttctcctatttcagctacagggtcagctgcttctgtccattggttgagtgtaaatatctgcatctgactctttcatctgcttgttgtccctttaagtttttcctaactcattatggagatttttttgttggtttgttgtatatatcttttattttgttgaggtataagcctagtacacttgattggtttggaattttccatcatgaaggaataataaggggcaatgtttagttttttttttttttgttgttgttgtttgttttgagaagatcttctctgaatagccctggctgtcctggaacatatcatgctataccagttgttaatgcaattaacagggttcactattttccccagcagcctacacagtaccttccactactatgaaatctagcaaccggggaggaaactttctggtcagtatcaaatttattttcccatgttctgtgaccaaacttcatgacttctgcaatatggtcttagcatcaagttatagtggctaacaacgggttatggcaatagtttagaaagcttgagagtctttgggacacctctggccaatagtccaaaggtaacatttccagacctgcaactgggctatttaattgataactccaattaaactctattatgtacacatattttaatttatatgtgtgtgaatttatccacattatatgtgtgtgtgtatgtatgtatgtatgtatgtatgtatgtatgtatatgtatggagcttataaaataagagttttccatatggcatttaaagacatccttggtgctaattattgtatggataaatggataatctcttgtgtactgtgtgaaagtaccatctatcaatgacctattagcaaaaggcagaaagtggaaggcgggtttgagatgttccggtagagagattggaactctggaagatagtaagaggtggaagattcaccacctggacactgaggaaattgaccatgtgaaactgggaagaagaaaccagtcgcagctgaactcagggtagaataagccattttattctaacctgagttcagctatgtgggttgaataaaaaaaaattaaaaagaataaaatgggttaataagttgagagtaagggaaccagccgaggcattttaaaaaaataaaattaagcctctgagtccttattcaggaactggggcgcgggtagaaaagcctatggttacaaattacctctcccctatgtcctcctctttcataccttcctatccctttccccactctaagccctctaccattattgcctttccttcccttcatatctgtcacctgtgttctaccatccttcctctctcaatctctgtttctgtgtcagctgaatatattgttttataccttttaattatgctcctgtctagtttaagtattaggaccatatgaggaatctacaaattttaacgaagtaaaacaatccaatttaaagataggcaaatgatgggaaggtgcatttctcaaaagaagagatacaagtatataaatgaaagatactcagtatcattatccacctgagaaatacaaatgaaaaacaatgtgctacaattttacctactcagccttcagtcctggatatacaacttgttttgtttgttttggtcagtttatacatagtaaatattttccctatatctgacatgcctactcagcatattaaagatgatatatgttgaattcaattttgaatttttgataaaatcttatttaatattttatttatatctgttctttgtcttatctaacttggtttaagcccaaattataagaatgtttattagatattttcttcatttacatttcaaatgctatccccaaagccccctatgttagttcatgaagtttgcttattttttatttaaacattgtgggcttcagttatagttttttaatcattggtctattccaaattaggtatgaggtaaagaccgaatcttattttgtacataggggcatccagctgttctagcaacatttgaaatatcttttccctcttgattgttttgacagttttatttaaaactagccataggccatctcacttctgttttctttctttctttctttttcttcttcttcttcttcttcttcttcttcttcttcttcttcttcttcttcttcttcttcttcttcttcttcttcttcttctccttcttcttcttcttcttcttcttcttcttcttcttcttcttcttcttcttcttcttcttcttcattttccttttctttttcttttctttggttaacattatgatattgccacactatacctttaaggcagtggctctcaacctttctaatacagttcctcatgtcgtggtgaccacaaccataacactatcttcatggctacttcataactgtaatttttctactgttgtgagtttcaatgtaaacatctgataggcagggtttctgatatgcaactcctgtgaaaggcttatgtgaccttccaaaagggaagtgacccacaggctgagaaccagtgtttgttgtggcaaaattttgaccaccctaaagttaacatgcaaaatatctaataaagaaaagcaaacttttaacaaattataataaattctagtttcctgataagaattatgattcacctggagtactttcttcaataacctatccactataatttcctgaatgtcattactatcaactgaggacatatttttaataattgagcataactattggtaaatttgaacctaactttggttaacattgcctgggattcaaaaattgtctcaggcatgcaggataactgcactagttttacacgtaactctaggagtagacaatagaagaaaattggagaatagaataatattaagaaacctaaccagggaatttagacattttaggattcccttatggttcgtggacaggatgttagggagtatatcagactgaattttaattttgttcactgtcttagttagggttttactgctgtgaacagacaccatgaccaaggcaagtctcataaaaaaaaccaacgtttaattggggctggcttacaggttcattatcaccaaggcgggagcatgacagcatccaggcaggcatggcacaggcagagctgagagttctatgtcttcatccaaaggctgctagtgaaagactgacttcctggcaactggggtgagagtcttaagcccacacccacagtgacacacctactccaaccaggtcacacctctaaatggtgccactacctgttccaagaatatacaaaccatcacattcactatttcatatgtaaaaatatcatgtatgcgcttggtgagaattctagtcactgcatttctgttttccggatatactattatcttattaaccttgttgtttggttgtttctgtattccttgtaagtcatctctttttaataatagcaaaatgttttctggttgtattctattgtttattactttccatatttactaacatttcagcaacatttataaataatgttcatatagcttgacatttaatttattagaatctaaaattatgaatatttgagctgttgcattgtctatgcttagatacggaactggttcttgttctcaaacgtctgaaggccacattttttgttatggataaatttcaagaaatgttattcaaatgccgggtcaaccaagtctctgttctttttgtttttcttagcagttttcccagatttgactccttttaaattttgatttttagtttctttcaggtttatgatcctccctgtgcattctttattttgattctgcctgtcttcatttccaaattccatgtttttacaagttttaaaatcaaatttagtctgggttctctgatctagctctactttagctgtgtgcaaattttctttcacattgagttatcatgttcgcatgatggattgttccttgtttttaaaatttatttgtttgtttgttttacttattcactttacatcctactcactgccccctcctgcacccccctcccacactcctttccctttcttctctgaacatgtggtagctcccttgaatattcctccccaccctggcacaacaagtctctgcaaggctaggtgcttcctctcccactgaggccagagaaatcagccgagctagaagaacatatcttacatacaggccacagcttttgggaaagccccgttccagttgttcaggacccactgcagatctgctacatatgtgcaggaggcctagttccagcctgtgtatgtcctttggttggtgattcagtctctgagagccccaggggtacaagatagttgattctgttggtcttcccgtggagttcctatccctttaggagctgcaatccttcctcctatttttccataagagtccacaagctttatccgctgtttggctgtgggtttatgtctgtctgtgtcacttgacaggtcaggcctctcagaggacaataacgttggtgcttgcccatgggttggtgcttgcccataggttggtgcttgcccatggggtggttctcagatgaggtggttattgattggctgcaaccccagtctctgttccatactcaatccctaaatttcttgtagacaggttaaattttgggtcgaaagttttgtgggtggtttggtaactatctcgtcaccagggttcccacctggccacgggaggcaggctcttccggttccatattcctaattctatgaggcacagctaagggctcctctattgattcttggatgcctcccaatcccaggtctccgtctcttcctagagatgtaccccacctctatcccagcctcttggagatttccattcattctcatagccacacagccatgttccttgccacctcccattctcctcccaaccacctccctacccacttccctccctacatctgccttccacatccattccattcccccttccaagtgaggctcaagcatcctttcttgtgccctccctcctgtccagcttctttgggtctgtggagtatagtatgggtatcctgtattttatgactaatatcaatttataagtgagtacatatggtgtgtgtcctttagggactgggttacctcacttaagatgatattttcaagttccataaattaacctgcaaaattcatgatctttgtagttgaataatataacattgtataaatgtaccacgttttctttatctattattgagttcagggacatctaggttgtttctagttcttgggcattacaaataaagctgctatgaacacagttaagcaagtggctttgtgggatggtggaatttcatttgagtatatgcccagaagtgatatagctgagtcttcaggtagaactatgccaagttttctgagaaactgccaaattgattcccaaagtgatttttacaagtttgaattcctaccagcaatagagatgtgtttttctccatagtcttgcccacatgtgctagctcttgaatttttgatcttaggcattctgactggtgtgaggtggaatctcagagttgttttgattttcatttacctgatgtctaaggacatttaacatttttttaagtgtttctcggccattgaggattcttctgttataaattctctttaactctgtaccccattttcaaattgggtcatttggattttttgaaggttagcttcttgagttctttatgtattttggatataagccctctatcagtgtcgcgcccgctctcgaccagcaagaatgacgcgaccaccagtccttctaacagcagtttattcagtcctgattcttcttgtttatatctcccccgaaccctgggcctctcactccttttatactctctctcatccacgcaccgcaggccacgccccctcgccagtcacgaggcttcagctaatcagggcagcaggggcaaatctccaccaaattggattcacctgtatcctggtacacctgcgcagcacttaagatgtttgtgtcttatatgaggaagtcaggtgcaagtcatatgacttagctgcagtccctggcgcctttgggactgccgccacacccgctccccacatatcagatgtgaggttagtgaagattgcttttctcaatctgtaggttgctgactatgcctgttaattgtgtcttttgccttacagaaacttttcagtttcatggggtcccatttatcagttgatgattttagagcctgattcattggagttatgtgccagtgagttcaaggctctttctcactttcttttctattacattcagtctatttggttttatgtggtggtccttgatccacttggacttgagctttgtgcaaggtgaaaaaatatggatctattttcatttttctacatacaaatggccacttagaccagcatgatttattgaagatgctatcatttttctattgtatgtttttggcttctttgtcaaaaatcaattgtccataggtgtgtgggtttatttttaggtcttcaattctattccattgatcaacatgtctgtttctgtaccaataccatgagggtttgttgttgttgttgttactgttttaatcctattgctctgtagtacagcttgaggccaggaatggtgattcccagaacctcttttattatggattggttttgctatcgtaggtttttttttccatatgaaattgagaattgctctttccgtgtctgtaaagaactctgttggaatattgatggggattgcattgaatctgtagattgtttttcgtaggatgaccatttttaatatattaatcctaccaatcaatgagcatgggatatctttccatcctcagaggtcttctaagatttctttttttcattgatttaaagttcttgtcatacagatgttttacttgcttgataagagttacaccaagttattttatattttctgtgactattgtgaagggtgttgtttccctattgattcatttttcctataaggaactctacaaccctatctttcatattcatttgccaatcatctccttctcatctgtgcacaccggtctcatttataatgaaaactatgggatttttttcatcacaattgtataaaatgacaatagattttgaagagtatatagacaaatttttctttggaaatacttgtcccctatgactgatgagtatggacaaagtactgtcaattttaataggaaatagctagttttctaattactgaattgatcctatataggacatatatatatatatatatatatacatatatatatatatatatatatatatataaagaatataagtgggtttttgtatttgcattggtttgtgagcatgttataacattttccatacttcatagttgtgttttgtaattagtaatgcagttacatactttaaaataccttgccttttccttttggccacaaaggaaacaagcagcattgaagcgttcttgcactggatgaatatgtcaaaccagtgtttctgtgatttctgcttcttagaaaccacaaaatcaggatattttgtgtagaacacttgtctgaacgaatggcatagcaaaatttaagatcacattaattcattggactatgagtaccagttgctgagattatcagccaacaattccattaaaaatattcttgcccattcataagggaaaaaacaatttctcctttctctcttcctgtaaataggcaacaaggaggcccagagcatgttagtggattttaacactggtatagaaccttggatttggactcactagatcttaaatgcacttagaacacagaatttgattgcttcataggagacattcagacatatttatgttttgcacaactctgaagtttttcttcttataatcatgattctgtggtctttttgcttgctgctttttttttttctatgatgttagtactttttcaaggccaggtgtcttatggttctctaaaggaagagaactggtagactaaatatctctcagttagaatgggacttataagtctatggtttgagtagtccaacaacagctgtcagaaatgccaagaatccggcagttgttcagtacataggactggatgtcttagcagtcccattcagatgttagagtcctgcaatattcctagagatctgttggtcttcacactctatttcaatccctactaagtagattctcatgcctgccaaagagtgccccaggaacaagatttaaacttgccagggaaaacaatggcaggcaagcaaaaatcaaaaccttacttcttttatttctttttatgtgtgctgccactagaaggtgtggcccagatttaatggggggtcttcttgcctcacataatctaattaagaaaatctcttatgggcatgcctggcagcttgggtctgagtatactccagatttagttaagttgacaaccaaaattgaacattacaagtccacctcttgttaacttgacatacaatcatatcccttatctcatgcttgaattccaataaccaagtcataattatatctaacaagctataactacctcacatgtagccccaaatgtgttaggtattttagaataggttacagtgtcactggaggaatgcttagtcttttaggggtctttttcagactgtttcttagagactccttcttaaagcagcaaggaagcagagagacagatcctagcatataggtttctttacgctttttaatgcatccaggatcttagccagtggaataatgttcctgacatacccagaagtttgtctccttggtgattctagatcctgttaagttaataatcaatattaacaatcacaataatctataaacacatcagaccattatattactccattaatctaagatttacacattagttaaaaataaataaatttatacctggggtttgtaacacaagcatatgtagcccagctactctagaagctggcactctctaggatgaactggagagcattgcagtagtaaacaaaaactactggtgatgtagttctgtgatagagctcttccctaacacatctgagctcccagtactgaggacactgagaatggaggattgtgactttgccagcaatgtggaaaaaattagtgagttccaggttcagccaaattctatgccaaaattctatcatcaaaaaatattaattaatttctatgtgttttattatatatgtatgagtgctttgcctctgtgtgtgtgtgtgtgtgtgtgtgtgtgtgtgtgtacaccatatgtgtacctggcatcaatggaagtcagataagagtattatagtccctaggactgtagttatggatggttgtgagtgctgggacccaaaactgggtcatggacaaaagttgttaaccactgagaaacctctccagtcacctctccaaataaaattttaaattacattagacatattccaagctaaaaatactggaagatagtcactaaaatatgaagctttcctgaatcagttctaaattaattaatgtggagtatatgatgatagtcaccattttaatctctgtaaaacaaccttagaacccataagagactttttcaaacttcttttatttttagaatttaagtttcatttttttaattattaagtttaatttactactactgtaatttggctggagaatgaacctagagtttcatgagtgataagatctctctctctctctctctctctctctctctctatatatatatatatatatatatatattatcttaagtcagaagagtagttgttaaaaatgcaccttatgattataatatacaaaaataagccagatgtgaaggtgcatgtctataattcctttacttggaaggtgaaggcagaaggttcaggaattcaaagttattatcatgtacacagaaaattcgaggctagcctaagctctatgaaatgtctttaaaaaattagtgacaaaatataaactaccctaaccaagaccaatctttcactcctaagtttgatgcagtgatgaatataaattagacaaggtaattttcatatttatagaaaatcaatttttccaacccaattactttagaaatgccatttcacataaggtctatctagaagtactcatgaataaagatattgcctaaggactggacagatatctcagtgagtacccagcttcagtttctcacactcatatcaggcaacttacaacttcctataactacagttccaagagatcagcagctccctctggtatatgttagcaccacatgcatgggatatacatacatgcaagtacttatataaagaaaataaaatttaaaaataaatcattttagagtttggaaaaaaaatgaaaaaaaaaaacccctatctgatgcaaggcatagacttagctttcttgcaccaaatgtaaggttactggaagtaatcagagaaacttagctgtggttttagaagattacagtattagtagtgaggttactggtaaattttccagagaaaatgctagaaatgccatcatttgttaattgatgttgtcaaatatttgggctcactttgatcaatgtgagtttatggtcatcccgcgtctgccatccttctgtaacctcccttctgtttgcaatgctacccactcctccatggaatacacaacagcaaccaagttcctaacacagagagaaatatgcattattcttctattatcacaatctatttcaaagtattacaaagaaaacaaatagtattagtaagttatatgctatgattgtgaattacttgtaggcatcaagttttaattttacatgtgtgcacattatcgagtttgtgtatataatgtgttgctttctatctctctgtctgtctctgtctccctccctccctctctccctctctccttcccctgcctctctctcctattctgcacacaccagcctagctggccttgtgagcctcgaggaattctcctgtctctagctcccatcttgctgaagaagcattgggaagtcagatacacactactgcactgataagtggtgaggctttgacctcagttcctcacatctgtacaggggtgcccagtaagcagcctcccctgcttctctataatattttagagaaccacttaatattttttaactctgaatatggagcaactggcaggtgctgttttggttaaaaggctttccaactgattaatgtgttcagcaataatttgatttttaaagaaaacttccattatagcgagaagaaaatgtttccccttcagagaaaatctggcaaaatgtcttggcttttgctcagaatttgtaagcaaatgagaatcaatttgaaatattggagaagtcaagggagtgattctggctctgcctctgttactgatgggctctgaattttctcacatttaaagtgataggagcacattagttaatttataaaatccattacaactcttctaacacttttattgtaagcatttattatgaagagatgtgatgtgtttatggcttgtgataggatatcatgcaaagttgtacaaaactattcaactatgagttcaacaagcactttaacagttgttcttccagtggagattttgtgttgtgctgtgatgttcaagatgatcttctacaggaactaggttcagttcccagcatccatatggcaacttacaaccatggtctatacaactccctcttctggcttccataggcaccaggcacacacatggtacagatagagacaaatacccacatacacataataaaatataaaactaaactaaaataatgtcttctaatagtgtcttaaacacacaagaagagccattacatattggaatgacatagatattgggtacctgtggccccaaaatttaacttgtactgaaaatcatcagtcctcttcgtcatcacattagaattcctcaatcagtaaaataatgtgcaaatatttttatcaacacctatgttccattgttcttctaatattataccatttccaggtaaatcagtaagttgtgttttcatattttgagtatgtgaatgttattgatatgctatttcttgtaattgtaggccttttgatatagttaccagctactgcatttatccatgcagtgcatttattaagccatctttatttcaacaagtgctatagtgtatatattttcctcacttttttcctacactttttagagtagaagactaaatactaaagtgtctgtgtaagcaggctctttgttattttctggcttataaaatctaatttgtgtcaacatattaacgtatactcagcaactttattaaattattttctgatgaaattcttttgaattttctatccctagggtcatttaatctgtgtgacatttgtgggtttttttccaaaatttcttttcatttcaaaaattgctagtacttatgttaaataaaacttcatcacatattatgtagtatgcatatatacatttacatatatacttcttgatttaaaaaaacagtctgatatttatccttcatattcagtcctatgtatctgttttctggcattgtttggttagatttgaatcctttccttaagttcaatagaattatactgaaatattatgttgtatatgatctttagactatagtatatggtcacttttaataaatatctgggatttaactcataagttgggcttcttcatttaatgggtacattcattatatcatcaatgtccattagtataagtttgttagtcatgttcaaatattcatatgtccttacaggttttttgtttgtgtgttatactggttatgagaggtttgtttaacaactacatagatttgtgtacctttatcaatctgttggtttttactttatatatcttggagatattattagtgtgcataatttaaagtattttaaacagaatctttcttgtgaccaaatcttttttcattgcagtgaccttgttttatcttttgtaatgtgttttgccttaaaatccattttgtctaaaattaatgtagtggtaccagctttctttggtgattattgtgcctagcttcttcttttatttcaacctttctatgtaatcttaggcttttgatgtctctgataaacatcatatcatacattctgaaatttgcttccttttttgaaattctaaggatatttgtttccaacattttcctcagtggtcttacctaagattttactagcattttcaaacatagtaagaatatgtaataaaaacaattatatcttcatctagactcagtatttttctgtgtttgctttacacatctgtctcttgctgcctagtgtttctatgtgtgtgcaatgattgtttaaaagtaatttacagacagtaaaacaccatatacctaaaaacctcaccacaaattgtcttatattagcctaataaaatatcacccttaataaaattaataattttaaaggcacatgtctgttatagttgtttatatcctgcttttgttcattttcttgaaattccaaatgtcaagatgatgtttgaagaaaatattccatgggcatctaatgtacatcttcagaggtgaggggctatcctctcagtaaactttattttcaaggatgttttaggaaaaaaaaaagacttgagaacttatgatagctattgtactttgcaagaaaaagccagataagttgacttatcactgtactaaaaacatgatctcaagaaatacagagttgctacccattatgagatgtggaagctctgtgaatacccaacttctcttcagcaacagcaagccatgtaacctatataaggttcattttgcatgtttagcatcaccctgaggaaatgggagcttattgaagcccaggatatgggcctacattcttatgacctattcagaagtctcatatttttagaaacatctcataaccttggggtaagcccactaagttttcaagtaaagaaatgtcttaatattttttagttgttgacaagatgaccttcctatattttatttctttacttggattttaaatagcatctttgatatataatttacacagtattcagtttgtctattcaaagcatatgttcagtagttgtatagaatatgtatatagaattttacaactataccccaaattatttttggaccttttttatccatatgttaagaaaaccacatcccttagctttttcttcccattgacatcagccacaagcaactgtcagtctgcttgttcatataattcaatatattctcaacatttaatagcagtaagtgaatgccagcataatattttgtatttgtgggttttttttacttaatacaatatttcaaaagcttatggatgtggtagcatgaaacaatacttccctcctcttttttgtcaaatgatatttcattgaatatatatactacagtttatttaattagttcatcttgatgtatatctggatgttttctcacatttggaatattatttgtaatcatgttttgtaatttgtaatgtagacatacataagaggttttacagacatatttttaattttcttagatatatgcctaaggatggaatagtttgctcaatgtgtttaattgttttagtaagtgctagactgctctaaagtggctatattgttctgcaactctaccagtgatgtatgagggttctattctcagtgatgttaatattctctgtctttttaaactagaaagagctagtatgtatgaatttgtatttcatcatatttttggttttcatttccctcatgcatggctaataacattgagtatgtttgcacatgctttctgcatacatctctttaaaataaataattattcacatttcttgcctgttttaaaattgaagtacttgacttcataatgttatgagggctatatatatgcatatgtatatgtatgtatgtatgtatgtatgtgtatacaatatatgtatgaatatataatactatatatttataaatcatatttctcataaatgatatataaatataccctcataattgatatgtgtgtttaccctattaagtattttcacttttcaattctgattattttcaaattaaaaaaataatttaatttatactctcactgcagtctcccttcacgcctttgccctcatctgttcatcttccctttctcctcagaaaaggggaggcctcctatttatattaaccagtcttggcatatcaagttgcagtaagactaagttcatcttctcttattaaagctagacgaggcagtccaggattatgcaaagggtcccaaatgtgggcacagagtcagagacagctccttttaggaatcccacatgaagaccaagttacacatatgtgcagaagacctaagagagagtcctaagaactcgctggttgacagtttggtctctgtgagcccctatggttccaggttagttgattctatgtgttttcatgtggtgtctttgacccctctggctcctacaatcctttttagctctcttctgcaagatttcccaagctctgcataatgtttgttggtctcttcatcagtttccataaagctgctgggtgaagcctctcagatgacagctaagttggggctgattttaatagtgtgagaggtaggctctctctcatgcatgggtctcaagttgggccctcaatttctccttcaactttaaccctgcatatcttgtaggcagaaaaattgtaagtggaaggttttgtgggtgtgttggtggcccaatccccccacatgcaaagtcttgcctgattacaggagatgaccaatttaggcttcatattccccactgatagaattcttagctaaggtcaccatcacagattcatgagagtttctattgcactaggtttgtagctcttcccagagatgcctcccggattccagttgtttcttccagtaccctctctctctgtcctctcctcacctgcttctttctgttcctatctccaccccatccaatcttctgttcacctaagttgtctattctatttctcatttcagtgagattcaagtgttcctccttgagctctccttgttacttagattctttgtgtcagtggagtgatgcaattttcaacaaatatctgcttaggagtacataccaagtttgtctatctgggtctgggttaattcactcagaatgatctttgacatttttgttatgataattttaaagtctttaaacagatttgcattatgtttattcatgtgtgtgtatctgtagtgtgtgattgaatggcatgtgcacatgggtgtctatgggggctagaagagattgtagatctccctgcaggtgaacttacaggtggctgtgagcttttgacgtgggtgctggcatctacactgcctctctgcaaaagctgcaagcatacttaactgctagccacctctctggccctttttgtgatttttcaaagagggactgattaaacagatgtcaggaatatggacttcagtgcttccttttcatctttttataattttaacttctcaatatgttacccattttaagaaaaaatactttaaaatccacaaggagacataaaagaccaaggatagccaacacaatcctgatcaaaataaaaaaaaaagatatgtagaccaaatagaaagaaattgaaaaactaaatgtaagtacttcatattcagccactttatatttgaaagagatgccaaaaatataacctggaggaaagaaaatatcttcaacaaattgtgatgtgaaaactagatgtccttgaatataaagggagtagggaggaatatatggagcagttcagaaggagaaagagggagggaggaatgcaataattaagttacaatctaaaacattacaaataaagttgtactcttcaaaaaacatggatgtccacatgcagaataaaattagacccttatttatcatcatactccaaagctaactccaagtggatcaacagaccacagtgtggaacctggaacagtgaaacagcttgaagaaaacagaagcttctgtatatgacatacacataggaaaggactttctgaataaggtttcatttacccacaatttaaagccaacaaatgacaaatggaatttctgcgtggctaaagaaacaatcaaccagaggaacaacaatatgaaccaaccagtatgcccagagctccctgggactaaaccaccaatcaaagaaaacacatggtgggactcatggctccagctgcatatatggcagagcatggcctagtaggtcatcaatgggaggagaggcccttggtcctgtgaaggctctaggccctagtataggggaatgccagggccaggaagcaggaatgggtgggttggggagcagggggaggggggaggggaaaccaggaaaggggataacatttgaaatttaaataaagaaaatatctaataaaaaaaagtgagagaaaaaggaagcctacagaatgggagagactcttgccagctgtgcatctgacagagattcaatattcagaatatacaaaaaccaaagagtgtaaatgaacaaacagacaaacccaaatgaccctttcaaatgatggacctggaaagacagggatctcaaaagaagaaagaaaaatggcaaataaacagctttaaaatgttcattgtacctaaccactgggaaaatgtttgtcaaatgaactttgagatttttctcttacccaagtcagaatggcaaagatcaacaaaacaactaccaacaaatagtgttggtggtgttgagaactggtttagccacttgaactcaatgtggacaattctcaaaaagctaaaaataaatctatcctatgactcaggcataccactccttggcatgtggtcaaatgactcaacatctcattccacagataatagttaggccatgtttatttctgctctattcaaagtatctagaaaataaaaaccacctaaagtacccttcacccaaagaatggctaatgaaaatatagtatatttgcactgtgaaacactattcagttgttaatgaataaagtgaaattacaattttcccataaatagatagaattagaaaagactgtactaaatgagatgacacaaagctagaaagactaatgtcatatgttctatgtcatctgaggttctttttttaaaatttattttttattagatattttcttcatttccattttccagatattaagatgtgagtaaacaatctcagtttctctttttctaatgtttaaaaattatggtttgagtgaagagtgactctcagaggctctaatatttggacacctggctcccagtcagcagcactgcttgggagggtgttgaaggtataaagaaaggtacttcatttacacttgtgtacttttaagatgcttcattatgtataaacacatatttcaatttacaaaagatgacaatgcccaaaatacttcaagcaatattctgatcagttttattttcacattttaacttctaaaattatttctatacttatcctatacctactaagtaattaattatttcgagcaataaatttttgagcagttccatactgctttaattattatagttttaagctatgttttaatgtggtataatatacactttgttcatttttctttaattttttctatattttctctcaggataaaaaagaaaaaaatctacagattcataattatcatgcattaacaaacttctatgattttgtagaaataaactttcccccataatactgaagcaatcaaactaggtcttgagagacagaagcaagagttgtacaagttacatgttagtctgagacataactctgcctcagaaagaagccaataaacacgacttgttgattgtacttttcatgtagacttaggaattcttttcaactgagatacataatatttattttatctcactattggtctcatctaaatttgtctttaactgtatggcttggtgtagtagttattttttttcctttagaaatcttttctgcctattctttcgagtgctatgaataatttttagactcaagggaattgtctttcttaactataataatcattgataccagtcattttcttttacttggtaaatcctatagaactctagttaaagcttaatctaccacgggagatcatattatccctatctgtcataaatgagaaacaaaccctagagtgtatagacaacatatccatgatctcataatgaatcagttgctacagaaagatcaagatatatttcttgtatgttattagtttttattttaattactgctatagcattattccacttaatttaaatttcattttcatttgtttacagctggatcagcaagcacccaggtctgcatagtttttatatcactcatagattcactattgtgctttgtgcttactagatattttgtcaatatgagtagatgctgcctaaaaattaaaagctgttccatctaatgagatatatacttaggaccacctcttacggctactcattaataacttcatgaaaagtgccatctaatggttggtgtgttacaatgacttggcttttttggtgtgtccccgccctcttcccccgccccaaaaatgaataacacaatcttatttaaaaaaataacctatctggcataaacagattataacttaaaattttaaattaaattcaatcaaaatttttataattcttaaataatgaatatttaattttattttatgtccattattgtgactccaggaaatggagttgcagacagttgtgaattgccatgtggggtttgggaattgaatatgggtcctctggaagggcagccagtggtcttaaccagtgaggcatctatctatccctatattcttaaatacttttaggggtttttctctctaaagtatacttcacgtttgttcataatgaactttgatatgatgaaagattaattttgagaaacattggatataaggaatgctacaagtatataaaatgtgttatttgtttatacattttatttttaagatttaggggttattgttagatattgagaagtgcaaatacatgtgtgatgggagttcatattatttttaattgtattaataaaattctattagtcgtctttgcactatattcggaatggtaatcccttttcagaggaaaatttattataaatgtctgaaaatgcaaaggatgttatttttaatttataacaaaatctcctctgcatatcttcttaattaaaatgtagatacacttaccaatgtcaaatattgttacattattatccattgtaaataataattaccctttgttcttcaattaatttctgtaattgagtgttcacaatatgtacaatttaattcagatattatgactgttgactattcttttttgttgttttgtttttgtttttgttttttgagacagggtttctctttataaccctagctgtcgaattagtgaatgtgtggcttctaaattttgtaaattcatagtttagaaccaataactcatctttgcatatgccagaattacatattttaagttgacctctgttcctaaactgagtattttatatgagtttatttatatttttatcttgtgcctaacaagtcttcttgccttcaataataacccttctcatttgatgaatgactgtgtgtcaacaaacctagaatgtagttaaacatgtaatactgaaaacaataaaatctatgtccctaatgtgtactagttacgactgcataactatctagtttgcttcctattattgtgctaaagtccattaccaaaagcaaattggagaggagaggggttgttttgctttcatgccccaatcactgtcaatcagcccgttactgagaaaagtccaggcagcaagtcaaggcaggaacctggaggcaggaactgaaatagaggtcatggaggagtgatgcttattagtttgttcttctggcttgctcagcttgctttcttatacaactcatgactacctgcccagacatgacatttctcacagtgggctgggccctcccaaataaatcactttgggggagaatgccccacaggggtcattttctcaactgagtcttcctttccaaatgactctagcatgtgtcaagtatataaaaaaaacatatccaacacaataacagactttaagctgaagtgtcagattgtgcttttactggaacacactcctttataaccaggaaaacaggtttcaacaagatggtggcatctagtttgagctgaagttaaataatatttagggagattctccagtaataactagaggaagacaagataggaggctagcttacatggtaaactacaggtgctaaagatgaaacaatgattaacagagttttatattttccttgtacaaaactttcagaagccagtttgacaaaatgtgttcaggtttgttgtgcataaatgctgtgttgtttgcatatgttattctaattcctcttgggttgttttgtcctaagcattccagctctatagtagtgtatgttttggggattagaatgtcccttactatcttcccagtctctatgtgtttttatagtagagaatgatacttttctggctccagaacattattccctagtgtggttgaattcagagcctctagcctgaagcttggaatggttaagaattgagctattagtgatgaaagagcaggcacatagggaaaagggagataaaatacagtattagatgctttatgatccacttgtgaatgctgagaagtaagctgacatcaagtggcagttattcttggctagtttccatggtcatgtgctgctacagactgcgaagtgattcattacaaatggaagaagaagaagaagaagaagaagaagaagaagaagaagaagaagaagaagaagaagaagaagaagaagaaggaagaggaggaggtggaggaggagaaggagaaggagagaggaggaggagagaggaggaggaggaggagaaggagagaggaggaggaggaggaggaggaggaggaggagagaaggaggagaaggagaaggagaaggagaaggagaaggagaaggagaaggagaaggagaaggagaaggagaaggagaaggagaagaagaagaagaagaagaagaagaagaagaagaagaagaagaagaagaagaagaagaagaagaagaagaagaagaaggggaaaaaaggtgttcttacaacctggacaagtggcaaagcatatgaacgagaacgtcttatgaattctcttttcagtttagcatctttaaaatgttatttcttagctggacatggtggcacacacctttagtcccagcactccaggggcatgggcatgggcatgggcaggggcaggggcaggggcaggggcaggggcaggggcaggggcaggggcaggggcatctctgtgagtgcaactccatactgagttcctggatggccagaaactggatagtagagacactcttgtcttaagaaaacaaaagcaaaaaggtatttctcagcatgtaaaggagatgtctacaaaacccagcaacttgatttttattgcttcatgttgttttccaaataccacacatattctacagcatgtgtgcaacacacacacacacacacacacacacacacatgcatgagcacacacacacagaataaataaatgtaaaaatgaagagatacttattagtttagaattataagcttttatttgctcattgtgagaaattgaaagaaatacatataacaagatattgaatataaaaagccattgttggttgcatgcatcctttcatagttttcttatattgattttgcaagtgtgaattactgccttaagttgatttttaagttggagagttgctgttaagtttgtatttaatgattttcccctttatttcctataggcctgccatgggtgttcttctggatcaaaatgtgactgcagtggtataaaaggagaaaaggtaagttctgagtaaaaaaaatagatatatcaaatactatttgtaaattaattgtacaaattatgcttctatcagtgtccaaataaataaaatagattctactgcattgcttaatttagagtgggaacttacatagatgagactgtgtcaggatcagcaaacatctcgatgaaacatgatatcataaatattttaggtttagtaaacataagttcggttacattttattttctgttggggattggatccagggctttgcaaaatctaagcaagcagtctacaactgtgccacattcctagggggggttctcagaaaattggacatggtactaccggaggatcccacaatacctctactgggcatatatccagaagatgttccaaccggtaagaaggacacatgctctactatgttcatagcagccttatttataatagccagaagctggaaagaacccagatgcccctcaacagaggaatggatacaaaaaatgtggtacatttacacaatggagtactactcagctattaaaaaagaatgaatttatgaaattcctaggcaaagggttggacctggagggcattatcctgagtgaggtaacccaattacaaaagaactcaaatgatatgtactcactgataagtagatattatcccaaaaacttagaatacccaatatataagttacaatttgcaaaacacatgaaactcaagaagaacgaagaccaaagtgtggacactttgccccttcttagaattgggaacaaaacacccatgggaggagttacagaggcaaagtttggagctgagccgaaaggatggaccatctagagactgccataatcgggggtccatcccataatcagcctccaaacacagacaccgttgcatacgctagtaagattttgctgaaagtaccatgatatagctgtctcttgtgagactatgctggggcctagcaaacacagaagtggatgctcacattcagctaatggatggaacacagggcccccaatggaggagctagagaaagtacccaaggagctaaaggggtctgcaaccctataggtggaacaacattatgaactaaccagtaccccccagagctcatgtctctagctgcatatgtatcagaagatggcctagtcggccatcactggaaagagaggcccattggacttgcaaactttatatgcctcagtacaggggagcgccagggccaaaaagtgggaatgggtgagtaggggagtgggtgggagggtatggaggacttttgggatagcattggaaatgtaaatgagtaaaatacataattaaaaaaaacacaaaaggacaataaagcctcagaaactactgagaattcttaggatgcacctagggaaaggacaaggaaatgggcagggaatgggaagcagagattggggagaatgaacaaaattaattatggataaaagtcctctcgaaacatctattactttacaaataaatcattttcttctgtcttgttttagatagggtcttctttgtaaccctggctggctttgagctcactatgtagaccttgagcttacacagaacaacctgcctctgtctcccaagtactgagattcaaagtgtgagccatcatctccagccttacaggaattttaataacaataataataataataataataataataaatttctagctcttggtctagacaaaatacacctcagatgacatttaacttgatggcttttatcttccagtgccttatttgtctgtgtgtcagtaactgacatcaaattaagaatttcaaacaagatcatgaattatagacaggagaattatgagaaagggatcttacattactctttcctctttttaactcaataaatatttttaatgaataaacaactattaataactatatatgaagttatggatcatatctttagtgaatattccagttagatatagaagtattcattcgtgcagtaaaagatgctaaaaagtcctggtgtcaacaatttcatcaatttatgttatgtattcattgtatgctgtgatcttatttacaagttccattctgtcatgtaacacagtacccctgtactggctaatttgtgtcaacttgacacaggctggagttatcaaacagagaaaggatcttcagttggggagatgccaccacaagatccaactctaaggcattttctcaattagtgatcaggtgggaaaggccccttgtgggtgggacgatccctggactggtagtcctttttttgttgttgttttgattttgtttcttttttttaatttctttttttaattaggtattttcttcatttacatttccaatgctatcccaaaagtgccccataccctcctcccctccactcccctacccactcactcccacttcttggccctggcgttcccctgtactgaggcatataaagtttgcaggatcaatgggcctctctttccactgatggccaactaggctatcttctgatacatatgcagctagagacacgagctccggggggtactggttaggtagtcttgagtactataagaggaggctgagcaagccaggggaagcaagccagtaagaaacatccttccatggcctctgcatcagctcctgctttctgacatgcttgagttccagtcctgacttccttggtgatgaacagcagtgtggaagtgtaagccgaataaaccctttcctccccaacttgcttcttggtcatgatgttttgtccaggaatagaaaccctgactaagacaatcccctaacagaacatctcttaagagttcttgaatagtagtctagataacacttgtgtgagtaacatttttaggggaatatctttgcaacaagaatgctttctgtagtgttaaagtattaaagaggtttcatttgagatcacaaaggaggaaagaaagtggaagggaatgtcttttaaagaaaggaagcacacatggagaatttacatgtatgtagatattattgcttatacttctcagtctgcaagatgatggatgggtaaattcttaccaagagtcatagttatggtcacaatgacctacagaaaatggttcaagactccagagtgcctggaaaagaaggaaggcatgttggaatgaatataagacagcacagagtggaggacaaaaaataaagttgaagattccattcaaattcttggttaagttttgattttatatgtattgagggaaagtcacagaatctaataaaaagaagagtagaggcttaaaataactaagtatagattaaccattgtttggtgaacggataaaactccatttaatcaatcagtcacgaactacttcatacaaaaaaaaaatgctctttagaagaaaataagagaatctagtatctctttctacagtatgcaattaaagcttaccaagtaaacacaaccaataattttaaaaaaagacaaatcacagaaaattattaaaacaatacagatgctacattttggaacttgaagcagataaagttaatatatttattaatttaaaaggaaaacctgttcaaaattgataaacatgtagtaaccacagatcactggcaaatacatgaaaaagaaacttgaaatttgaaaaataaaaagcagtttatccaaggagtatgatagcaaactgttggcttggagctgctgacaaatgcagatttccaggctccacaactgtaagttacccatctcgttctggtcatggtggaaaataattgattttgacaaactctccacgtggctcttttacaagctgaagtctcagatctatatagcttcattttgacagtagctaaaattcttctaattatagtgtggcaactgtctcattgtggtacagaattataaagagaaaataagaattatacagaacaatatattattgttttaatttcttcactaagaacttagccttgaacttgcacaatttgcaacattctaactgaaaataatttataactagttaccaatataacactttgtcttaattttttcctatgtccacacacaattgtgtttcttgacagttctacattatccttcttgaagtactattctcatgcttcctggagtaatatacaactggcatactagcactcaggcagcataagcaagatgactagaagttcaaggccaacttacatgagacactcaagaaacgaacaaacaactatttttatgctcattttcaggaaacacttttattgtttattataaacagctcttcttgaaaggggtgctatcttaaagtacttttaaactccagatcttaggtaatcagtagattaatcttctttaaactggtgagctgggatgtgcccaagggtagaatacttggctttgtattatatctgggactgtagatttgatatctatcaccacacaataaataaactagacttatcatgagatagtttttctttggataatttatcaaaacctgaaatattgcctttattctgggtttaagtaaaagcactcactagaaaataaggatgtcatttataaatggattttttgtttattttattagatattttctttatttacatttcaaatgttatcccctttcttagtttcccctccgaaaataccctatccctttcccccttcccctgctccccaacccatccactcctgcttcctggcccaggcattcccttataccgggtcatagaaccttcacaggaccaagggcctctcctctcattgatgaccaactaggccatcctcggctacatatgcagctagagccatgagtccctctgtgtggtttctttgactggtggtttagtccgagggagctctgggggtactgattagttcatattggagctagagaaaatgcccaaggagctgaaggggtttgcagtcccataggaggaggaataatataaatgggtttctattgaatatttgttctattggacactaaaaatacaacattgaaaaagccatgactgtttccatgtagaggcgaaggagatggtggtgtccaggttaacataaacttctgactgagacagatgagctgtgttctatgtatcaagtttacacttaggaaaattataaaacttctctctcatgacttttcacacataaaatgaaaataataattttactttgtcttaaaatggggagaaaaaagtaagataaaacaaaaccctgaaggaggttaaacagtctggaaaacagaaaaacattcaacacacgtgggctatttttacagtctttcgagttttaagtgtttggggaaatgcttaagaaagttgctaataagaacttaccattactattttcaattgtccagggaaaaagagaaggcaataaaagaatctaagtaatacttatatttaaaagatagcaaaaagagaataatgtatttcacaaatcatttttttaattcaaacatgggcaagcaggataagtcggtggtttgtttttaagtttgtctttcagaaataggcaaccacttctcattcagtctataaatgtgtgaaaattacagcacaaactgatagtggtttaaacggattatatgagtacctctgaagcaaatctaggcacatcactagtgttagcttttcttcctgttcatttaaagaaattaggtagaaaaccatacttttagtccattcttgcacaggaaagctatatttcttttactttagcaaacattctacctttgaaattctcaagattgttcttcttgttcttttctgctactgtatagcatctacttttctgtctctagttctgtgataatgggagggaatttcaggatataccattaaaaattataacattttattgatatcaacataattaagcttttagcatcctctattttcttctacaatttttactggtacatatgtatacatacatgtatgtatataacaaaaatgattaaagaaaaaaaggctatcaatttgtgtgaaaggtgggtgcctgggaggggaagggggggcaaagggaaggggagagatgacgtaattttattgcaattaaaagcacataacaatttttaaaattatttttacattaattactttaatgtacatctctctgtgtatgtgtgtctctgtgtgtgcatacatgtacatgtttgtctctgtgtgtgtgtgcacacacatgcatgtgtttgtatatgtatatgtcacagtgtctgagtgcagaagtcaattctcttcttctactctgtggttcctgagaattgaactcagtcaggctttacctgcctagctactccactgggcagcatcctctatcttcagtctttggtcagatagtacttttgctttgaaaatacacatagcatactctagacatttgacaggggtatgctctaaatgccagctgaaaacccaaaatttagctattttgtactttgggaaatatacaaggactaggttcttttttctttttacttttctttctgagtggaacttgtagtcagagttttaatcctagttctgctagtaacagaccattcaataatgtgagataatctagctcttaaaatttgaaaattgtgaaattcttaatatacctgcttgccttctttattatcgaatgaggttaaagcagttattatattctcactttatctctgatatattatctaattctacaagtagcaaagaggttataattaactatatatgatatatatttgggatgatttggattttttcttctcacattttacagacttgtccatgttattagatactgtggacaaaacgtatcactatattatgttactttcatctgacagtcgtttgaacgttcgaaacacaactgtgtctgtgcttaaaagttcacaaatgactttacattcttgtttaattgcagggagaacgggggtttccaggtttagaaggtcatccaggtttaccaggatttccaggtccagaaggccctccaggacctcggggacaaaaggtatttgtttcagtagccaatcaacaatagcagaggaattaaaccaccataaatttgagacaagctatcaaatcgactaaaagtccactgaatcgtaatgagaaaatagtgcttaaatcaaaaaacagagttgaaggaactcttattttctgtattcatttatcccttctttcccatttttcctccttcaagcagtgattaattacctatagtcctttgtctaggagcagaaccccataaaattgtctcatttttatattaacatgtgcattgatactgttgttgttccagacttcttggtaatcttgctgttagaagatttctacctcttcttctgtgatggtttcctgagtcatagatgcagagatgttgatgcaaggctggattccccccaaaacactgatctcttttttttgtccagttgtgtgtggttttgctgttgttgttgttttatgatgttcttcatttgccataatgagagatttctttgatgaatggtggtaactagacttattcagaaaaagtgtctcttcaccttagtgtttctaatgcttcaatttggatattattgtcatagtcaggtatttttcaggatgtcgtttgttatatatggtttttggaattctttctactttaaacttgtcctggggagatgcaaataaacatcttctcacccaccccctatgaacaccaatggcagacaattttatgatttatccaaagtccaaattgtgttgaccaaagaatttactggacttgccaactgaacatgaataagggatttcctacagaagtgtaggtgactgcaaaacagctgtatcactacaaggttccaccatatcatggataatgatctcatggaggctgctatgaagtctcactttgaatcagcttcctaactctatgtactctagcatcaccctaaatcagatattgaatgggggagggtcaattgcttgaatctcagataagtgtctctagaataatttttcctctacctactaggaagtgttaaagttcaattatcattaccataggtctgatgcatatatatttttctgtgaataagagtagcatctttatgtgtacgataagatagggaatgggaaaagataatagtgaattttgagaccaagaagagtttctttcagtttttaatggctcttttggctccgagcccttttcagtctgtggtagattgactggtaaagtggtgtatgaaaggtccaactctattcacttgcccaaaaagcaaaaaaaaaaaaaaaacttgacttaataacatttccctctagctttattatttcatataatgatggtgtaccatatcattagaggattaagaaaatcaaatggatatcaccaggtagtctttctaagaaaggaggaaaattaaatgcttggagatgttttaatataaagctagctataccagagggtagatgttgtgagaatgagggtacaactgtgaggaggaagtttttttttttttcagattcagcaggaaatgagtcttgtggttaaatgcactgaatagaacttcatatgaacactaaggaaacactaacactctaaatgactgactacatagaattttgaaagatgggccattcaaatgaatttcctaggtgctataacacagcaagtgtaagagtggcagtataatccttgccacccaggaatggcaaagaagtagtgcagacttctaaatcatgaactgagcataatacagcaaaacaactaaattcttccacttcgcagcacactggaacttaagcaacaacattctgaaaataaagtgggaacacaaattgattaattttcagctatgttatggaaatgagtgctttggaatagaatgtaatttgaaccatagaaaaagctgtttctcaaatgtgagtttatctgggaacagggccagagtttcttgcataacatggatattaagagtaaatatttgtggtttattaaaagaagttacattacaattattttgaaataatttagcattaactgagacttcttaataatagtataatagtttatgaagatgtgttcattcgcacattaagtttagagagtattactacaattccttttcattatttatagagtggaagtgggaacagctttctaaacattttacattctacagcttaaagtgtacttttgtgtgattggagatttactttttaaagttatatagatgattattcttcattggtatattcctttttatgaacatgtagatttgtaaaataaactgtccaattagcatagttgcttaaagtgtggtactgagatgtgtgtgtttatttatataaatgcacatttgtaatattgcaaaggagttctttgttaaattaaatgttccttttcagtagataatatattcattttattcacaattagtaaatattatgaatacaatgaaaaactcttttctacctgtgttcattggtccctgaatacatacccacattttcatcctctttgtttttaaaataggatgtattatgtttattttgtgtttttcttatatcagtgttctcaggatatgatattcttactacattcaatttcattgtatatataagctataaattagtatcaagctccctactcatgattatgtagttttcaatagtttgctgctataaaacataactgctaagatgaaaatctttgattaattcttattgcatcaataagcatgaattggaaagataaattgtgggaaatgggtgcccatgtctgcacatgtttttttacacatattaccagatcactatttcccaaacatttatgatttaccctttgatttagcaacaaagaagattcattttctcgcagattcatctctattcctaaaaaccttttctagttgtcattatggtagaagagtgacctttcaatatactttcaatttgcatttctctttttgtgattacgaatatgcttctcacagatcaaagtttcctttgtcttcctgtgatctctattttcatatcatttgccccttttctcatgacttggtgctttcatattttgtagagctatttgttaggaagattatttccatgcacacactgtacgttgtattattttaccctttgtcttttgcttttgtaggcatgtgcagggaaatttatgcatttatgaatctctgtctttaagtcacatggattttcatgagaacaaatcttatgcactttgagggtatatattaattctcaaaagttttctttcagtatatcaatttattttttatcctgtgtgaaacccatcctagtatacggtttgtgatttaagatacaccttaaacacaatcccacaacacccagaggaagctctattctcagatgctctaacatgccaggattgtagaatcaaaggtgaggaggacacagcatctgttccaacaacaccagaagcaactgggactagtgggatccagggacacaggaacctcgcctgaccagtgactcaggttccttctgctctacaccagtttaccttgggcacaaactccagagccagtcccacaccacccttaggaagctccactccaggctctctaacatgccgaggatcacagaatcacaggataacaggatcccaggagtttggccataccaggatctcagggtcccagaggcagcttgattcccaggaactctgacacacccaggatctcaagatcacaagatcctggaatcacaagatcacagagacagctggactctgagcagttctgacacaaccaggatcacaggaaggacaggctccagtcagatataattagtccaggtagcactagagatggcagaaagcaagcacaagaatataagcaacagaaaccaaggttacttggcatcatcagaacccaattctcccaccatagcaagtcctggttccactattacaccagaaaagcaatactcagatcaaaaatcacttctcatgatggtgatagagaacattaagaaggatgtaaataaattccttaaacagatacaggagaacacaagtaaacaggtagaagactttaaagaggaaacacaaaaatcaagaattacaggaaaacacaatcaaacaggtgaaggaaattaacaaattcatccaagatctaaaaatggacatagaaacaatagaaaaaaatcacaaagggagataaccctggagttaggaaacctaggaaagagatcaggagtgatagatgcaagcatcaccaacaaaataaaagagatagaagagagaatctcagaggcagaagataccatggaaaacattgacacaacagtcaaagaaaatgcaaaatggaaaaagctcctagccaaaaacatccaggaaatccaggacttaataaaaagaccaaacctaaggataataggtatagaaaagagtgaagattcgcaacttaaagggccagtaaatatattcaataaaattatagaagaaaacttccctaacctaaaggcagagatgcccatgaatatacaaaaagcctacagaactccaaatagactggaaaaaaaaagaaattgctcctgtaaaataataatcaaaacacaaaatgtactaaacaaagaaagaatattaaaaacagtaagagaaaaagatcaagtaagatataaaggcagacctatcacaattacaccagacctcaccttagactatgaaagccaaaagatcctgagtagatctcatacagacactaagagaacacaaatgccagcccagaatattatacctagaaaactctcaattaccatagatggagaaaccaagatattccatgacaaaaaataatttacccaatatctttccacaaatccagccctacaaaggataatagatggaaaacacaaacaaaaggagagaaaacgaagaaaataatctttcgacaaacccaaaagatgatagccacacaaacataattacacctctaacaaacaaaaataacaggaagtaacaatcatttttccttaatacctcttaacgtcaatggactcaattccccaataaaaagacatagactaacagactggatacataaacaggacttagcattttgctgcatgcaagaaaaagcctcgaagatatgggcacaggggaaaaattcctgaatagaagagcaatggcttgttctgtaagatcgagaatcgataaatgggacctcataaaattacaaagcttctataaggcaaaagacactgtcaataagacaaaaaggccaccaacagattgggaaatgatctttacctatcctaaatcagataggggactaatatccaatatatataaagaacccaagaaggtggactccagaaaatcaaataaccctgttaaaaatggagctcagagctaaacaaagaattttcacctgaggaataccaaatggctgagaagcacctgaaaaaatgttcagcatccttaatcattagggaaatgcaaatcaaaacaaccctgagattccatctcaaaccagtcagaatggctaagataaaaaattcaggtgacagcagatgctggcaagtatgtagagaaagaggaacactcctccattgttggtgggactgcaagcttgtacaaccactctggaaatcagtctggtggttcctcagaaaattggacatagtacaaccagaggattccacaatacctctacttggcatatatccagaagatgttccaactggtaagaaggacacatgctccactatgttcatagcagccttatttataatagccagaagctggaaagaacccagatgcccctcaacagaggaatggatacagaaaatgtggtacatttacacaatggagtactactcagctattaaaaagaatgaatttatgaaattcttaggcaaatggatggacctggagggcatcatcctgagtgaggtaagccaatcacaaaaaaaactcacacaatatgtactcactgataaatggatattagccaagaaacttagaatacccaagatataagatacaatttgctaaacacatgaaactcaagaagaacaaagaccaaagtgtggacactttgccccttcttagaattgggaacaaaacacccatgggaggagttacagaggcaaagtttggagctgagccgaaaggatggaccatctagagactgccataatcggggatccatcccataatcagcctccaaacgctgacaccattgcatacactagcaagattttgctgaaaggaccctgatatagctgtctcttgtgagactatgccggggcctggcaaacacagaagtggatgctcacagtcagctattggatggaacacagggcccccaatggaggagctagagaaagtatccaaggagctaaagagatctgcaaccctgtaggtggaacaacattatgaactaaccagtaccccggagctcttgactctagctgcatatgtatcaaaagatggcctagtcggccatcagaatatcagtggaaagagaggctcattgatcctgcaaactttttatgcctcagtacaggggaacgccagttccaagaagtgggagtggttgggtgggagggtatgggggacttttgggatagcactggaaatgtaaatgaagaaaatacgtaattaaaaaattgattatgacctgggtgggtgattattcccctgagggggaagaaacgcacttcagtgataaggacagacactatctagagtaaaaggttggaaaacaatttttcaagcaaattgtcccaagcatcaagctggagtacccattctaatatcgaataaaatcaactttcatctaaaagttatcaaaaaggataaggaaggacatataatattggtcaaaggagaaatcttccaagatgaactctcaattctgaacatctatgctccaaatacaaggcacccacattcatgaaagaaactttactaaagctcaaagcacatgtcataccccacacaataatagtgggagacttcaacaccccactctcagcaatggacagatcatggaaacagaaactaaagagtgacacagtgaaactaacagaagttatgaaacaaatggatctaacagatatttatagaacatttcatcctgaagcaaaagaatataccttcttctcagcacctcatggtgccttctccaaaactgaccatataattggtcacaaaacaggcttcaacatatagaagaagattgaaataatcacatgcaccctatcagattaccatggactaaaggtggtcttaaattccaacaaaacaatggaaaacacacatacacatgaaagatgaacaatgttctactcaatgataacttgttcaaggaagaaataaagaaattaaagaatttttagaatttaatgaaaacgaagacacatcagacaaaaacttataggacacaatgaaagcagtggtaagaggaaaactcataggtctaagtgcctccaaaaagaaactggagagagctagcagcttgacagcacacctgaaagctctagaacagaagaagaagaagaagaagaagaagaagaagaagaagaagaagaggaggaggaggaggaggaggaggaggaggaggaggaggaggaggaggaggaggaagaaagtacacacaaaagagtagaaggcaggaaataatcaaactcagggctgaaatcaaccaagtagaaacaaatagtactatacaaagaatcaacaaaacaaagaactggttctttgagaaaatcaataagacagacaaacacttagccagactaaacagagggcacaaaaacagtatccaaattaataaaatcagaaatgaaaagggagacataagaacagaaaccttggaaattcaaaaaatcatcagatcatactacaaaagtttatactcaacaaaattgaaaaatctggctgaaatggacaattttctagacatatcctaggtgccaaatttaaaataggatcagataaatgatctaaactgtcccataacccataaagtaatagaagcagtcattaattgcctccaacctaaaaaaaacccaggaccagatgggtttagtggagaattctatcagaccattaaagaagaactaataccagtactcttcaaacaattccacaaaatagaaacagaaggaacactacccaatttgttttatgaagccacaatcacgcatttacctacactacacaaagaccaaaccaagaaagagaacttcagaccaatctcccttatgagcatagatgcaaaaatactcttgccaagcgaatccaagaacacatcaaaatgatcattcaccatgatcaattaggcttcatcccagagatgcagggatggttcaatatatggaaacccatcaatataatccatcacataaacaaactcataggaaaaaaaccacattatcatttcattagatgctgaaaaagcatttgacaaaactcaccatcccttcattaaaagtcttggaaagatcaggaattcagggcccctacctaaacatattaaaatcaatatacagcaaaccagtaccctacatcaaactaaatagagagaaacttgaagaaatcccattaaaatcagggactagacaagactgcccactctctccttatctattcaatacagtacttgaagttctagctagagcaattagacaacaaaaggaagtcaaggggataaaaattggaaaggaagaagtcaaaatatcactctttgcagatgatgtaatagtatatataagtgaccctaaaaattccaccagagaacccctaaacctgataaacagcttcagtgcagtagctggatataaaattaactcaaacaaatcaatggcctttctctacacaaaggataaacggactgagaaagaaattagggaaacaatacccttcacaatagtcacaaatattatagaataccttggtgtgactctaactaaggaagtgaaagatcagtatgataagaacttcaagtctctgaagaaagaaatcaaaagatctcagaagatggaaagatctcccatgatcatggattggcaggcaaatagagcaaaatggccatcttgctgaaagcaatctacagattcaatgcaatccccatcaaaattccatatcaattcttcatagagttagaaagagcaatttgcaaattcattcagaacaaacaaacaaacaaacaaacgaactcaggatagcaaaacctattctcaacaataaaagaacttctgggggaatcaccatgcctgacctcaagctgtactacagagcaattgtgataaaaactgcatagtattggttcagaaacaggcaggaagatcaatggaatagaattgaagacccagaaatgaacccacacacatatggtcacttgatccttgacaaaggagctaaaaccatccagtggaaaaaagacagcattttcaacaaatggtgctgttcaactggcggttatcatgtagacaaatgcgaattgatccattcttatctactcgtacaaagctcaagtctaagtggatcaaggaactccacataaaaccagagacactgaaacttatagaagagaaagtggtgaagagcctcaaacacatgggcacaggggaaaaattcctgaacagtacaccaatggcttatgctctaagatcaagaaacgacaaatgggacctcataaaattgcaaagcctctgtaaggcaaatgacactgtcaataggactaaatatggcaaccaacatattgagaaaagatctttaccaatcctacatctgatagagggctaatatccaatatatacaaagaattcaagaagttagactcccaagaatcaaataaccctattaaaatgcagtaaagagctaaacaaataattctcaatggagaaataatgaatggagagaaacacctaaagacatgtttagcaccctttgtcattaaggaaatccacatcaaaacaaccctgagattccacctcacaccagtcagaatggctaagatcaaaatctcaggtgacagcagatgctggcaaggatgaagagaaaaaggaatacaccattgctggtgggattgcaagctggtacaaccacttggtggttcctcagaaaattggacatagcagtacctgatgacccaggtataccattcctgggcatatccaacatgtaataaggacacatgctccactatgttcatagcagccttatttataaatagccagaagctggaaagaacccagatgtccttcaacagaggaatgtggtacgtttacacaatggagtactactcagctattaaaaaggatgaattcatgaaattcttaaagaaatgtatggaactagaaaatatcatcctgaatgaggtaactcagtcacaaaagaaaacacatggtatatactcactgataagtggatattagcccaaaatctctaaatactcaagatacaattcacagaccacattaggctcaaaaattaggaatactgaagtgtgggtgcttcagtccttcttagaaggagaacaaaatactcacaggagaaaaaatggagaaaaagtgtagagcacagactgaaggaaaagccatccagagactgtcctacctggggattcatcccatatacagttaccaaatccagacactattgtggatgccaaatagtgcatgctgacaggaacctgacagctgtttcctgagaggccctggcagaggtggatgctctcagccaatcattggactgagcacggagtcctcaatagaggagttggagaaaggactgagggtgtttcaggggtttgaaaccccataggaagaacaacaatatgaaccaaccagaccccccccccagagttcatcaatgaagccaaagccatcaaccaaggagtacacatggctccaactgcatatgtaacagaggacagccttgtcaggcatcaatgggaggagaggtccttggtcctatgaaggcttgatagatgccccagtgtagaggaatcgagagcagggtggtgggagtgggtgggtaggtgggtgaaggaacaccctcatagaagcagggggaaggatgggatagggaatttccgggagggggtaaaaattgggaacgtggataacatttgaaatgtaaataaagaaaatatccaataaaaatgccttgattttttctccactcatttacaatgaaatattcattatagagtagccaccctttatttgtagtttcatttcccatgatttcaatcatatgcatccaactactgtatggaaataagctgaaattcttaaaattaataattaatgttttccaaaactcattataatatgttgttatatttgttttatattaccctttgatatttttaaagtcttccagtgtttataaattttgttacatttatgtgtacatatgaaaatagaaatttgaatatagaaatttgctttctgtctacattttcatgtggtgactatgtgggatcttagaagctatccttggctaaagagtggcttctgttttctaagttcatttgagctttctttctgaaaatcttctagtattcactttatccaaatctaagtcccaaactattttaataactgaagccttgcttcacttttatgtctgactgatgtagggcccactatgttcttttttctttttacaagttttcccacagatattgctggggtgtttttgcctatataaactttggagctactgtctagtcttaaaaaaacccagtaacttctattttcattatataaaatttctatctaattttgtaatttactgtttaaattggattcctttttttaaggacatggaatttcttttttatacatatttaactacttctttgtgaagttcacaactgtttttaatcctttcctcttgtaaatcttgtgcatttcttgttaaatttactgcaaaatattttgttttgtcattattggttgagtattttcttctattaagtcttgtaaatggttgttacaataataaagctatcttttagtattcactttaatccaaatctaagtcccatttattttaataatgtgaagcaaggctatgaagacaaggctggcctcaaactaggggcatttttttcttctttaaccttttgacttttggcaatacaggtcctccataacttctaactttgtaattttctttcctgaagttcttctttaaccatgttgctggtctaactggtgcaatactcacacttttgtcttatttctgccttcagtgagaaggcataaaatatttattgaacaagagatcttctagttattttaactgggaatcagaatccattgaatcttctcacaaacaagtctgcttcagaaagagtatgtcattaaactttttaaaaggagacaattttaaagggacttacagactttgcattaacagtattcatgtccttgtcaaaatctgtggatatactactttacaccaaactgtattaggtcttttttattcaaaactttaaagaaaatacttaacaaaaaattcacggagataaaattgaaacttttcagcaatgcaggggtgactaaaagtgagtaggtagaatttgcaaggaacagagaacagaagctggaagggagagtttatgacttttaagttctataaaaagtgctttctgaaataaatggaaagataaaagcaaaagttcacaaacaacacgtacacctgcagtttgatgtgttatagaaactgtcaagattttgattttctccgtctctctctctttttcttccctcatgtacaaatttatcttcattttcttgtgtgtgtcttgtatatctttctgcatgcaacatttcttcttcatgtcaacagtctccccagtaaaatactggccgttcttggtattgttcatttaatttatcagtggtttgaatcttaatcataattcttgtttgggtgtatgaaattagcactaattttcagaaaagtttaccaaaaaattcaggctagctaatgaaaaattagttattagatgactgctttgaaggaaaaaaaggaactaaataatattgtgtttttcagggtgatgatggaattccagggccaccaggaccaaaaggaatcagagtaagcaatattcagtgtacgggaaatgctttgttgttgtcaacagataagaccaagtaaaatggtatgagacaacaagaaactaattatcattgctcacaaacatatatacacatgtatgtttatattacatcatatagatacaacatgctaagttcatttactcttgcttctatgcattcatgatttcaaggatgaccacttgttattggataatcaaatggggggggggtcatccctgggatgaccttaagaaagactccctctcaagcgtcattatacatttgtagttttgtgtcaaaaggtgcagctctctggaattttttcccattcatattaccacatttgttcatagtcataactcaagagtattgtccatctatgtggggaactcaaggcagcaggggttcgtagcaactggtcccatcactttctcaatggaaagccaggatcgacagacatacttgtgctcagctcacttactttatctagttcattatccctttctcagggaatgatcctgaccacaatgaaaatagttcttctcacatcaattaatataactaagataatccctataggcatatccagaaggctatttccctagtaattctagattctgtcaagttaacaactaaaatgaaccattagaacagctctttgtcagcctgacacatcaacacaacacttttatgccataactttccaagctttgtcctcataggttcatgacaattatatgatctaaaatgcattcagtccaacttttaaagtccccttcatactaagcctcttaactgcgagataccataaaattaaaaaaaaaaaagcaatggatgtacttcaacataatagtggcacagaataaatatccctctccaaaacagaagtgggacatagcaaaaaataatcacttcaacataaattaaaatccaaacagataaagatcaaatcctgcaactctaaggctagcatctagaggttgtaatgtggtcaactggtatccaaaacaccttgagcagtcccacaaacccttagttataccacctacaacacatacattattccctaggcttgcttttttccatgcccacagctttccttggcagctgtcccttattcctgacatctccactatcttggggtctcaactgcaacttagtatgaacctttacaagttcatactttggcctcttaggacgtttttgcagagatttcaaccataccataaatcctctgaccttagatttaaaaacaaacaaacaaacaaacaaaaccccaataaacaaaaaataaaactttacagaatgactcagtgacctgcttaaacttatctttcatgccccttaaacttgtacaatgtgaactacattgccaagttctgcttctagctcttgatggaggctctgataacttcaggataactttttgtttgtcccagtgcaatgtagatttctcttcaatgatcctgacatctttatcaaatatatatattctcagtaccaggctaaattctctcccttattgaaatgtcctctgccaaatacattaatccattactttaaatttaccttccatcaacatctcaggaagtgatcagaatgaagacaaattgctggccaaaatatcatatgaatgctctctagcacaattgttggcggagtcctagttcctcctgaaatctcagtgacctgcccccactggacatattcctcccaatgttcttattttccaagttcccagaagaagaaccattaagctctgcttattgtattctgagacttttctttctttttaaaagtttatttatatatttttttaaaatgtaggagtgctctgtctgtatatatacctgcatgccagaagaggacatctaatccctttatagatggttgtgagccaccatgtggttgctggggattcaactcaggacctctggaagagcagccagtgctcttaactactgagccatctcaccagccccaaggacttttctaacccaatgtttcatttcttccacattcctcctgaaaaccatttccaaaggcctaagacttgcacagtcaattttatcagaacaatgtcccaattcttggtaccaatttctgtattagttcttttgctattgctcagataaaattttctgttaaaggcaatttaagggagaagagatttatcctggcctacagttcaggggttaaagttgttcataataatgattaaagccaaggcagcaagagttttaagctttaagttttaaggtcacactactttcttttttttttttttttttttttttttttttttctttccattttttattaggtatttagcttatttacatttccaatgctataccaaaagtcccccccatacccacccacccccactcccctacccgcccactccccctttttggccctggcgttcccctgttctggggcatataaagtttgtgtgtccaatgggcctctctttccagtgatggccgactaggtcatcttttgatacatatgcagctagagtcaagagctccggggtactggttagttcataatgttgatccacctatagggttgcagatccctttagctccttgggtactttctctagctcctccattgggagccctgtgatccgtccattagctgactgtgggcatccacttctgtgtttgctaggccccggcatagtctcacaagagacagctacatctgggtcctttcgataaaatcttgctagtgtatgcaatggtgtcagcgtttggatgctgattatggggtggatccctggataaggcagtctctacatggtccaccctttaatctcagctccaaactttgtctctgtaactccttccaagggtgttttgttcccacttctaaggaggggcatagtgtctacacttcagtcttcatttttcttgagtttcatgtgtttaggaaattgtatcttatatcttgggtatcctaggttttgggctaatatccacttatcagtgagtacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctgggttctttccagcttctggctattataaataatgctgctatgaacatagtggagcatgtgtccttcttaccagttggggcatcttctggatatatgcccaagagaggtattgctggatcctccggtagtactatgtccaattttctgaggaaccgccagacggatttccagagtggttgtacaagcctgcaatcccaccaacaatggaggagtgttcctctttctccacatccacgccagcatctgctgtcacctgaatttttgatcttagacattctgactggtgtgaggtggaatcttagggttgttttgatttgcatttccctgatgattaaggatgttgaacattttttcaggtgcttctctgccattctgtattcctcaggtgagaattctttgttcagttctgagccccattttttaatggggttgtttgattttctgaagtccaccttcttgagttctttatatatgttggatattagtcccctatctgatttaggataggtaaagatcctttcccaatctgttggtggtctctttgtcttattgacggtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttctttgatccatttagatttgaccttagtacaaggagataagtatggatcgattcgcattcttctacatgataacaaccagttgtgccagcaccatttgttgaaaatgctgtctttcttccactggatggttttagctcccttgtcgaagatcaagtgaccataggtgtgtgggttcatttctgggtcttcaattctattccattggtctacttgtctgtctctataccagtaccatgcagtttttaccacaattgctctgtagtaaagctttaggtccggcatggtgattccaccagaggttcttttatccttgagaagagtttttgctatcctaggttttttgttattccagatgaatttgcaaattgctccttctaattcattgaagaattgagttggaattttgatggggattgcattgaatctgtagattgcttttggcaagatagccatttttacaatattgatcctgccaatccatgagcatgggagatctttccatcttctgagatcttctttaatttctttcttcagagacttgaagtttttatcatacagatctttcacttccttagttagagtcacgccgagatattttatattatttgtgactattgagaagggtgttgtttccctaatttctttctcagcctgtttattctttgtgtagagaaaggccattgacttgtttgagttaattttatatccagctacttcaccgaagctgtttatcaggtttaggagttctctggtggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccagaacttttatcatgaatgggtgttggatcttgtcaaatgctttttctgcatccaacgagatgatcatgtggtttttgtctttgagtttgtttatatagtggattacattgatggattttcgtatattaaaccatccctgcattcctggaataaaacctacttggtcaggatggatgattgctttaatgtgatcttggattcggttagcgagaattttattgaggatttttgcatcgatattcataagagaaattggtctgaagttctctatctttgttggatctttctgtggtttaggtatcagagtaatagtggcttcataaaatgagttgggtagagtactttctacttctatcttgtgaaaaagtttgtgcagaactggaattagatcttctttgaaggtctgatagaactctgcactaaacccgtctggtcctgggctttttttggctgggagactatttataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcagttctgattttgttaattaggattttgtctctgtgccctctagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgtttcttcatggaggcactcagagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccacgtgagtgttggctttctgttattttttttgttattgaagatcagccttagtgcatggtgatctgataggatacatgggacaatttcaatatttttgaatctgttgaggcctgttttgtggcctattatgtggtcaattttggagaaggtaccatgaggtgctgagaagaaggtatatcctttggttttaggataaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggtgcaatgtgtgctttgagctttactaaagtttctttaatgaatgtggctgcccttgtatttggcgcatagatattcagaattgagagttcctcttggaggattttacctttgatgagaacaaagtgcccctccttgtcttttttgatgactttgggttggaagtcaatcttatcagatattaggatggctactccagcttgtttcttcataccatttgcttggaaaattgttttccagccttttattctgaggtagtgtctatctttttctctgagatgtgtctcctgtaaacagcaaaatgttgggtcttgtttgtgtagccagtttgttagtctatgtctttttattggggagttgagaccattgatgttaagagatattaaggaaaagtaattgttgcttcctgttatttttgttgttaaagttggcattctgttcttgtggctgtcttcttttaggtttgttgagggattaccttcttgttttttctagggcattgttcccgttcttgtattggtttttttctgttattaccctttgaagggctggattcgtggagagataatgtgagaatttggttttgtcgtggaatactttggtttctccatctatggtaattgagagtttggcagggtatagtagcctgggctggaatttgtgttcttttagtgtctgtataacatctgtccaggctcttctggctttcatagtctctggtgaaaaatctggtgtaattctgataggcttgcctttgtatgttacttgacctttttcccttaccgcttttagtattctatctttatttagtgcatttgttgttctgattattatgtgtcgggaggaatttcttttctggtccagtctatttggagttctgtaggcttcttgtatgttcataggtatctctttctttatatttgggaagttttcttcaataattttgttgaagatgtttgctggccctttaagttgaaaatcttcattctcatccactcctattatccgtaggtttggtcttctcattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctccagtgttgcctcactttgagttttctttattgtttctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttttcgggtgtgttggggtgccctggactgggcgaagtgggagtactgggttctgatgatggtgagtggtcttggttcctgttagtaggattcctccgtttacctttcgccatctggtaatctctggagttagtagttatagttgactctgtttagagattgttcttctggtgattctgttaccgtctctcagcagacctgggagacagattctctcctctgagtttcagtgctcagagcactctctgctggcaagctctcttatagggaaggtgcgcagatatcttgtatttggacctcctcctggccgaagaagaaggcccaaaacaggacctttctcagacactgtgttgctttggcagttcccagaagctgtcagcttctgtggtgcagactctcacctgtgcagactaaaatcctaagttccagggagtcctggaaccaagatggtgaccgctgctcctgaggccgaggccgtctcccgagccaggcggacacctgtcctctggtccggatggtggccggttatctgcggcccgcccaggctgctgcctcagcggctctgtgcttctgcccgttccagaagctgtccggttctctggcacaccctctaacctgttcagactaatttcctaaattctgctgagtcccggaaccaagatggcgaccgctgctgctgaggctgaggtcgcctcccaagccaggcggacacctgtcctctggtccggatggtggccggttatctgcggcccgccccggctgctgcctcagcggctctgtgcttccgcccgtcccagaagctgtccggttctctggtgcaccctctaacctgttcagactaatttcctaggtcccgcggagtcccggaacccagatggcgaccgctgctgctgaggctgaggtcgcctcccaagccaggcggacacctgtcctctggtccggatggtggccggttgtctgcggcccgcccaggctgctgcctcagcggctctgtgcttctgcccgtcccagaagctgtcaggttctctggcgcaccctctaacctgttcagactaatttcctaagttctgctgagtcccggaaccaagatggcgactgctgctgctgaggctgaggccgcctcccaagccaggcggacacctgtcctctggtccggatggtggccggttatctgcggcccgcccaggctgctgcctcagcggctctgtgcttccgcccgtcccagaagctgtccggttctctggtgcaccctctaacctgttcagactaatttcctaggtcccgcggagtcccggaacccagatggcgaccgctgctgctgaggctgaggttgcctcccaagccaggcggacacctgtcctctggtccggatggtggccggttatctgcggcccgcccaggctgctgcctcagcggctctgtgcttccgcccgtcccagaagctgtccagttctctggtgcaccctctaacctgttcagactaatttcctaggtcccgcggagtcccggaacccagatggcgaccgctgctgctgaggctgaggtcgcctcccaagccaggcggacacctgtcctctggtccggatggtggccggttatctgcggcccgcccaggctgctgcctcagcggctctgtgcttccgcccgtcccagaagctgtccggttctctggtgcaccctctaacctgttcagactaatttcctaggtcccgcggagtcccggaacccagatggcgaccgctgctgctgaggctgaggtcgcctcccaagccaggcggacacctgtcctctggtccggatggtggccggttatctgcggcccgcccaggctgctgcctcagcggctctgtgcttccgcccgtcccagaagctgtccggttctctggtgcaccctctaacctgttcagactaatttcctaggtcccgcggagtcccggaacccagatggcgaccgctgctgctgaggctgaggtcgcctcccccacactactttcacaatcagatgcagagcagtatgaatacactcatactagtgcacagcttactttcatccattttattcagttcaagatccccaagattaaggaatggacctgtccacaattaagataattcttcccacaacaattgataattccccacaggcatgcccagagagccatctctcaggttgattctcgagtctgacaagttaactgctaataccaaccagtatctggttagtatatggctggttttagaattagaggatactgggttaccaatagtggtagttttcaaagataagttctatcttctgtgaaccccagtttcttcacatgccagaatatctcttttagctccaaacttctgtttatagagaaatgtctcttactttgactattagatgcatggatggctacataacatgcttatatgtggattcttatcacaactttcacatttttaaattatttgatatttaaatatttagattaaaaacttgcacaaactttaaaaacattatattggctatataatttttagcagcttgtagtatcccaacttggtggatcagtactgggtatggaattttgactacttctcaaaaaatgtaaacaaccaatccaaaatgaaaatccatctcagttgccttatgtggtgtttataactggagtggatatagtattgaacaaaaaagacaagaaagtcaaaatctttagttaagatttattttatgtatatgaatgcactgtcactgtctttagactcaccagaagagggcatcagatcccatcacagatggctctgagccatgatgtggttgctgggagttgaactgagagacctctggaagagcagagggtgctcttaacccttgagccaactctctagtccaaaatctttagtttaatctgacaggtataactatgatttttgtagtaaattcatatcatatgtaccattaaagatcttcataattacacaatatctcaaatagccataaatacctacctgtgataagcacagtggaaactaaaaagaacttgtcattctattaacagcttcttccggatatcttggagtgttcttatagaccctctttctgaagtacaactttagagatgcttgatacagtatggacttttaggtgtcagattacagactattgttgatatacaaagtttaaaagtagaaaataaaataagtttagacaaagagaggacacaacatccttgtgcttatttctaccctcaaaacaatagaacactttgccattttacttagtctccaaacaaccaccatttttgcaaatgttttaaagtcaatccctcacatctttcactttgcaaatgaaacttcagtatgtctccatgactattaaccactatactcttgtcttatattaacaatttaaagattacttttcatttactctacacttcctcgggccaccatttttagctggtattttaataaattaatgaacatctatcacttcttgaagtagtgatcaaggaacgttttggctttttttttttaaataaccaattcataaaatgtaatgtttcaatcaattgaagctattacgtttttgaggtaagttctcactttgtagacttggctagactcacgatcactggcagtgctgatattaaaggtatgcagcaccatacacattagttttttgaaagccattttgtaccacccttaatctgttaggagtcttttcaagtttgcttcttgcccattgtcacttttacagaagtcattgatcactgagacgtccttgcttgctgccatacaagtctttcagaagcatcctctgcttttttttttttttgttttccctccaagcattgatccaatagcgctgcaataacaaacctaaagcagaacactgtgttttctaatttgtagtgtcctttgggatgggtgcacagaagtgaattgttatgttacaggatatgttgtattgttttggtagatattccaaattcccatgttctcaccacaggcaagagaacgagtttccctatgtcctcaccaacagaaatagttgtcgagttctattttactgatcccaacaaggagatttaattgaaagatgcttggggttagttatattaatgtcctcagagagagatccatttgttgccctctcatctcctagtaaatttattattcacaaacctgaaagaattttatctgtaaagacaggcatttctatctatctatctatctatctatctatctatctatctatctatctatctatctatttatttatttattttagttattttctttatattcatttcaaatgctatcccgaaagttccctataccctccctctgccctgctcccctacccacccactcccacttcttggccctggcattcccctgtactggggcatataaagtttgcaagaccaaggggcctctcttcccagtgatggccgactaggccatcttctgctacatatgcagctagagacatgagctctgggggtactggttagttcatattgttgttccaacacccaacatacaatttgcaaaacacaagaaaatcaagaagagggaagaccaatgggtggatacttcattcctccttagattgggaacaaattacccatgtaaggagttacagagacaaagtttggagctaagacaaaaggatggactatccagagactaccccacccggggatccatcccatagtcagtcaccaaacccagacactattgcatatgccagaaagattttgctgaagggaccctggtatagctgtctcatatgaggctataccagtgcctggcaaatacagaagtggatgctcacagtcatctataagatggaacacagggcccccaatggtgaagctagagaaagcacccaaggagctgaaggggtctgcaaccctaaagacagacatttcattcactgctttgctttccgctgctaactgtaatgaagaaaatgtgcttacaaacaggagactctagttttctgtaaaaggaattttaaagacaactctgtgaaagagtgttactaattattaaaccaacagtgattggtaacaatgaggcacattttgtaatagctttgtcatttaatcaagcgatttctttattattatagggtcctcctggacttcctggatttccagggacaccaggtcttcctgtaagtatggtttttattcttttaaaatccccctaagaagtaatataagaaatattataagtgtgttatatgccttttcaaaggggatgccaggccatgatggggctccaggacctcaaggtatccctggatgcaatggaaccaaggtgaggttggttttttttttttttcaacttaattgtaaacagattgttgattaaaatctaaaaagagacagggtcattttgtgtctaagacaacattttcagtatattaaatttcagtaatttatttaaacctgtttaactagtgaggatactgaattgggttagggggtattttaaaagtctttgtgtaaagtattataaatattaaaaatggattaagacttgtgtgtttcacatactatagaagttgttatgggtaatacttggtaatatcttactaattttgatttttaaaatacgtgctatttaaaattttgaatacttcatgttttaagcttaaaaaaattgtatgttattgatgccgtggaggaagaaaccgatgtatgccaccgagcacacatggggttcagaggacagcttgtgggtatttagctctttctaccttgtggactatgggtatcaaattcagattgtctgcactttggcaacagacacctttatctactgaaccatctcagtgatttgattcatgctttattttttaacttccttaactgtcactgtgaaaaatacaattttttcatcaacaaaaatggtgcacttaacaatttaaaaaccccaaagctttagataatggtacttttcttgtttggagtcaacaatttaacattaagacatagcaatacataatgaggaaaatgttcttattataaaatgatattttatagcatttgatttttttatttcttgttttttcttttcttaagtaaatgcaccattactttatgtttatccttttagcattttatgttttgtgcataagattctacaaaactagatctatactatattttaaaattaatgtcatatcccagatttttacattagggtatacactttagttaacttcctgcaatacaaggaacatgttttctgagattttaaaaacatacataaattgaacatattacttttaaacccagtatttctcaggtctctgtaacccttgccaacaataatattttttttttcttaacacagagtcccactatgtagctctggctagcctcagactcacagaaattcaccgggcctctatctcccaagttctgggaactaaatgtgcaccatgtttgtcgcaacaattatatatatatattttgagacagggtttctctatatagctctggctgtcctggaactcactttgtagaccaggctggcctcgaactcagaaatccgcctgcctctgcctcctgagtgctgggattaaaggcatgcaccaccatgcccggcataatttttttaatgtttagattttttacatttttattagatatcttcttcatttacatttcaaatgctatccccaaagccccctataccctccccccctgccctgctccccaacccacccactcctgcttcctggccctggcattcccctgtactggggcatatgatctttgtaataccaaaggcctattgatgggagtctaggccatcctctgctacatattcaactagagacacagctctggggagtactggttagtgaaacatttacacaatggagtactactcagctattaaaaacaatgaattcatgaaattcttaggcaaatggatgcatctggaggatatcatcctgagtgaggtaacccaatcacaaaagaacacacatggtatgcactcactgataagtgtatattagcccagaaacttagaatatccaagatacaatttgcaaaacacatgaaacttcgctccttcttagaatggggaacaaaatttccatggaaagagttacagagacaaagtttggagctgagacagaaggaaagaccatccagagactgccataccctgggatccatcccatatacaaccaccaaacccagacactattgcaaatgccagaaagattttgctgacaggaccctgatatagctatctcttgtgagtctatgccaatgcctgacaaatacagaagtggatgctcacagtcatctatcggatggaacacagggcccctaacaaaggagctagagaaagtacccaagaagctaaaggggtctgcaaccctataatgtgtagatcattaaggcaaatatctggaattgagaaatttatttatgttcttcattctagctgagacagtctttgatggttggaccaataggaattttgtttgtataacacatttcataagaaagtgaactatggtgatggagtaatatacaattgatgaataaagagataggctgttaaaggctttgaaataaaaaaaaagaaagtgaactattttgttcctattctggtggcatagctatgttttactttgttccttttcttgtgtgtgtgtgtgtgtgtgtgtgtgtgtgtgtgtgtgtgtgtgtgtgtgtgtgtttggtatgtatgcatgcatgtgtgtttgctagcataccttttgcaacaagaaaactagtattcaaagttttaaataaagaaaccaaatgcacatgcagatatatttatggtgaaagagatatttttcacaaagtggtcttttcatatatctaacaattaatttatgttttagggcatcatttatggaataagttttatataaattaagtaattttatcgtacatggtgactggttagactttttttacccttctcactaggtatgtaaaatttgattcctaatgttgcatccacaatgtatggattcttttctaatgtcattggacctagtttattttttattaggtattttcttcatttatatttccagtgctatcccaaaagtcccccataccctccccctcgctcccctacacacccactcccacttcttggccctggcattcccctgcactgaggcatataaagtttgcatgaacaatgagcctctctttccactgatggctgagtaggccatcttttgatacatatgcagctagagtcaagagctccggggtactggttagttcataatgttgttccacctatagggttgcagatccctttagctccttgggtattttctctagctcttccattgggagccctgtgatctatccaatagctgactgtgagcatccacttctgtgtttgctaggccccggcataatctcacaagagacagctacatctgggtcctttcgataaaatcttgctagtgtatgcaatggtgtcagcgtttggaagctgattatgggatggatctccggatatggcagtctgtagattcattggacctactttgtccatctataaaaggtgattcagagaaggccattgcatagtgattcaaaagcacagtggggtagtaattttgcccctttaagcctctgacatgtttgtttctagaattgctatagcatacataggcatttggaaagaatttgaattaattttcttctatctcaattttaacttgttttcaaaccaaatgtctatgttcctactttgcaatagtgaatgaaaaagattgggtacctaagaaatctaatggcctgcaatttctaaaaccgttgttactgtattcttggtgctatcactagctttattccttgccatgttttacattttgaaaaaaaattgaaatagtttacaataagaggaaagtgaaatggtaagtttttaataagaatttgtacagtacctgatcaggaacttgcagcaaatcattaacaattaaatgtgatggttattggaaatctgtggtgtgatgggctcaaagtagatttttcaaaagaatatgacagtgagactgttttctccttagatttggttggggtagatgagtacgaataagagtgttcggcttggtaggttgaattgccacagacagttgattctgaagttattggaaaggggatgctaatgacattttggtgatctggtatgcatttgtcgtacaaattttcactgtttcttttttctctacactcttcctttttaactcccagggagaacgtggatttccaggcagtccgggctttcctggtttacaaggtcctccagtaagttctacacttcaggattaaaatgaattcaagaagtaacagaacagaaaaagtgtgaatacagagtttactcaaatggaacagcatcacatatttaaagtgtaaactagagaatttcaaagattaactggcaaaaagacttcctgcagattaaagccaaggattctgtgatggctagtataaattttacctataaaatcctctaatataaaatattctaaagtgaccctataaaagtttattcattttgttctcctttatgttatattcatatgtacatcatattttttgtttataacagtcaaatttgcacaaaatttccttctttcttttaataatagggacctcctgggatcccaggtatgaaggtaagcatcacatgctaagaagataagcagtgtgaataaaatatgtagaatgtctacaactgcagtagaatattactgtaagttcagtctccaaatggatacatatggagagtatattgtttaagcagtatactatgcaatcttatataatgtaattcttgaaaaagaagtgtgcattgtgctcaaatctctcttttctaacacattcaggctttatctgattgtattttgctagggctgactgctgaatatctctagatgattatctcttctttatccttggtttctgtaacactctagtctcctagcatttcttctgcatctgatagaccttcactctttagtacaagttcattctgttctgtccagcagccattaagacacaaacctgactcttcctgctcttctatgcctggtaatattaataatgttcaaggcatttattgattaggtagttactggccatctacattgaaatcttcaaattagattttttttctgagttcaagatttatgagttcaacaccctccttaaaaatctctgctcaaatatctccaagacgtatgtatgtgtatatatagtgtattcactatatatatatatacatatatatacacatatatatattcatataatacatgaacaaactatatatatatgaatataacatatatatagtttgtgttattatacactacataacttttaaattatatatacttattaattcttggaaacatgtacattcaccatattttgaattatgcctagccccaactcttccacgtctatctccactctcccacattccaagtcctctcttctctcatagcccattgagttcagtgtgtgctgtccatattctcatgggtttaagtccaaccactgaagcatgatcatcctgtcaagagccatacccttaaaggaaatggactctccttcacctagatgccatctgttgtcactaacttctctcatctagtggatggggtcttataaggcccacctccctcaatactgcaatgatgacctagttattcttgtgcaagcaactacaaccaccatgaattacattatgtccagaacacactatgttgccccagtccttcttaatgtcttgtacttataaattttctacacccctccctttccattaagtcccctaaatcttggaagaaggggtgtgatatgaatgtctccattatgactgagcataccacttaataaaatacccatgacagtcattctctatactttgatcagttatgcactctgcattaaccattgtcaagcacacaaagacatttctctcattggatctaaaggttaaactgataagatctaatgagtagagcaattggaatttagagggaaatttgatactatggtcctagatatacaccctggagccaatgagcttcctttcaatgtgttcttagtcagacttacactaacagtcaagaatttatcctgggaagtgtgccttaaaacaaatcacagggcagttggacacctctataacatcaatgccacttacccatgtgcatatcttgtcatgtgggtcattgttgtagcaacagccttattttaagacatttttcctttgatcactagtctcactggtctgaatttagctcatttgagaattttaattttctattattttttttatgacagactttcatgcatgctagataagcactctaccagtgagccagtgcagcttttagtcatttgtgggaaattatgcttattctttcggctgagagttacatactcttttcacattactctaatatgactgcctagttaactatttttattacttatttatcgctcactatgccattttgctttactttatagactgcaacagaacacactaccgtcttgtttacttgttatgttttatatttctccattatgtttttagcctcaggagaaaagaggctctacttctttattactaagtgtccagagcctaacacaatgctccacaaacactttatatctaatgcatatttctaattaatgaataactaaaagtgccacaaactcctaataaatctactgtacattggtataccatggatacttcttaattgacttttcaaaggtaaatttgttcatgaaattaccggtgtgctcagtctttcacttatttatgtactaaaatgaactctcagaatgtctttttaccttcttgctgtttctcatgtataataatgattttaacttacactgttggtttcttttagggggaaccaggcagtataatcatgtcaccactgccaggaccaaagggtaatcaaggatacccaggtcctcctggaatacaagtaagagtatggggaattttttctttattacatgattaaaacataggatcatatgagtcctgaccttctatactcactgttgctgttttagttatacaaattatcacctgaagttcttaaggtctcaatgcattccttctattttaaagtaaaagtttttacaaggcatatttgttttcttttatctatgtatccagtgtctgtgggtatttgtgtatgtggcaacagaagtttgcatcaaaaataatttctgacattcttcttctgctataggtagcagtagggttgaccataaatgttttttaacaaataaaattatcgatctctcttttaagatgttaaaattgccatttataacagtatcaattatgcatgatatctgagcagacactgaaggttgaaggaatgcaatttatgcatggtaaacatcaaatgtaatcttacaaaaagattgtgttagtttatagataatatacagagacagtaatgacttttgagtatttatagatgaggaagttcattatagtttatgaaaatcaatccctttatcaaaaatacaaatcaggaggttttactgtttgatcacaaagatacaattttggagatttttttcatttgttcattttttattctttacctgacattactagtcataatctcttaagttcattcaaatattctccttaatcatacatataatttttaatgaatatttaagataaagtataacagatcatatgcagaatatatgctgagataacacaaaatgaacacctaggaacactactaaacccaacagaaagttacaaataattttgaatcaatacaatgttacctggaagccacagccttcttgattgcctcaatatataactaggagcctgagcaaactgtttaaagttgctttattccctcaactgtatcagctttcctttacagtatgtgatagtcacgtaatctgctgcaatgcatctgttttccttggcttgttaaggttcattcgtattgttttgctatggttcattttttttcttttttcattatgtatttatcatgtttttgtctatcattgtagaacataatcttgctgaaagctgtaccccatctctcttattgagttaccttttaagctacttagcccttctatttgtacaatttttaagccctgatagtattgcagggttatagacttatgaaaataacttaacttgcatacatttatttctttatatgatgaggtaaagggttgagtttagggattttgtttttcatacttctttcctcattaaaattgataaaatatagtctttaaaatatattgtttactggtttcctttcttaataacatgagaaaatagaattaatgatttctctgtttttgaggattttttcctaggggggagggcgagagaggtgactaagcgatatctatcaccctgagaaccagtgagtttattagacttacttagaattgacaataagttactaagaggagtgcaagtgacctaaaagccacactgaaaagtctttacccaggatgtagcagggctttcctgaagccatgtagggagctctccctttctctaggcttcccagtccctgaccctagatcatccataacatcttgaggctttgtatgactaaggcctaaatataaaatcggctgggatggctctgtccatatcctccttttgttaaggaatgtaacatttaatctgtcccactgtgatcatgaagacagcacttgtttaacttagagcagaagccccacattctaacatacttttctttactccatttataacagggcccacctggtcccaagggtatatcagggccaagtggtcctccaggaccaccaggtttaatggtaagtttctgtaattgtatttttttctcctttgaattctgatccatggatataattactgactatattacttgaaagttaacttaatttcaatatccatgcctttaattttgttatttaacactggctctgatatggtaaagaatctaaacaagcaaagcccctatatattcatacaggtgaaaaaatacatacataaaaataaatacaagaaatgggagctggacatatagctaaggtagaatgcttgctgagcacacatgaggccctgttctgtccagtgcaggaaatataaagatgataaatactactgtaatacttagatttcattgtagtcaagattggagttagacctttgctgccatcctcttaaaaagacaacaaaattgtattcccatcaaagtaattttatatgcctttctgtgtcctatatgctatgtacttcagtgacaattttcatattttcattatgcttttatggataatgcacttttgtttgtgactattggttcttactcttcaataggggaaataatgtatgctacattccagacaagcctactgaaagtccttagaaagacttaaccactaccctcccccattagtttgatttaattgtaaacgtggtgcaatcagggaattctgggccatggaaccttttcataattctgttgttacagtattggtgttatctgggtctgttattaaaccctgaatttctttaacccttgtaaactaattaaccgattccctccacacttctgaatattccttcaattaacctgtatttaacagaggaaacaacgtcttagaaatgacactgaggtatgatatggaagtaaaaagagaatactgatattaaaagcactatacataggcaggcaagtgcctatttaatattttaaaactattgtccttatttgtaagaatttcatacatatacacaataaaatatgaccattttctctcctgttgctcacctctaactctccccacatgcctgtcaacatccccccccccccagcttcatgcttttaaaaaagttacccccaaagtctaattattgctgtccatttgaaaatgggagtgaggccatccatgggagcctgggaatcctaagagtcgccacatcctcagtagagggcgattgccccttcgctagcagctgtcaactgctgttagctcctcagtgagaagaggggactggaggtcatctatactatctatgctgagattttagctgacatgatcttgtgactttctaatgtaggtaaccccagtttttgtgacttcaagagtgcaatagtcatgtcatgtctagaaggcaactgtttacagcactacttctcatttccaagtctttctactttctcttctcccaagctttgggcaggagagttgatagatatgtccagtttagggctgaacacccagtctcttattctcagcactttgactagttatccatgtctcccattgactatgccctgttacaaaaaggagtgtttctaaccaaacttcaaaacaacccaagtccatgggtataaaaataaataactaaaaggcatgtagacaaacatgactgtttaataaaattgcaataatattctatcattgggtccaagacctcctgtgctatgggcttttgaccagggttgcaatatgaggtttgacattcctctagaatgtcaatcagaaaatgattagttatccaataacagtcaggccactattgtaccagtaggcaaaacttatctggtaggtaggtattgcagtatgcaggacccagcactggttgacacactcatgtgttttctctcccagcattcttcattttaccagctggcactgagaaatctggccacaagggagaaagtttccttgtgtgtttgcgattgacttctctgtatcctgcagctaaagtgggagggttcaacaattgggtcttatcatatagttatggagggtaaccaagaaaagcctacttaatttttcatgtcctgagacatgattagaaattcaaattgagcatgtgctttaaaaaatatcaacttcattgtttcccataattctgataaaaccatgttcactgaagttaagttctttggtttggggacttgcgctatctcccctctcatttatcgatcctagttttctactcctgccaattctcatcctgtcactgacttttctacatttgtctaggttgttttaatcaattgaactgtgtgcctctgatgaaaacacaattatgaggggaaaaataggattggcttggtacctcactttagtacacagctgctttatctctgagctatatccccagaattaaaaagagtttgaaggtccttttgggttgtcacattaaaaaaaaaacaaatagttttaaagaaacatcatactaaaatgtttttttcctccttcctgcgtcttctaagggacctcctggcccaccaggcccaccgggaccaaaggtaatgttctttctgttcacatcatttgtttcctgtgggttaggttttctgattgttattgagactttaaatggaaacttctctccccaggggaatatgggcttaaatttccagggacccaaaggtgaaaaagtgagtaatcaaaagttggtcatccagccttcatgcctctcctttcacatgcacctggactgtcttgttcctccccctgtttcttatgatggacatagtttacctataatattgttacttgtagtagattatgaaatatcactatatctttgttgtgtaaatagggcgaacaaggtcttcagggcccacctggtccacctgggcagatcagcgaacagaaaagaccaattgacatagaatttcagaaaggagatcaggtgagccctcagggaggggaagtggataaagactgtgctatagatatgttaattagcttgattggggtaatcatttcacaatatgtaggtatattgagatatcaccttgctcattcttaatatgctcatttttgtcaactctagctcctttaatctattttttaaaaaaatatgaaaaatttaaaactgaaagaccttgctcttataaaaggcactatatatagacatgtattattaattgagggtattctttcaataacaaggacttcggataattagatttttttaaaaaataaactagtcacgatgtcgttctgctgttaatactagatgaacctaaagttcacattcttgaacatgttttgtgattatctccaggatagggagaaaacatattctagtactaatgtgctttcatttttctccatacctgcatagggagttcctggtgatagagggcctcctggacctccaggaatacctggtcctcccgtaagtattccaagactctttagcatcatttaatgtgaactgatatctatagacaatacctcatgaaccaatgtgaatattgattttttgcagggtcctcctggtggtgtgaaaggtgaaaagggtgagccaggagaggcaggcaaaagagtaagtgttatgaccatcaatggtgtttataagaagcctaaatatgttcatgtgcgagatctctttctagttcctaatggcattgcctgaaaatgtcactacaggtataacctataataatacctgtcatgcaaaaagtctattcagccaaacatttgtggtgcactttgatctcagaactcaggaggcagaggcaggatgatatctatgatttcagggctggcttgatttatagaacagccagggttccatggagaaaccctgtctcaaaaagccaaaaaaaaaaaaataattaattacttaattaattttaaaagagcactttaaaaatctatttacatagttcaaggcagaagtaatggttgctatagtatttcctctcctattaccaaactaacaaagttttgttcacactccatcattgctttgcatcctacagggtaaaccaggcaaagatggagagactggccaaccaggaatcccagtgagtagcaatggtcctttcctttaacaaaaaacattggtagtatttgcactatttgtgggtggtaatagaaaagcagagggcacacagtatggagtttggaaatagtttagatgaatggaaattatcatcacctttctgaatatgaatttggaatgtctctagttttaaggcagatataatgaggtgtgctttaattattgtttagaatcttttctagttgctgtaaagacactaacaaaactatcttaaacatgaaagtgtttatttggctacagaatgatacagtccaccatggtagagaagacgtgcagtagtcaggaaaagcatgttggaagaaacagagactggattgtcacatcataatttcccctcttcctcttcctccttctccttgtcctcctcctcttcttctttaccatttcatatatgcacctctttcatactgaccactcttatctcttacctccctacctccacacccatctctctcatgttcatgtatattcatttagttttatagctcagaaagattaatccaaatccttggtaacactgagtttggagctatgtgttggagactgatggactcaagagagaaggtcctaactaaacacaggatggggctctataaggtcctccttcttccttgactgttgataaggcttgtcaggtatggtcccagtgctggttgaattaagaggacagcatttattagcccttccccctatccttgaactcttaacatacctcctgctccctcttccataatattccttagagggagtggtctaagtaaatgactgattcatggctgggcccacagctgtcacttatagtctgtatcttgggcagctgtgcatgtctgcattcaccattgctcattgttaggaggcgattgtctgattaatgctggagatccttgtgtctatgggtgtaaagagaggtacttagaaggtgtttgttcctgtctgctaagttaaccatcagcaacacactctctgcatgggcatacttcctcttcagacctaagctgttagctaggttcatactactaggtattgtgtgcccctcttcccacctgcctcatgctgagtgggtcttgaatccattctgagggtgttagcgttctgtctaaactctactccacagttacctggcaacagccaggtatgctccaccccacagttacctggcaacagccaggtagacgacccactataaaaggggctgcttgtcctctcccctctctcttgcctctctctcttgctatcttgcctctccctcttgctcccccctttccccattcccttcacctcctttccatgtggtcatggccagcctctacttccctactctctccctctttctgcctttctctgcctctactaccctcttaactccccctattcgctgaataaactctattctatactataccatcttgtggctggtccctcggtagggggcaggagggaagggatgccttggcatgggcctgctgagacattcccttcccccatacctcaccacaccccagtagaatatatcttatacctttttatctttttataaaacacatcagagagttaattggttacatcccaaggtgctatcacacaaatggaaatatcttgctttccaagtggtttctttatatattctctttgtctgtgttaagtgttttcccactcacatcctcacttctccaatcttgcctctccatccctgcctaaagctttgcatacatggtgtactcttttagtgtgggagctgggtagaacagcaatgaacatgtatgtgcacatagtaaggcacaaaatctcacatgcctcggagggatatagctgagtcatatgctagtttttagtgtttgaagaagactgatttccaaagttgatatactctgttacattcccaccaataatatagaagagttctccttctcctaacatctgcattagcatttgttgttactgatattcccagtgactgactgggttgtggtgaaatgctgacgtcattttaaactgaattcccttaatggctaaggtgtttccttgccatttgtccatttgaatgtttcttttctttttttttttattattattttcttttattttagatctatcatttatttgtttgcttgtttaattttctgtgtatagatgttttgcctgagtgcatcttgtgtgtgtgtgtgtgtgtgtgtgtgtgtgtgtgtgtgtgtgatgactaaggagtctagaaggttgtgactgctatgtgggttctaagaaatatcacagatcctctgcaagagcaacaagtgttcttaaccattgagtgacctctccagcccctacaggtttggatttgttgttgttcttttgttttgtttttttttccttttgagaactttctctttagttctgtagcccattttcaaattgggttgttttcttggtatgtagtgttttgaattctttgtgtatttttaaaattaatttacttatttattttatacttattcacattatattctactcactgcccacctctcagtcaacccctccaacagtccttcccccatgcccccctcctcttctcctctgaccaggtggggtaccctcggatatgcccccaccctggcacttaaagtatctgaaaggctaggtgcttcctttcccactgagaccagacaaggtagcctagctagaagaacatatcccatggacagacaacagcttttgggatagcccccactctagttgtttgggacccacatgaagaccatacagcacatctgctacatatatgcagggaggactaggtccagcccatgtatattttttggttggtggctcattctctgagagccccaagggtccaggttagttgactctgttggtcattctgtggaattcctatcccattaggagctgtaattcttctcctgctcttccataaaagttcccaagctccatccactctttggctgtgggtgtctgcatctatataagtcagttggtgggtggagcctctcagaggacagttatgctagattcttgtctgaaagcataataaaatatcattaatagtgccagggattggttcttgaccatgggatgggtctcaagttgggctggttattgtttggccattccctcagtctctgctccatccccagtctctgtatttcttgtagataggataagttttgggttgaaagttttgtgggtgagttggtgtccctatcactccagaggcagtctccccagacttcatattcccagtgctgtgagacacagctaaggaattcccccattgattcttgggtacctcacttatcccaggtctcagtctcttcctgaagatgctgcccacctcttccactcctctttgtgtattcccaacactagtcctcggtcagattatgtagagcaggcaaagattgcatcccattttatgggctgcctttcagttgaatgagtttcctttgctatttataagctttttaatttcatgaaatcccacgtggtgatttcttagttacttttcaatttctatgccaaaagaccatgaccgaggcaacttagaaaggaaaggcttatttggacttcaggttccagagggattgtggtctgtcatggcagagaagcagcaggcattgcagccgggacagcaagcaaaaagttcacttcttgaacagatagcaggaagcagagagaacaaactaggaatggtgtgagggtgtgaatcctcagagctttctcccagtgccatacttcctccagtaaggccacatctcctagacacccacaagcagcaccaggaactgggcaccaaatgttcaaatgccaaagcctatgggtggggaggggctttctcatttaaactaccatatcaggccttggtcttattttctgtgctttgggaatcgtattcagaatgtctttgcttatacctatatgttgaaggatatatatatatgctttcacatttgtagaatgttaaatcttatattggggtaactgatctatttgggatggattttgtacaatgggagaaaaaggaatctaatttccttcttctgaatgttcatatccaggtttaccagaaccacttgctgaaaatacttcccattttcaagtgttgtttctcagcatctttgtaggaaaccagataactgtattttcagggactgtatcttctcttctattgatagactactttagcttatgttctcattacttgtgttgaggacatgatttttggcatcttcctaactttgccatgtttactaatatcaccccatactctgttttaaagggtttgcctggtgatcctggttaccctggagaaccaggaagagatggtgaaaaggtaaaactttctacattgtgatgtgtctggttttattcttattaccataatctgtgctcctcttgatactggattataagtgaaattataattacttagtgtttgtattcctgccttcattacccattttttcccttttatgcactttcctttaaattttcttgcattgctctaaatcacagtgcagagaaaatgcatgggattgaatttgcattagaatgtcagtgcctttgctgtaagcatatatcaacaaatcttttaagaggaggtttgatctctattccagtgaggttctcttgaaaagtttagagctgtaaacttctaatttctcctctaaacattttccactttgtatgtaatcattgtttgtttatctgtgactaattcgttgtagttttcccattggatggacacagcctgattgaggtcatttatttagttacctttttaaaaagtgactctgaaagcctgtgtgaaacacagttaccctatttttagcatatcacaaaatatttagtcctccatgttctctgttctctaactgctttgtatcaaaaccaatctgaaaaaagattaaagcaaacttgagttatctagaagtcacatattttactgatgatttctctctaaactagatccaagttttagtttagactaaaagacataattggaataaagggagagatcaaatacttaaatgggattgtttctcagttagtaacttatgatgcacagtaactttcctagaacttgaagtgtgagagagaaatctattcttaagtcttggcccgaaaaataacaattgaatgttgttttcttcctttatgacaatgttgtcttcttcctttgtgacaaagcatgttgctgctaggaatctgtccagtgtattcagcttttaagaaagctagcaaggttaattcattttggtcaagattatataatcagtacatccaaggcaagatcaaaggtctttggcaggcttaagcaagtatctcattaacctatgttatactttccacttgatttctttatgaatgacgcatgagtctttatgaaactcaattgttacttgaggaaatctaaaccaccacgtcattcttactaattacatgttataacattgccttgaacagggtcaaaagggtgatattggcccacctggacctcccggacttgtaagtttttctcttacgaattcatttctcgaatttaacattgcgtcaacatttttgtacacaagctatacactccctaccagttcctcacagaacataaaaatctaagtcattatcaacttctactgccttagaagccattatagttttgtcttgtttaatcatccatgttaaccttaaagttgttatacggttctgcctctgtgttactttttcatagttaaggtccaaattacacattattgttttgcatgattgtcaactcgtttcttaagtaaccagtaggtggcgcaactgctgctttcaaagggttcagagaaaggattttgagggaaccagaaattggtggtttcccctgcagtgcttagggcaaacatggatttagtcctaataggtttgctcaacttgaaattgtctggttcacatttctctcctttccttagtgtgtactttctggggctctagataacaaatcagcaattgctataactgggaggaggtgatagtatagattttctatcatatttacattgattgtggaatttaagtcatgtatatttccaagtatatcaagaataaaaaagatcactgttgaggattaagtaatattttggattgaacttggctaattctctagacttaacactgcattgaatccacagtagtgaatgctgtaaaagttcttctatactcctgacatttcagttctccttaccctaatgagtctcagacagaaatacatagaaacctactaaacctaatgaggccatatgtataatagatattagataatttttatccactttcacttgtttccagttcaaaatcggttctccaaaaaataatctctttagaaaataagacaataaaatcaggagtagaaatggaacttttaagagtgtagcacacttttcctttcagatcattaccctcattttgtatcttaaaactttgaagtctcttcttgtttatgaatatttttatgtccattggacttaggtagagtgaaatatcatagttggctagcaagtattaatttgtatgctggatcaacttgaaattctttatttttgtgaaattctttagaacacaaataagctatgagaggatgtagaagataggggtattcctcaaagggatggggcattttcaaagaagagtgtgagctgcagatgtttggaagacatctgtaaagggcactggtgaaaatgtgcacattgtgtgaagtggttataaccagatagccttgagagatatgaagtcattgctaaaaataatagggaaagaaataagaaagagtgatactgaaggaagtggtttgaccaagtttagggttccaagtagtatcgcatacagaaagtaggcaagtaatgtccttaggagaaatgtttacatagaaaagttgatttgaggaaattagcttaatgtgtgagatgaggacagaaattgtggtggttttagaaagaattgcagggcttcaggtgactggaatattatgaataatatgagaagagacagcaaaacacacgtctagctttgtaagccttgggcttaatattgtagggattacatgtttcctaattggttgagggtcaaagtgatagaggtgattactatgtaacagccttaaggagactcagtgtgatggctttcaggatttcctatctaaggactgtgtgaaaataaagcattataaccacatgtagctgcttagttacacttcgaagaacaagctacttcttcactgaattcctgaactccttttccataaaaaggtaattcctgcacctggaactggtgtgactatgggagaaaaaggaaatatcgggttacctggtttgcctggagaaaagggagagcgaggatttcctggaatacaaggtccacctggctttcctggacctccaggtaaaagacatgatggttatatctctatgcttacatagccaatccatacatacaattatttgatgtgacaactttattaattctgtgaggtttcagaaatacatacaacatacttttattatattagaaccaattttacattttacaatgaatataaaatcttgaccactcttacttattatttccagtgaagtgaacaatttcttgctcctattctaattactatacaattattttgtttcttttttaatagatattttgtttatttacagttcaaatgttattccctttcctggtttccactctggaacccccatcccatcctccctcttcctgcctctatgagggtgctaccccacccacccacccactcatgtcttcttgcctttgcattcccctacacgggggcatcgagctatgtgagaacccagctatacaactcctgagcatatacccaaaagatgctccaacatataacaaggacacatgcttccaacatataacaaggacacatactccacactatgttcatagcagccttatttataatagccagaagctggaaagaatccagactccctcaacagaggaatagatacagaaaatgtggttcatttacacaatggaatactactcagctattaaagacaatgactttatgaaattcttaggcaaatggatggaactagagaatatcatcctgagtgaggtaacccatacatacaattttatcatattggtttgactgggcatgacagtggatgatgtgaatggttcaggcttcacaccttgtatgtttgtgtatgataaatgtctgtgtggggatgaactcacccatgtgagtaccggtggaggccataatttgacattgaaaagtctttctacacttttttttcctcattaagcaagtctactcttgctggtcagttagcccccacaatctgtctgtgtcaccagaatggaagttatattaccattattaccattccaggctcttaagtagtttctgtggatatgacctcaggtccttatgttttcctaaaaaccctttacacacttaccccattccaaatgaggactttctaaataaccaagtataccaaagctgtattgtgtttcacaacaaattcttcacatgtacttttaaaagcttacttaaattttgtaaaaatcacttttaccttctattaaaaatatattgtgccgggcagtggtggcacatgcctttaatcccagcacttgggaggcaaaggtaggcgaatttctgagttcgaggccagcctggtctacatagtgagttccaggacagccagggctacacagagaaaccctgtctcaaccccccccccaaaaaaaaagaaaaaaaatattgtaccaaacaggtccttgatcctgtacatgaatcatcacacttttcattttgtcagaggacaggatactgacctaataaattactaacatttcttcatttcctatataacagtactaaccagaactgtccacttagaatcccagaatcaatgaattagaaatctgcgaggtgatttcaccacacaataaaactttaagactcagtgctgacttttatagctttcccttaccgggagctcttgactctagctgcatatgtatcaaaagatggcctagtcggccatcactgcaaagagaggcccattggacttgcagactttatatgccccagtacaggggaacgccagggccaaaaagggggagtgggtgggtaggggattggggggtgggtataagggacccttgggatagcattgaaaatgtaaacgaggaaaatacctaataaaaaataaataaataaacaaaaaaagttggctgcaaattaaaatgcccttatatatcctgttcattaagttatcagattttatgtaaacttcacagtagtgtctgtttcagtatctggcacacacatgtattcaatggattatagttcgttttcatgcaaaagtgtgtaactaaggaacagctgtcatgaggaagaaagtgacacctcccaagaaagaagctagtaagtgtgagtttcattatggtctaagtatgtgctttttattccttatctcaaataagtgaggtaaatgtttgttatgtcttgataattaacgtgaggcatttttccagaatacagtaagagctcaggagttgaataatataaaggaaaattataatgcacaggggatcagggaataagttgtatttcccaaaactatcatgtgagagtcgaagtacaaaagaacggggtgaggagcagtatttgaaaacaagtaatggctgtgatcttccacttacttaaagtacatgtttgtgcaagtgcacacatgtgttctctctctctctctctctctctctctctctctctctctctctctctctctcccctttgtgaaaaatattaaactaaacaaaagaaaggaaaagttaaattaaacaagaaaaaagtaataacaaaattacaaagccacataactatgtgactcagactcgtggaaatttcagaatttaggaataaaattaaacaaacaaacaaaagcaaaatcaaccaaacaaacaaaaactcatgaaaacctacctaagtgggggtgtgtgcagggggaggcacattgcctttgaaacagtaagtttgtaggacataatggaacatattttcacagtaaaaaggacaaataactatgaattttggagcctatattctcctaaaccgccatcctggtatgaagatggaatagttaaaaggtttacctcctccagacatactggagagtaagggacaaattcaggataaagtaggggtgggaggtagggtaaaagaatcagggactaagaaagattgtaataactttgattaactcagttcataaaaatatgatttacataaaaacccaggactgtgtgtgtgaatattctttacatggtatgggcaaatacagagggaatgaggagttggccagtggtgcagttgttagtttttactattagtatgtgagaacataagcattatttactctaagcttttagagaaatacagatttaagggctttaggagtggttcagtggaacaaatgtttgctacacaaacatgaagacctaggtttgaatccctgacactgatataaaaatctagggacagtgtggtacatggcctcagagggaagagaggtggaggaaaagaaggagaaagaggaaaaatatagacttaaatacatagatcaacatgtataggtaccattattaagaagaatagaaataaaatgtacaatttatctccagttagaggaaaaaatagatcaatctatatagtagaaggtaaaattaaaacacagaaagataaacccagatgtatagaaaataaagtataagatgacacagaagatagtgaaaagtaaatcattaactccaacaaacataaagtgtgtatacttcgttccttcttagaattgggaacaaaatactcatggaaggagttacagagacaaagatcggagctaagactgaaggaaggaccatccagagactgccccacctggggatctatcccatatacaatcaccaaacccagacactattgcatattccagaaagattttgctgacatgaccctgatatagctatctcttgtgaagctatgcctgttcctggaaaatacagaagtggatgctcacagtcatcgattggatggaacacagggtccccaatgaaggaggtagagaatgtacccaaggagctaaaggggtctgcaaccctataggagtaacaacaatatgaactaaccagtaaccccagagctccttgggactaaaccaccaatcaaagaaaacacatggtgggactcatggctccagctgtatatgtagcagagaatggcgtagtcggtcaccaatgggagaagaggcccttggtcttgcaaagattctatgccagagtataggggaatgccagggccaggaattgggagtgggtgggttggggagcagggggagaggggagggtataggggattttcaaggaggaaactaggaaaggggatagcatttgaaatgtaaatgaagaaaatatctaacaaaaaaagaagttaaaaaaataaagaaaagataaatgatagatggtattaatgtaaaattgagataaaaaactgaaaaataaaataaaatactggtatagtatgcagaatatgtatatctgaagcagaaagaggaaacttgaaagtaggtgcaagaaatattaattaaatgatttatggaagaagaaagctatttaattctaatgtcaaatgaaagaaaattcaatgaaaaatgcattaatgactcagatattaataaatgatacagtgattaaagtcatgaacctttacacaactaatgaataaccttcagttatataataaaattgataagcttcagggggtcaattgacaggtccttaacacactgagtgtattaatatagcatataaataatttgaccaacattaataagctatatgttgaaagagagggaaactgttctaggaagcaaagaatatatattctttgtagatgtacatagaatataaaaatagactctttttttatttgaaaagaatctactgtgtgtatccttgtgtatgattctctatggctacagtaaaatagactggaaaaacatcaaatatccttataataatatttgtatggtgatgtagttaaaagtacttccagagataaagcaggcattatatgacaatgctaagccactaaatgctaagccacaataaaatgtgcttcatatcaaaactctttgactatagagcaaacagtacccccactctgtcaccagactacaaataccaaaattaagagagaaatatgaatgtagcccaggtaaaatgtacttgcattacacacacaaagaatgaggttgtatccctagaaacgataaagaagacaaaatgggctaaatttaactcacacacacaaacaaaaagaaacaagcacaaaatgtagaatggaacactttactaggatgaaaaaagtctgtaaagtgaaaactgaaacagatacagctcaacatggacactaaaatatgaaggtttaaactcacaaatggtaaaaactaaaattaataaagaaaaaaggatattgccataaatttttattgtaaggtattggaaaactataatatctacttatatatttaatattttagatgaaaaataaactctttaagcaagaaaacaaaattattaaagttgtgaataggaagtctaagtaagtcaattaacataggtaattttggaagattgaagatgtatatgaagaaatgttgatttacatgcacttttatagttttacggatgaattataccaaactgtaaaacacatccccatgttttgttttatttcaaggcataagtagaaaacctaataatactaatagcaaatcagccaaggaaaaacactgtaaataaaaattattcaatcttattcatgaacaaagtataataatgctaaattaaaattaccacttctctataaattatatatgatgttatcgctgtttaatttttcccaagatatcaaaaatgtttctatgttacattgctttaactgactacattaccaaaggatagaacaataaatgtatagaaattgatactagcaacaaacagtgaaatccactctttacagacctttgtaaaatatttgtgagtgggcctggagagatggttctgtggttggtagaactaactgctctgccagaggactcaaggttggttctcagcacctgcatggtggcttataactgctaactccagttccaaagaatctttttctctctttttacccttaaaggcaccagcacaaaaatggtgcacataaaatcatccagctttgcacacatacttatacatttaaaatatatagtcacagtgaataataaaaaattactaaaatatataccaagatacactttatgtaagagatcaataatttaaagtttattatattaagaactcatcctttaaattcctggccatcagatgccagattccaattggattttaaagagaaatttacaagtcattcttaaaattaattaagagtaaaactttaaatatagaaaataatttttaggggactggagaggtggctcagcagtgaagaacactgactgctcttctgaaggttctgagttcaagtcccagcaaccatatggtggctcacaaccatcataatgaaatccaatgccctcttctggggtgtctgaagacagctacagtataacatacatataataaataaataaatcttaaaaagaaaataatttttaaatgtataattatttcctgagtagttttgaaaaaaaacataaagtgtgtttatgtacaaaataggctgtgaggctgaaaaatgtccaggaatggagttacattttatttgatcatatttaagtacccattctctctttgccttttgacagtttcatatgtgtgtgtaatatactgtgattatattcagtctcatttacttttgtcatctcccttaatttacttttgagccccttcttcctaactagctctccccacccccagtgacaacactattaatgaaaagtaacaccactcatccatcaaccatcaacactccaaaggtcctcaggaaagaggagatccccgaagtactttcttttttcatgataaagtgctgaagggcccgtcttataaaaggatccatagctgctgtgtattccagatttgaaatggccatgtcatatctgaatggcagccttttgtggcacacctctatgttttttcatgcagccatagtttttgttaagctttctctctatccccataactactcccattcccctcccttaaaggaacgatatttctagggatagaacattatcatgtcaaattgagtgtattaatttattattaacttcaaaaattcataaaattgcttttgtttgttgatttttaagacagggtgtcaccatgtatggctatcatggaactcactagatcagactggtctcaaactcacagattcgccttcctttgtcacctgagtgctgggtttaaagttgtgcactaccaccaccgggctattactttgaataattgtgccttatactcaaagtgttacatcatttaaagaattcttccttgcaagtgttaattaccatagaaaaccttaagaccaaaaagaattgaacagggactaagttgggtaggaaggggtttaaaacatgagcagccagcaaatggggagaagaaagacaaaatagtgcacatcatctcttccatgcagaatctaatttagccttgtagaatgtgccatagaagcagaaagaagactgggtggataaatgagagtaaggaagggaaggacaagtgatggataaggtattgtggggtggatatgaacatatgtatatatggcataatgcaacccaatgttttgtttactaaaaatacagttttttttttaaaaatacaataaggaaatccaaccaatattatattaaaggcagattttatcattttatcttgtaattgtgtacaagataaggtcattttggtcactttatcatatactttttgtcatttaggaacagcagttgtgggtccccctggtcctcctggatatcctggtgaaaggggccagaaaggtgatgaaggtccccctggaatttgtattcctggatctcctggacttgatggacagcctggggctcctggccttccaggacctcctggcccccctggcccccagttgccatccagtaagccgtgcttttatcctgacatgcttggctgttgttctgctgtacgtcatttagaagtgaatctgactgaagtttgacatcgttatttatgttcctgatatctaagagattatactgttgtttttagtttgtggttttggtcattcgtcttcaaaccgtgttgattattaacaatatgttgccatattgcttattgagttgtatttttacagagaaataattgaaaataagtatttttctagcctttctgaggttttttttcctctagtcttctcaatgcttaacgataattaacttgctattttatctttaacctcaggagatgaaatctgtaaagcaggccctcctgggcctccaggacctccaggtgataaaggactccaaggagagcgaggagtaaaaggtttgatcccaaacatcttctcattctttaacatcattagtggaatgccctgcatctaacttctatcttaaaaaagctattcccatatcatctccttaaaaatagtgtatatttttgtaatgttggtttcatatctcagctctttttagcttacaacttctaataacttgactccagcacacctcccattgagacttactttagattagccatagcttaatggtatattttctttcctcttaattttccttaaattagcatgaccactcattgaaatcaactctattattaagcttgactcatttatttcctcacttccttttatttgtttggaactaaggtttagcatctttctctctctctctctctctctctctctctctcatttttttcaagactgggtttctctgtatagccctatctatcctggaactcattttgtagaccaaggtggcctcaaactcagaaatccacctgcctctgcctcccaagtgctgggactaaaggtgtgcgccacaactgcctggccttcttttctctttttatacttataggtaattatcactttaagattcttaacttgcttccttcttcattgacaaaataatagcaaacactctcaaggatctatggcaccacatactcagagataattacatttgtgcccaggcagtaccttcttaactaattatagttactgtttgttcttgaagcctggtagtctgggtggcctcctgtttccctaagagttttgattaaaaaattcttacctagtatttccaggaaagttaattaccatagtataaaccttgttcttcacgggaagcaaaacaaaccgatgaaaaatatagaagctctatttgaataaaaatgctggataagtcatctagcagacagacatgacagatgaaaatgtaaccatcttatctaatgtacaatatattactacatagaggactgtggtaataagttagtagtatcgtgcagctgccttgtaagagtatatttttgtcttgatgaaattggttggggctggaaatcaacatataagtggctaataatattaacgacaaagggatcaatagtggtcactagagttgaaaaataacaatggttttctattggcattagtcttgctttaattttacatggaaattctaatgtacatgattatttacttttgttttgttttataagagtttcttacatttctacctatttatggtagactgaagttagtgttaagtggtagtgttgagtttgggattatattaaggtttgattgggtcttttgtggcattagtttttttgtttgtttgtttgtttgttttaggagtgatgctagcatttgcctattctacagcagtatcagtagaaaggaattcagacctgtgatacactatttgaattattgaaggtgttaatggtggcttttgatagagttaattagagttgtattattaacaaattatgaggtagggttttttgttgaatttgataatattagaaattgaataattcccttcctgtcggcaccggcatcgggtcaccttgggcgcagagtcagcggacacccccaaggtccctagaggactctccacgtgatcttaggaccactagtgagtggaacacaacttctgttccaatccaatcacgcgggacctgagacagcattagggaagcagaaaaccagcctgaccagggtcacaagtcccttccggttggcgccagtacctggtaacattgtgctcagagttggcagaccccccacggtccctagaggactcttcacgtgatcttcggaccactgaccagaaagctccacactcctcaaaggagacaccacttccaggaactgtaacacgaccaggatctttgacagcaggatcccaggataaaaggagcttggtcacaccagtatttcagggtctcagaggaacttgactgccaagaactctgacataaccagaatctcaggttcacaggagcccacaagcaaaggatcacagagaaaactggactctgaggagtcctgaattaactgggattatagggaggagaggctccaataagatatattgaggacatcaaatacttgagataatcagatgggaggaggcaagcataagaacagaagcaatagaaaccaaggttacttggcatcatcagaaccaaactctcccaccatagcaagtcctggatacaccatcacaccagaaaagcaagacatggatctaaagtcacttcttatgatgatgatagagggagttaagaaggaaatacaggaaaacacaggtaaacagctagaaacctttcaagaggaaacacaaaaatgccttagagagttaaaggaaaactaaaacaaacagaagatggaattgaacaaaaccatccaggatctaaaaatggaaaaagaaacaataaagaaaacccaaagggaaacaactctggagatagaaaccctaggaaagaaatcaggaaccatagatatgagcatcagcaacagaatacaagagatggaagagagaatctcaggtgcaaaagattccatagggaatagggacacaacaataaaagaaaatcaaaatgcaaaaagatcctaaatcaaaacatccaggaaatccaggacacaatgagaagaccaaacctatggataataggagtagatgagaatgaagattttcaacttaaagggccagcaaatattttcaacaaaattatagaggaaaactatccatacctaaaaaaagagatgcccatgaacatacaagaagcctacagaactccaaatagactgggccagaaaagaaatccctcccgacacataatactcagaacaaatgcactaaataaagacaaaatattaaaagtagcaaggggaaaaggtcaaataacatataaaggcaggcctattggaattactccagacttctcaccagaaactatgaaagccagaagatccagaagagatgttatatagaccctaagagaacacaaatgccagcccaggctactatacccaacaaaactctcaattaccatagatggagaaaccaaagaattccgtgataaaaccaaattcacacaatatatttccacaaatccagcccttcaaagaataataaagggaaaacaccaacacaaggacagaaactataccctagaaaaagcaagaaagaaatccttcaacaaacctaaaagaagacagccacaagaacggaatgccaactctaacaacaaaaataataggaagcaacaattacttttccttaatatctcttaatatcaatggactcaattccccaataaaaagacatagactaacagactggctacacaaacagaacccaacattctgctgcttacaggaaacccatctcagagaaaaagacagaaactccctcaaagtgaaaggctggaaaacaattttccaagcaaacggtctgaagaaacaagctggagtagccattctttttttttaagagttatgaatttattagtattttatttttttaattttttaaaatattttttattacgtattttcctcaattacatttccaatgctatcccaaaagtcccccataccctcgcccccaactcccctacccacccattcccactttttggccctggcgttcccctgtactggggaatataaagtttgcatgcccaatgggcctctgtttccagtgatggccaactaggccatcttttgatacatatgcagctagagtcaagagctccggggtactgcttagttcataatgttgttccacctaaagggttgcagatctctttagctccttggatactttctctagctcctccattgggggagctgtgctccatccaatagctgactgtgagcatccacttatgtgtttgctaggccctggcctagtatcacaagagacagctatatcagggtcctttcagcaaacacttgctagtgtatgcaatggtgtcagcgtttggaggctaattatgggagtagccattctaatatcaaataaaatcaacttccaacccaaagttatcaaaaaagacaaggaggtggcacttcatactaatcaaaggtaaaatcttccaagaggaactctcaattctgaatatctatgctctaaatgcaagggcagccacactcattaaagaaactttagtaaagatcaaagtacacattgcacctcacacaataatagtgggagacttcaacacatcactttcatcaatggacagatcatggaaacagaaactaaacagggccagattgaaactaacagaagttatgaaacaaatggatttaacagatatctgcagaaagttttatcctaaaacaaaaggatatacctacttctcagcacctcatggtaccgtctctaaaattgaccatataattggtcacaaaacaggcctcaacagatacaaaaatattgaaattgtcccatgcatcctatcagatcaccatggactaaggctgctcttcaataacaacataaattatagaaagccagcaataatgtggaaactgatcaatactctcctcaatgataactttgtcaagggaggtataaggaaagaaattaaagactttttagagtttaatgaaaatgaagccacaacatatacaaatttatgggaaacaatgatagcatttctaagaggaaaactcatagctctgagtgcctccaaaaagaaactagagagatcacacactagcagcttgacaacaaaactaaaagctctagaactaaaggaagcaaattcacccaagaggagtagatggcaggaaataatcaaactcaggggcaaaatcaacgaagtagaaacagtagaaacaagaagaactattcaaagaatcaaccaaatgaggagctttttctttgagaaaatcaacaagatagataaacccttagccagacacactagagggcacagggacagcatcctaattaacaaaatcagaaatgaaaaaggagacataacaacagatcctgaagaaatccaaaacaccatcagatccttctacaaaaggctgtattcaacaaaactggaaaacatggatgaaatgaaccaatttctagacagataccaggtaccaaagttaaatcatgatcagagtaatgacctaaacagtcctatatccactaacgaaatagaagcagtcatcaatagtctcccaaccaaaaaaagcccaggaccagatgggtttagtgcagagttctatcagaccttcaaagaagatctaattccagttcttctcaaactattccacaaaatagaaacagaaggtactctacccaatgcattctatgaagtcacaattactctgatatctaaaccacagaattacccaaaaaagatagaggacttcagaccaatttcccttatgaatatcgatgcaaaaatcctcaataaagttcttgctaaccgaatccaagaacacatcaaaacaatcatccatcctgtccaagtaggtttcattccagacatgcagggatggtttaatatatggaaatccatcaacgtaatccactgtatatacaaactcaaagacaaaaaccacattgtcatctcgttaagtgctgagaaagcatttgacaaaatccaacacccattcatgataaaagacatggaaagatcaggaattcaaggcccacccctaaacatgataaaagcaatctacagcaaaccagtagccagcatcaaggtaaatggtgagaatctggaagtaatcccactaaaatcagggactagacaaggctgccactttctccctacctatacaatatagtacttgaagttctagtcagaacaacttgacaacaaaaggacatcatggggatacagattggaaaggaagaagtcaaaatatcagtatttgcagatgatatgatagtatatataagtgacctcaaaaattctaccagagaactcctaaacctgataaacagcttcagtgcagcagctggatataaaattaactcaaacaagtcaatggcctttctctacacaaaggataaacaggctgagaaagaaattagggaaacaacacccttcacaatagtcacaaataatataaaataccttggtgtgactgtaactaaggaagtgaaagatctgtatgataagaccttcaagtctctgaagaaagaaatcaaagaacaactcagaagatggaaagatctcccacgttcatggattggcaggatcaatatagtaaattttgctaccttgccaaaagcaatctaaagattcaatgcaatccccatcaaaattccaactcaattcttcaaggaattagaaagggcaatttgcaaattcatctggaataacaaaaaaaaaaatctaggatagccaaaaaaaaaaaaaaacaaaaacaaaaacaaaacacacacacacaaacaaaaaacaaaaaacctcttctcaatgataaaagaacctctggtggaatcaccatgcctgacctaaagcattactaaagaacaattgtgataaaaactgcatggtactggcataacaacactcaagtagaccaatggaatagaactgaagacccaaaaatgaacccacacacctatggtcacttgatctttgacaagggagctaaaaccatacagtgggaaaaagacagcattttcaacaaatggtgctggcacaactggcggttatcatgtagaaggatgcgaattgatccattcctatctccttgtactaaagtcaaatctaagtggatcaaggaacttcacataaaaccagagacactgaaacttatagaggagaaagtggggaaaagcctcgaaggtatgggcataggggaaaaattcctgaatagaacagcaatggcttgtgctgtaagatcaagaatcgacaaatgggacctcataaaattgcaaagcttctgtaaggcaaaagacaataagacaaaaaggccaccaatagattgagaaaggatctttaccaatcctaaatcagatagggaataatatccaatatatataaagaactcaagaaagtggactccagtaaatcaaataaccccattaaatatagggcttagagctaaacaaagaattcttgcctgaggaatatcaaatggctgagaagcacctgaaaaaatgttcagcatccttaatcataagggaaatgcaaatcaaaacaaccttgagattccacctcacaccagtcagaatggctaagatcaaaaattcaggtgacagcagatgctggcaaggatgtggagaaagaggaacactcctccactgctggtggaattgcaagcttgtacaaccactctggaaatcagtctggcggttcctcagaaaactggacatagtactaccagagtttctagtgatacctctcctgggcatatatctagaaggtgttccaactggtaagaaggacacaggctccactatgttcatagcagccttattcataatagccagaagctggaaagaacccatatgtccctcaacagagaaattgatacagacaatgtacatttacacaatggagtactactcagctattaaaaagaatgaatctatgaaattcctacgcaaatggatggacctggaaggtatcatcctaagtgaggtaacccaatcacaaaagaacgtacatgatatgtactcactgataagtggatattagcccagaatcttagaatacccaagatacaagttggaaaacacatgaaactcaagaagaaggaagaccaaagtgtggtcactttgccccttcttagaactgggaacaaaacacccatggaaggagttacagagaaaaagtttggagctgagatgaaaggatggaccatctagagactgctgcacccagggatctatcccataatcagcctccaaatgcagacaccattgcttaggccagcaagattttgctgaaaggaccctgataatgctgtctcttgtgatggtatgctggtgcctggcaaaccagaagtggatgcttacagtcagctattggatggaacacaggtcccccaatggaggagctagagaaagtacccaaggatctaaagggaactgcaaccctataggtggaacatcaatatgaactaaccagtacccccctggagctcgtgtctctagttgtatatgtagcagaagatggcctagttggccatcactggaaagagaggccccttggtcttgcaaactttatatgccccagtacaggggaacaccagggccaaaaagtgggaatgggtgggtaggggagttgggggtgagggtatgggggacttttgggatagcattggaaatgtaaatgaaataaatacccaataaaaaataatgagagttgttttcttaaaattaattaatgcaaagaatccagactatcgaaaatgttgaagaggaggattcatgtgtggtatatagtagttgggagagggaaaagaatatgatgaaaatatactgcatgagccaggcatggtggcacatgcctttgatcccagcacttggaggcaggcagatttctgagttcgaggccaccctggtctacagagggagttctaggacagccagtgctatacagagaaaatctggcttgaaaaactaaacaagaagaaaactgtatgaaaaattaaataagtaaataatatgaatagcttaccaagtaagggtagatgatatagctagatttgtaagattgccacaaattcttctagggtgatgaaggtagagtagggtaggatagtttgtaaatctttaagcaaaatatatagtgaattcccttgtagtattaaagaccaaataaccagtggcatatgcctaacatatgaatgtgcaagtcattattttaagtctgcttgtgggaaaatggagtctgttataatgatggctcttctgttaaatacccacctgcttttcatataaatcacagtgaaagctacatgttaatgtggcttgtatgtttcaccataagtcattcatttcactttaaatctataatttggccctacttccttattccatttcagcagactgatctatgggccattcattgcctatatgtagcatatatatgctatacttcttatgcaaatgccatgcctttcattttgtttatgtagacatcttgtcaatgagatctatcctgacctaaccctatttaaaatctttctcccacctaagcctccgcagcacacactcagtcacacctaagtccattttccctgtacaaatgtattttaatatacaattaaaagcttactggatttaacactatattaaactatttaaagtgtaatttaataatttgtcatctttactgtttattatttttattggtaggaagttagcttcacaaaagcatggaattttgtctattttctatattggcatgtcacaaatgcttaaagttgttctttatatatactaggcactcagtatttgtctaaaatttaattttagacaggcttctctaatcacagtggtgggtaggaatgctattattccctacagctgacttctttagaatcccatcaaaagaaagtttaagtaatccttccaataatatttgtttttttgccaggtgacaaaggtgatacttgcttcaactgtattggaactggcatttcagggcctccaggccaacctggtttaccaggtctcccaggtcctccaggtaaaatatcctccatatagtcaatcttttaaaatactttggttcttttgagcatgctaattgttttatgatgttactttgccatttttagctagtcacttatgtctagaaatttttgagtatgaaatgcctctcttatgaaataaattgcacttgtgtatgtaactggaagttaccaacattctctatcacagtatttggcattattcaaagaattacattttctcaaaagtgaaatgacatttagagtcagaattttgttctagaaaactagggagaatattcatactttctggaccatgagtatggtttccagatgcagagtcataggaatatatttcatattgtcattaaggaacaaggtttctattaaacttctggcaaccaactgccaatattccttgtacatatatggcttccctcctaattttgaatcatttctcagaatcacaaccattctactccattagctctttacatatgctaatattgcatattcttgagtttatatataaaatgtgtgtccaggctgatgatagactccagactgattaccagtctagtacatgtatcaatgacacaaagtcataagaagttaggaaacaccttaagcaagcttcatagctgccactaggagctagtaacatagctgtaaataatgcagttagtgcaaagattcgcctgtataactgatgcttcagtaacttttttcctgtaatgtttggtactaaacatctctgaaaacaaatcttaaggaatgaccaaccaaagaaagagctaggaaagatataggaagattgtataactgagggtgggtagggaagtggggggaagggtatgggggacttttgggatagcattctaaatgtaattgaggaaaatacgtaataataaaaaatattaaaaataaagaaaataaagataagcaggctcctttcctgtcttctcccagtggcagtaggatggggataagaactcatgcccaacctcacagtttctagtggctgcaaactttgcaaattaatactctggagttagaaaagacctggggatgcagtgctttaagtgctgttatatattaatttataagaaactttggtttcttcctcttgagaacacaaaagaggaaagagtctgagttaaatgtggtagagctctctgtttaaaattgaagtttgtgatgtgctgatttctagatgcgtgtgattggggtgggggcgcttacggctcagtgctcacctgacctatgtgtgtcttaggatctcttggaatccctggagagaagggggacaaaggacaagctgggataactggtccgaaaggattgccagtaagctttgattattttattatgagccacaaagtactgaaagatgcatgtgtcctttgatttttcacttatgaacagatacatataaatttagtttaaattataatttattttattctttctctctctatgctttgctatccctttttattagatattttcttcttttacatttcaaatgctatcccgaaagtcccctataccctcccccacactgctcccctacccacccactcccacttcttggccctggcattcccctatactctggcatagagtctttgcaagaccaagagcctctcctcccatcgatgatcgactaggtcatcctatgctacatatacagctggagccatgagtcccaccatgtgttttctttgatggtttagtcccagggagctctggggttactggttagttcatattgttgttactcctatatcgctgcagaccccttcagctccttgggtacattctctagctccttcactggggaccctgtgttccatccaattgatgactgtgagcatccacttctgtatttgccaggcactagcatagcctcacaagagacagctatatcagggttatgtcagcaaaatcttgctggcatgtacaatagtgtctccgtttggtggctgattatgggttggatccctgggtggggtagtctctgggtggtccatcctttcatctcagctccaaactttgtctctgtaactccttccatgggtattttgttccccattctaaggagggatgaaatatccacactttggtcttcgttcttcttgagtttcatgtgttttgcaaattgtatcttgggtattctaagtttctgggctaatatccacttatcagtgagtgcatatcatgtgtgttcttttgtgattgggttacttctctaaggatgatatcctccagatccatccatttgcctaagaatttcataaattcattgtttttaatagctgagtagtattccattgtgtaaatgtaccacattttctgtattcattcctcagttgagggatgctttgctatccttaattcatatgctactttgtatggtaaatattattgtataggttaatggagcaaactggaggggaaaatgttagaaaatattctaacttactttttttttcttctcccacttttttcttcaaactcagggcatacctggacctccaggtgctccaggctttccagggtctaagggtgaccctggggatgtcctcactcttccaggaatgaaaggtgacaaaggagagttgggtttccctggagctccagggcttcctggtctacctggtagtcctggaaaggatggtttgccaggactccctggccccaaaggagagcctgtgagttggattaatatacttgcttttatgtcaaattgtcatttagtaatgtttcatacaggatgaagttctatgtcaatggtaaaacttgtactgggtttgtgtgaagtacctaaattcaattttcagtactctctaaccctcctaaagcaattggtaagttaaaataaaataggagcctattacatagatgaatactaatgcctaaaataatacgattttacagtgaaatggtacattgatactagagtttccttactgttttccttcagttctataaactccttattaactcagtatagtattgattattactaactatgattagatggagaggaagttaaaatgcttaggagtcagagagggattcattattctaaacatctgtgggaattttttaagcatgaaaaaacccaatttgttatatatatgtgtgtgtgtgtgtgtgtgtgtgtgtgtgtgtgtgcgtacagccagattaagatactacagagccaaacactgagcgtaaatgaacagtctctttttatattcaacatccagtagaggatatttgaatgagaaatatattttaatagtataaatagacaataaccatctcatggtacggtgtgagatttttgagagcagagactttgatttactcatcttctcagcttataccactcactggaagatagcgttctgagatatttgttgaaggaggtaattagtgagtaagtaatcatagattcgataaaagaacgtaacccagttttagcataactttaaaaggcatacttatggctgagtcatgcccctgattgtatccatttagactaatctacatgacgttgttacaccaatgctttctgtcttaaacatttccattttcagggtggaattacttttaagggtgaaagaggtcctcctgggagcccaggtttaccaggtctcccaggaaatatgggacctacaggcccagttggttttgggcctccaggccccataggcgaaaaaggcatacaaggtgtggcaggaaatccaggccagccgggattaccaggtatgtttacctttgttgtcttttctattttaaaagtagacagacacatagacagatagacagacagatagatataaaaagtttaaaaaattcctgggaaatgtgtttctctagccatctatatgcttataggaagggaatagattgtttttgtttaaagtgagatttcttgttaacttagtctaagtttgtagtgttttttgtatttcgttcttgaatatatgttagtgtagttgtatccatgtaactgggaaggatatgcacataactattttattaatatttttgaaatgatattataattataaatttttctgccttacctttatccctctaactcctcccatctcacatgtaaccccttgctctctttccaagttaaatccctttacttcaaatattcttttacatatgtgtgtgttcctacatgtacattcctaaacacagcacacacacacatacacactcctaaatacataaaaacaacctgcttggtctgtatagcattacctttatgtatatgttttgagtgtcaaaaacatgcaccataattttggagacagggtccctcactgaacccggagttcattgatattgctaggctggctagccagtactatccaagataccctcaggatatgggttatgtggtgctatagctacagttttattcatattcagcaggcactttgctgatggagctaccatcccatcccaatttatgttctgatgctcaagggaaggagaagataggtgttccagatgaatgaggagatgtgggggggggaagagggagagatttttttcctatgttttttgttgttgttgtactatccacatcctcttctgttggatgataatggtccatattgtgcaaaggcagaccctccttccttaaagcactgatttaaattcctatgtcttctggaatcatgggccataggcataaagcagagataattattttatcagctatctaaatatcctttaatctagtcaccctgacatctaaagttagttatcaaacatcctcaatcatggaagtacctaaaattcattctttctttctttctttctttctttctttctttctttctttctttctttctttctttctttctttccttcttccttccttccttccttccttccttcctttctttctttctttctttctttctttctttccttcttccttccttccttccttccttcctttcttccttcctctctctctctcttttcctttctttctttctttttttttgaaattttatctttctctttgctatcttcctagaatatgcaaaatgggattgtaattattagtcaagtaaatgattctcacttggagtgttccatttgttttcaggtcctaaaggagatccaggccagaccataacccagccaggaaagcctggtttgccaggtagtccaggcagagatggtgaagtgggtcttccaggtatgcaaagaatttattttatttcaaaacaacttcatcactgaaattctttcttttggatgttccccattcttacagtgctttttttttttgtaggtgatcctggacttccaggccaaccaggcctgccaggaatacctggtagcaaaggagaaccaggtatccctgggattgggcctcctggaccacctggtcctaaaggtatgtaggatgaggtatggggcagtgtagattacctgattagtaagatactattctttcataatatagaacaaagtagatttaacttattttggtatatgccatttaaaatctgtaaatgaaaaagtcacattgggcctgcagagatggctcagtgactaagagcactgcctgctcttccagaagacaagagtttacttagcatctccatggcagctcctaaccactcttaactctctaagtataatggactcaatgctgtactctgttttgtttttttttaaggacactaggcacatacctggttcatgtacatacatgcagacaaaacacatttgcacataaaattgaaatgataaaaataaacattaaagaagaaaagtcattatatgcaccttaattttggagacaggatctctcactgaacctggagttcattttctaaaacagtctagtgatgaaactatctacatttgagggatgcaaaatgattcatatgctaaagaacatcatgggaattatgacatttgtgttcatcattgtattcttagagccttgaagagttcctggaagtgtaacaagaagtacatagatatgtattgaattaatagattctattaatcagaacagattcactatacacatatgcaatattttatcccaaataaaatacacccttgatttattgatatttttagtttttttctacagttgtgctttactcctcccagaatgtattcttatgaataacagggcagcacctttgggtgatgacagttccttaggtctcccttatttttttttaataaatgacagatttgatttcatgtgtgaatgcttatataacacatacagttgcatctagctcatctgtagaagtacatgttcggcattctgtcacattatgtcacaatgtaagcagaagggcaggtctgtatttatgtatggcattgattcactatatttaattctgatgtgttatatacttcaaaagagcatagtttcttctacagccatctaattaccccgtagaactgaaaggataagctgattgagagactctcagatgaatattagacttaattctaagtggtcatatacaatgttcctggacttttaacgtgtcagtgtataaagcatgtgtttagggagatgagaatgtgactacctatcttcaaatttattctttctatgggttaaaacaatggcttgctattttacaggttttccaggaattccgggacctccaggagctcctggggcccctggaagaatgggtccagatgggcctcctgggccaccaggcttcccaggaccaaaggtctgaaacaatttcttaaaggatatatttatttttattttttatgtgtatcagtgatttgtctgcatgtgtatatatgtgtagcacatgggtgcctggtgtggtgacggtggaggccaggagtggggctcagatgccctagagctgaagtcgcagacagttgttaactaccatgtgggtgctgggaatcgaacctgggttctctacaagagcactcaacttctgagccatctccagccccagtctagaacattttaaactagccctttttcacaaagacagtcttctctactgtccttcgatccagttcctattcgtcttagacattgtcccaagtctttattatattgataatacttagctatattttcatttaaaaataaccaatcccaaaccatctttaatagaacttaacacccagatccaaagtctctgacattgttttagactgctaggtttttggattacgtgaaagaatccaatgatcagcttggcctatgtttatgtagacaaacagtaacccatttcatacttttacatgtgtgatgattggtaagattgtgttggatatatcaagcccttcctgtattgtttcctctgttccaattccattaaatatacataaaccaaatcactgctatttggtaatactaataaataactccctttatatttttccactgtaacttatttaaccttaaacacttttcagtcagccttcagcaaactgctaaagcatgtaattatacctactcttcctgaattccgtgcttaaatgatctaatctcagtggatttcatccttattacttgttttcctcatggaaaaacagctgacagactctcataaaaaaaaaatgcatctcttttggcttgtttttatttcatgatgaacattttcaaataaacacaaaagcccaagaaatgatctaatgaactttgacagatgtgtcagtcaggtacaaaactgctaagattatagtaacacttccttgatcttttcctgtttttcaggaagggggtggtctcacttaacccaaatctcaagattacatcatttcacttacaaatgctttgccattcatatgtaactaaatgaaaattgtatgcagaaaccacaatgacattatactacttaagtcatgttaaaactaattctttgcattatctgatcctcagtcctcttcacattccctcacttgtgtagagtgtggtttaatcccttgttttcagttaacttttgtactttgaaaacaatccaactcatttaatttgctctcactaaaccctatttctgtcccttccagatattctctctaacacacccatcattttttaaatttgactatcctcttcttaatatggaagaaaaaatattactttgtattcgatgctttaaattctctgtagtaaatggtaagcgtcaggaaagtcacgggacttttccttgtgttttgtcatgtgtatgcttaagggagagccaggatttgggttacctgggccacctgggccaccaggattcccaggtttcaaaggaacacctggtccaaaaggtgatcgtggtttcccaggaccttcaggtcctccaggacgcactggcttggatgggctacctggaccaaaaggtatggaggctcttgctacttctcaatttgttttaaactttcattgatgttgaaacctttggaaaaggttatgggtaataagcaagctcactggaaagcccatgatgcctgtctgccactgttttaattttgtttatattccactagtttgtttgtttttttcatttgtcaaaacagaggatataattgcctcttgtcttttgatttacttgctttgtgtacttttttaatttaataattactccatgtaatttaaatttgaaagaattcactgacttagtattgaattacatgtgtatactatcagttactacttgtaggaatggatttttgccaaccttttcttaacaccaataataccacacatgttatttagatgtgtgcaggtacaatagcagattagagtagcaaaacttaatattctcagtaaaaggtaagaacgtctatgggtagtatgaaatgtctctctgtctgagctattttatactcctaccaacaatgaatgaagcacttgtttcatccaaccccttcccaactgtagttaaaacaaaaacaaaaacaaaaacaaaacaaaacaaaaagacaaacaaaaaaattcctgactttttctagcctggtagaagtcactttatcagtatactttaaaaacatttccaagctaggtgtggtggcacatgcctttaatcccagcactccggaggcagaggcaggcagatttctgagttcgaggccagcctggtctacaacgtgagttccaggacagccagggctatacagagaaaccctgtctcgaaaaaccaaaaaaaaaaaaaaaaacaaaaaacaaaaaaaactaaaaacaacaacaacaaaatttccattgcaaagttttcaaatgcacagaaagattacaaagaattatacattgaatggctatctgcctgctgcttagaccctatatatgatattttgtctcattcaaaaggatttttaaataaaatactgtagatgcaatagctagagatggagctctccaattgaaaacttgcctagtatatgaaaggacctggattcattcctcaatgccagaaatggaaatgttatatgtaatataaggtagaaaaggcaataccatgactgctatatgcacccatcactgatgttctatggtgaatgttttttttttcattttttattaggtatttagctcatttacatttccaatgctataccaaaagtcccccatacccacccacccccactcccctacccacccactccccctttttggccctggcgttcccctgtactggggcatataaagtttgcaagtccaatgggcctctctttcaagtgatggcctactaggccatcttatggtgaatgttttatgcatactttctcatttatctgtccatttatatatctctttatataatcatcaatttccttttgatgaatatcaaaaaagttgcaaaagtggtaatcttttccctaatactcttacaatcccaaagctgcctatgtgttttatttctatataaaatccacagatgtattgacaaacaaaatctaatatgatatattatgatatattccagggcttgggatgcagctcattggaaatgcattttcttgccatgctcaaagtcctggtacacacacacacacacacacacacacacacacacacacacacacgtccttattccagtttccaattagtgtgcaataaccataccaatatcattatgaagcttttgtctgtcctttaatccttgtatgtggaatcatgcaatatgcatgtttttagaaaaatatcctcattagtacttatttctagtaaattcttgaagatgccattgttaggatccctgggctgtgtcaagttgctgagtattatgagagaagctgttagaagagatctctgagtcttttgatggatatatgctttgagtatgcttgtacatatagctaagactagaattgtgctcataagtgtgttcacttgtttagacctttctccaacatatattgacactttaaaattcacactgatataacatttttagttattcatgattctccccaatattaacattttacttgctttgtggttgtgtcataattacaaatttaatttaatttctctgatgacataggatggccagatttttatccgctcttgtggattatttagacattcaaatatttgccagtttaaattgatggattgtgttgtgtcttaagttgaaggtgttcctagtacaccctgaatacttgtgtttttttagagcaaactcaggagtattttattcctgtgttggttacctatttgtatttctagagtatttcgatatagagttttgattttattgttttatttatgttacccattatcataattttgtgtcttctctaagaaataattacctgctaggcactatcaagacattctgacccatagtgtcattaatctctaatactttgtatttatatcatttattaaaaataaaagtcgaacagtagattatttggacatttctatcacatcaaatactatgtatagatgggctattttctgttcactcatttgattcactatcctttaactagtatcacattgtttacatggatatatatacatatgtatatatatatgacccaaaaaatacttttcttgttaaaaattttaaactatattatgtactttgcctttcttctcaacatagttcaaatgtatgtgtccctactctgagtgaattaactatgtatcattttagagccttattttccctgcttacagttgatatcccaatttctctactactttaaccttcttaaacttgatatctttttttttgttgttgttcttttttgggttttggtttttggtttttttcaagacagggtttctctgtatagccctgactgtcctggaactcactttgtagaccaggctggcctcaaactcagaaattcacctgcctctgcctcccaagtgctgggattaaaggcatacaccaccactacccagtgatgtctttaaatatataaaggaataggcttaaaataactagcttggctgatttgatttcactgtttaatttgcaaagaatagaattctcaggataaatattttggagaattgtctaaattaaatttatattcacaaatcgtattgagttgattttcattaaatatatatatatatataattataaggaaactataaactattattaataacatgacattttaaaattgtttttaaaaattcctacatattagtgagaaggctgggtgttgtcaattatccccatttataaatatgaatcatttcaatgagaatttaagtaataattcagaagcatttcatgtaactgatttaaaaccttagtatttaccaaatacacattaatgcaggttaaaatgccactgatattataagactggaaacctgtacaggaataagtttatagaatttcagcaattcttttttttaatattttttattacgtattttcctcaattacatttctaatgctatcccaaagtcccccataccctcccccccacttccctacccactcactcccactttttggccctggcgttcccctgtactggggcatataaagtttgcgtgtccaatgggcctctctttccagtgatggctgactaggccatcttttgatacatatgcagttagagtcaagagctccggggtactggttagttcataatgttgttccacctatagggttgcagatccctttagctccttgggtactttctctagctcctccattgggagtcctgtgatccatccaatagctgactgtgagcaaaatttcagatagaaaattgtgatgctataatgtccatcattaggtggtttttacttccaatcctcatctaattagtacatacagttgacattatgttgatgggtacaaaaataattctaggagacatctctgggaatttgtataaaacattctaaaaagcagtaatataatctctacacagcttcttccctggaagaatactgttgattgttcacttcccaatggttatgagggtagaattcctctaatatcaaaaccaggcagaaaaacaaacaaatagacaaaaaatacaatgaaaaatatctaagttataggccaaaatctctgaagaacaaataggtaagaatttttccaaacattagcacatcaaatgttacaatatataaaaagaaactctagcatgactttaatgaccatcaaggtcttcagaatacaagctgctttgacatctgagaagtattcagcataatttgctatttcaacagtccaaacaattacatctatgcacctgaaatactgttcaaattatttgatataattcaacatccatttctgaaaaaaatacttttagaaaattatgaattaaagaaaacctgttagccagcctatagactcatcatatggtgggttgaggcagatggatttcaggctactcagaagggcagtgaaaagccctgtttcagaaaagcaaaaaagccttgtcatcaatattgaaattccaaagctcctttttataatctactcttttattgtaagtcttatatcatttattaaaagcttaatcaagtatggttgatggtgaaatactgaatactttcctccaaaaaataggctacaacaaagagttgtttgccagaaaatttatcattatactagaaatatttagccattgttgtaagttaagacaaataaattaaaagcatagagattgaaaaggaagaaattatctattcatacatgatttgactttgcatttagaaaatcatcttacataaaacctttggaacagaaagttaattttacaatataagtattagggccactatacaaaacaaagtgaaggtttaccaattagaattagataaaaaataatatttaaaatagtaccaagtatcataatgttctgacatatgtatagttctaacaataagtgtagtatttatattttaaagaagtacaaaatataaatgtcataagccaaatataactaaataaagtgatatattatgccaatgtactggcaggcccaatttccttaagacagcagttctgtccaaatagactaattgtacccttaaggaaaacacagcagaaatttgtaattggtcaaacacttatgtggaaaagtgaataccttatagtagccaaattaaatgaagaaagtcctatgttagagagttcaaagtatttgatttgaagacttaaaacaatcttaaagtgactgatatatcttgtaatatatgacatactgacacatgggtctaaaaatagaattgtctttgattttttgtgtgtgcagagctggagataaaatccaagcactcttgtattctaagcatatgctgaggtaaattctatcttcacaaaaatgtttctcataaattgaaagtacaatagaaaaagaaacttctaacaaatagtacaaaaactattattgtataggtgaccatgaaacaagcaaacaaaacaagtgaacctccaaattttccaaattttaactccaaacagattgtagacccacacataaagcttcaaaccctcacgcttctagaatgcaagcactgcaagtttttctggtaaaagtcaaagggaatcttttagatttagcagaggacattttttgttttacaagttctccttttggatatgtcatctgcttctctcatcaatgcaacaaaataactgacaaaagaaacttagagaagaatttctttcccttcagagttctagggcacagagcatcaagaaggagatggcttgagagcaagagcttaaggcagctcttcctatcacatccatagttaggaagcaaagaaagatgaacatttgtacttggttcattttctcctagtcacaagcagggaccagagcccactgaatagtgtcagccacttttagggtggatcatctcaccacagtctaatctaaataattccctacaggcctgtttagaggcttggctctaaatcctgttaggttgataatcaatattaagtaccatgtgattcaaaaataaaactaattctcagctcatagatagtgtaaacactggtgtatagtcaaattcagtttttttttaagtgaaagcatagaacaaaaatctttatgatcatatcctagacaaagaattgtttgctaggacacaaaagctcataaaaatggaaaactgctaatttggacttcactaaaataaaatattttcattttatgtgtctaacaaattatttgtaagcataatatatacaaatcctcaaaactcaacagtcagaaaccatttaccaaagttaaaagtagagttgaaaaatgttggcaacaatttaaatatatttatattttgccccacaaatcattcaaatgtcaagcaaatgcatgtaagattccatacagtcttctgcaaaatataggtttaagcaacaatgaaatagatagatagatagatagatagataatagatagatagatacatacatacatacatacatacatgcatgcatacatagatacatagataaactataagaattagctttcttctcaagaagaaaaattgccaagtatgtagactaatagagaactctacacagctagttagaatcccaaacagtgcagtcacttcaatctccagcacaggaccaaagagcttctgtccactttgaaaatgttgtgccagtgtattagaaagtaaaacagtcttgctctctgaaacagcaaactcacttctaggtatttattaaagaaaactctgaagctttgcataaaaatctgtaagtctatgttcataggagctttattcataatcaacaagaattgtaaaaagcccaaatgtccatcaaacaacaaggactaacacagtgtagagtatttatacaatgaaatattcaatatgtgctgttgggaatcaagtccaggacttcatgcatgctaaacatacgttctcactgctgacataaatcgtagcccaacatgtatctttcaaaaatttacacagtcaatttcagtaggaaaataaatcttttcaacaaacagtgctaaatatgattggatatatgtatacacaaccacacataaatgaatctcaaatgtatcacatttagtggggaaaaagacatactcaagaagctacatactgcatggttacatttgtgacattctggaaatagaaaacctataagaaataaagtagcagagtagtcacaagattattggcatatggagaaggagcaacaactgatcgctggtccttttgaggattggtgaaatgattttaaatctggatttaatggcagttttacaaccgtacagatttctcaaaatgcatccaagtgtgtgatgaaagaacaggtttcaaaaaatacaatgtttgtattagttttttagaaattcatacatactctgtagttttctgactcttgcctataatgccctcaagatctatccttcacctctctgcgcctcccaattttacatcatcttaaaaagtaacccactaggtccaatgtgtatatctcacactcatgtctattagaacaggaacaacataccacaggccacacccttaaagaaaactgactttaccttccctagaagccatcaactaccaatacctcctctactagaaatggaggtacatgagacacacacacacacacacacacacaccacacacacacacacacacacacacacacacacacacatacacatacacacacacacacacacacacacacatacacatacacacacacacacacacacacacacacacacacacaccccttaagcaggacaattgattgatttgatcgtgtgcaggcaactacagctactattgagtatctaagtgcagttgtcgggtcatatctagaagacaccgattttctctggattttcctaacttctggctcttacattcactcccactcctgttcctcaatgatccctaagcaaatcttaatagatgtgataagtttgaaaagtgtgagtgataggaaattcagagagtaaagtatcaactgtcaaaatattgtaggcaagagcatattttcagctagaacctcaagttaataaaaagaaagatgttgctgtctatctgcttaaagctgaagtgattaaaaaatatttttataaccaaagagttatccagtatgaagtagactacaatcttgttgctgttttgagaagttaagacaagcactgacattgacttctggccttgtgttaaataagacttcaactatgaatgggatttcagctttgggtacttgtccttttcttcctggataaactagtcttattgcatccttttctaccttgtttggttgatgccccagggaggcctgctcttttctgaaggcaaagagaagagcagtgggtctgggtgaaagggaaggtactggaggagtggagggaggcaaaaactgctgtttgggatatattgtatgagagaagaataacagaaaaggaaaaaatatggttatatttaacatgtaaactgtgcttttttaaaaaggtgatgttggaccaaatggacaacctggcccagtagggcctccagggctgccaggaattggtcttcagggaccaccaggaccaccagggactccagggccaataggccaacctggtaagattacagtaaatgtgcctgctataagacttgcagtgtatatgattgtcttccagtaatgtgattaaagtggtaatccgtgtgtgtatatatatattttttatccaattgtaaactatagatcacatcataagagctaatttattacttgatgtttcccccttctgttcacctaaaaatccatttagtctagtaatgaaatttgataattgtacttaccattaccatataatcattgaacatacagagttttaaaaacagaactcaaactatttgtgcttattatttcagaccaaagaataaagtggatctctctttttttttctcctgtactgggaataactgtaattgagcatgcgctaagctgctctttcttcagttagatacttgaaacggtcttgtaacatgtagctcatggttttgcctccatggataaagaatcacatggctgttgtatatctgtatgagagtctgtagtaagtgtggattctgagtgaattcacattatctatttactccggtacagtaagggacattctcagccctgaatttcgttattttgaatattgtaatagttcataaaatgaaaacaaacatggaacattattttttaattcgtatgaacataacagaaagttgaacacaattcagatgcacatatattgaacacatgtattttctgaccttaaatgacaccagatatgttgttggtaattgccttaagagtttctaaactatggttaacaatataaaacacccataaaggctatttttatttgttcaccattttaaaactcaatttgaaggcacgttgtacttttttaaagccccctggcaagcattacataagaaaaacataagcaaacttgcagtcatgtttcgaacaaggttgctatagttgcctcatcattcatgaaaaaaagagcaaacaaaacaaaaacaaaaacaagctttttccaccatcttggctcctgtggaggcctgctgggaacaggacttctaacagcaagtatgtctagaaggctgtggtgcaaggccatttttgttggttccaagcaaggtctctggaactaaagagagcacacggctcttaagattgcaggcgtttatgcccaagatgaaacagagttctacttaggcaagacatgtgcttgtgtgtatgactcaaaaaacaaaacaaaacaaacaacaacaacaaaaaccaatacagcgactcctggaggcaaaccaaacaaacccagagtgatctggaaaaaagtacctgggctcacagaaacagtagaatggttcttgccaaattccaaagcaaccttcctgcagaggccattgtctacattgtggacattgtctacaaagtaaggagaaggcatcaaaaaagcccaagccaccctcattggtccacttaaatcttcagcaacaggcgctggagagtatcggaatccatctctatatgtgtttggttgatcttttttcattaagaaatctacacagaatcagtttgatgctgtatccatcccggatttaaacttatggagagtaaataagtaaaaatagattggtgctcttgtaaaaaaaaaacaaaaacaaaaacaaaaacaaaaaccactctgcccaacctgcatagaagtggaatcttgaagaaaaatgtatttttagttttgattattactgacttaaactgttatttcacaaacaacagtgtaatgattttatcacttcttttgcattttgttgtttcttttagtttgcaaaagtacatgacgctgtcgaagcattttgaattcttacatgagagctgcatggaaatttaaaacactgttaacaagcatctgaattaaaatataaaattgtaatatttatttaaaactatagctaataccttgcaattttttgtcaagacatctactattctatttctctactgcttttttccaactcccagtagcataaacactgcacaatatcaggacagtgctagttaataacttttaattcaccttcatgtatttgcttgtaaatattttctttgccatagacttttatatcaattgtattcagcagttaacaaaaaatataaaaattattcaatggactctcaatatatacattcattttaatataaatgttattatcatcaccaaaggaaaatattaatttaacactttttaactatattgactcttacatagaaggtcgatcagcaagaacactattatagtatcttgctagacctgcattataatgcatgacagaaacttccagtttacataatatacttgttttctgttgcatcaaaaatgcaataccaaataataacattaaatataaaacttaatttaaaataaaacttaaaatgagataatacaacagaaaacttaatacaaaatagtaagaactgattgtataattattaaaacgacatgttaagacaaagcctaaatcaaaccaaaacaaattgacttatttgataatcattcagaagggtcaacattatatgcacaaataattggtaatgtaatggaacagtgaaaatccacctgtggtcagcgggccaatgaatggcaaagcataagatgttaacaatggcaaagcataagatgttaacaatctacgatgagaaaaacattgagagtgtgcattcaaaaattttacaaatttgacaatttaaagctatgctcctatttattgaataatataaccagaaaactgagctttttttttttttcaaggtttggttaaggatatttgtacttaattaaaaagttagtcaaaaattaactggaattttttaaaaattgtgttttaaccaaaacaatttgagcaaaacctctcttccagaaatatgacttaaaatgttaaagtttggttttcattaatcattttcacatgcacgatggctaaagtttctgtaatgcactctcctaagtatatcatctgcagatcacgtcacttctttgatagaaaaataaccagatgtgtaatgtggagactgcatcaatacttacaatgttaatatgttgttaactaggcttacatgggattccaggagagaagggggacccaggacctcctgggtttgatgttccaggactccctggagagagaggtagtccagggctccctggagcccctggtcttataggacctccaggatcacctggtgtccctggaaaagcaggtgtccctggatttccaggtaatgtttaataatctgtctgactgtgaatcaatgaaactaatatttatatgactgacaaaacattttcatactaaattttatgactttacactatctattaaggaagactgttaaatgtatgagtattgaaaactccgttggtgtttgtgctatactttttttatactgtgtgatagtaccagtaatatattactatataataaaggatccaaagtatgatggttgaaagtaacttttcaaacattttgcttaagattctgtgggtcagaaatcaaagggtgcctttaacagattattttctataattcatatgactccaataagaatgattagagttgcagaatctaactctatggtgactcttttctgacacttgggtattctttagctcatgtgacatctaatcattcataatgccccattctcatctttttttcatccttccattgcaagtggcttcccaaagtaagaatttcctgagacaaaaatgaggtcctgaagagatattttagtggttacaagaactggctgctctttcagagaactggggttggattcccagtgctgacaaggcagctcccaactccctgtaattccaggtccagggatcaagtgccctcttctagtctctggggggtactacaagcacgtgaggcacagcacagacatattcagccaaaatacccatacacataaaatgaaaataaaaacgtgcttttggagggagggagggagggagggagggagagagggacagaaggaaagtggcgagatggaaggagggaggaaggaaaggaaggagtcatggagggaggtagggagagaggtaagggggagagggatagggggaggggagggggagggggagagggagaaagttagtttcagggcaccctggttggtgaattcttaatatgtagtgctatcttctgtggagaacagttaccacagtgagtatctgtgcgttttgttcaggcgtgagtgctaagcttccagtaagaaaggggaaaatctcactgtgccttcctttcattcctaaatagctttccaaaggatatctttaaaagtctatcttatctttccaaagtccaaacccaggaaatttagtaactgatattttccaaaggtgtcaaaggcgaaatgggtatgatgggacctccaggcccacctggacctttgggaattcctggcaggagtggtgctcctggtcttaaaggtaagaactgcagtttactgacagatatgtctaacaaagaaaattaaaccctgggttctgtcaatacagtttctggtttttctattttaaaattgacagtgcttagtattttgtttctttgggatgtgttaattgaaagtgtcttcttttatattttttatgaaactgttaaagaataaaatgtattaataaatttaaaagataaaatatttaagaatatattatcattattattttagacattaataataataaaatgcctacagtttgttgactttacttttgaaaaaaatcacataaacattctttttaaaaattattttatttatttacatttcactttttgtcccccttccagtcctccctctcatggttcctcatcccattcctcctccccctttcccccaagagagtgctcccctcaccaggcatcatccttctctggggtctcaagtctttggtggattaagtgcattttctctcactgcagccagaacaggccagtgtatgctcctggttggtggttcagactctaccagctccctgagatctgtgttagttgagactgctggtcttcctgtggggttgcacttcccttcagcttcttcagtccttccccaaattcaaccacaggggtcctggacttcagtccaatggttgggtgtcagtatctgcttctgtctcagtcagctactggtagggcctctcagggaacagccatgctagacttttatcttcagtctcttctccattttgaacctgcagttctttttagacagcaacagttctgagtcaggaatattgactgtgagttagtaacccaattcccccacatgaggcccatgttcatagcagccttatttgtgatagccagaagctggtaatgtcttcttttcagtttgatgatatacttaatttgtatacctgaaacattgtaaatgcttaggccataatttcagaattgaacttcaggttttccttattgtgagtctgtaaacacattccagaaaggagataaattattacctgtgtttattaacatatatgcactcaagtaatttattgacagacattaggttagatacatgttttgaggcttagtttacctaagttatgagacatgtgataattttacatgcattgattatggatgaagaaatttggtgtgctttgttgactttaggtgatgatggcatgcaaggtcagccaggtctccctggccctgcaggagaaaagggcggtaagggagagcctggccttccaggtcctcctggaccaatgcatccagatttcctgggatcgaaaggagaaaagggtgagcccggcttaccaggtaagtgggtggatatattcacaaatatttttgcatatcttaggtttaatattttttaggttattttgttagttgtcctacaggcgaacaaatcatatggatactagcaaatgctctttcacacacagttcctgaagtttgattttacacatattatttattcatgtatatatgtatttatgtatggtgtgtgtgtgtgtgtgtgtgtgtgtgtgtgtgtgtgtacatgtagaagtcaaagaacaactttcagaagttagttttctccatccacattgtgaattccaggggttgaattcattggactttttataaagcacctttacctactgggccatcttcccttgctcctgacattttatttttaagtaccagagaagtaacttggagttactatgtttaacaagtcaattacatatgtgacattttggtagtgaatattttcatttcatttgtgttgtttcattgattacctttctgcttgaatattttctttgtcatatacctgtcatgagctatggggtttttaaagcagatttggggagctagggagttggctaagtgaattgcttgctatgcaagcatgaaactggagattggatccaccaaacccatataaaggcagcacaggcacctacctataatcagaacacttttgaggcagacatgggtgagcaaactctgggagatttttgagttcagtgagagacttgtcctcaaaaaacaaaaggctgagcaatctatgaagacatccaagttcaactttgggcctctgtgtgacctaagaaagacacatgggccaacaaacctatgagcatgtatatatacacatacatagatgcatatctaagtacatacattcataaataatatagacttaaataactaccttcaggcttccagaagtaccacagaagcatagaaagagaaaattatatatagccacaataatttgaggacagcaaatttggtatttaggaattgtggtggttctttttaattttattcacctagaaaccaaatgatgatgaatagtattatgctctatacaacaagttttaaattataaaaatattggtttcttatcctagaaatataatgtggtttatcaaaaaccacacacacacacacacacacacacacacacataaacacacacatatatatatggcacctatagaaaagaaacatactttttgaaaaagcacttgcaactttttgtgttctattattgctgtcagttgtaaatgtgtgtgtgtgtgcacatctctaaataaatgttatgggtttctcattgggcatgatttaatgaaatttttccttaaaattactttgtatgttaaagtttttctaaaagtaccaaaagaggtaaaatttaggataacaaaaatgaaatgtctttcttagttatctcttcttttaaaaaccagatctgattgactgattgattgatttggtgattaattgattgatacatatatatatatatatatatgctacagtacccatttgaattgcagaggacaaattatacttctcctactccactatgtgggctacaaagtttggactcagggcttcaggtttggtggcatgttcccttatcaagtgagcagttttatcagctcctggggttattgttattatctttcatcttttaaccaggctttgcaaattataggacagtaaaatatacttgacttgtactgtagagttaataatgataaaagacattgagacaggaacaaagagaaagttgactttatttggctgatctgaatttcttggtgggaaacagtaaacaaatgaagaaactaatagtttatactacatcaaattatcaccaatttggccagtgttattgttgatacaggtgagtagggccaggcattgaatattattttgttgctcttgtttgaagtgctgggggtcaaatctgatgattggatagttcttaccccatcattctccaggccatcttaagaattcatgatccatatctctatcaagtgagaggcaaacctccttagaagtgggaacaaaacacctttggaaggagttacagagacaaagtttggagctgagacgaaaggatggaccttgtagagactgccatatccagggatccaccccataatcagcatccaaacgctgacaccatcgcatacactagcaagattttatcgaaaggacccagatgtagctgtctcttgtgagactatgccggggcctagcaaacacagaagtggatgctcacagtcagctaatggatggatcacagggctcccaatggaggagctagagaaagtacccaaggagctaaagggatctgcaaccctataggtggaacaacattatgaactaaccagtaccccggagctcttgactctaactgcatatgtatcaaaagatggcctagtcagccatcactggaaagagaggcccattggacacgcaaactttatatgccccagtacaggggaacgccagggccaaaaagggggagtgggtgggtaggggagtgggggtgggtgggtatgggggacttttggtatagcattggaaatgtaaatgagctaaatacctaataaaaaatggaaaaaaaaagtgagaggcaaagatgctgcaactaccactgccaattctaagaaagtttactaaattatccccagaacgtggcagacaacctggggagcatccttgccctcccaagtgctatgtcagggatcatttttatccataacattttatcatccctagacatcatcttgaagttgatgttcataggatctttttggtagtcatttcattttcatttgtcctgggaacttcatcttcttgatttgggaaatcaattggactgtcagaaaaagaccttgtcacagaacatagaattagggaaatagttaaagtgcagcagccttccaacacacacatacacatatggacacacatacatgcactcatacatacacacataaacacacactcacacatgcaccaagagagacagagacagagagatagacacacagagaggacagcagtttctccattttacttatatgcagttcaacagttaagcagctttctggcaaaatcatgtaatttattagtaagaatcagcctaacttgatttttatgcttgtctttggaaggtattcctggactttcaggaccaaaaggctaccagggattacctggagacccagggcaacctggactgagtggacaaccaggatcaccaggactcccaggtatgtaaaatacatcactgtggtacttagatgattgacaaagatcctgaggaagtatttatgtcattttacagtttagtgatgatttagatctgttcatgctaagtgcagctaggcttgacaaaattgttggcatgtgctccaagttttaacagataagatatataggatgttttattttgcttattcagattcatattttgctcacaacataatatatttagaactctgattcatgtaaggtgctatattttattacaaactctccaacatagaaagaaatacaattatcaggtagaagcctgaataattcacctgttccagttgttttgattctttgttaatatcagacaagtccataattctgcgatgtaaaacagattattgctattttaatttttaaaaattttaaggatgaacatttcacagccctccttgtagtctgttacagcccaaattctcttacaatgaacagggtttttttttaaatcctcatttttatcttaattctcataaaactttcagctgttttattttagttcatccccaaggaagtaaaaagccctgaaggccaactatgtgccatcttattcacataccacatcttgaaggagtcagaaagatggactcgctcctgatttcttcccaacatcttttgcattctccatctaaagctggaagtcactgtgaaagaaaaagaaaaacacatttatggtagcagtggtaaatgattaagtgacatcacacagctcaactcaagcacctgtgatgttaaaagtagaatcctcaaacacatccaggtcaatctagcatcttttcatcaacccaggagataggtctctctctctctctctctctctctctctctctctctctctctctctctctctctctctctctcctatcatagtgaggctctgtcatgacacaaacctactgctgaagttttattaaacattcttatattggatttatcagtgagaacagaaagtgggtagttatgtgcaacaaacagaacaccaaatgcatggaattagtttatgagaagaaccaagatgctcaataaaattgcctttatttttatgaggttgaatttaaagatctgtatttgcataattatattgcagtataatactaaacagacttctgagggacacattgctcattttgtactaagttatgtctgtagcctataacgcaatgcaattaatttttccaatgcaatgcatggtcccactactctgctttaattttatcaacattacttttctaggtcccaagggtaatcctggtctccctggtccaccaggacttacaggacctcctggaccaaaaggaaacattggtgacatgggttttcctggtgagtgatgaaaaagttaaagtcatttagtgctattaatagtcactattccccccctcccttgagacagggtctcatgtagcacagactatcattgaacttgctacatagctagtcctcctgtatctacccacaaactactgggattataagtgcttgacactataccatgtttataatgtacaaaagattgaacctacagctttattcatacaatgcaagcactctgccaattaacctatgacccaacctcctttttatcccctacctctttttacaatattttatttttattaattaatcttttatactccatattgtattcccctcaatccaccctccaactgttccatatctcatacctccttcccactcccctgtctccatgaggatgtccccaaccctcaccccacctgacctctaaactccatggggcctccagtcttttgatgattaggtgtatcatctctgaatgaacacagacctggaagtcctctcctgtatgtgtgctgggggcctcatatcagctggtgtatgctgtctgtttggtggtccagtgtttcagagatctgggagggagtgtccagattaattgagacagctggtcctcctacagggttgacctcagcagcttctgtccactttgggccttctttccctcaggttcctttccattttcatccctgttattctttcagacaggaacaattatgaatcagagatgtgactgtgggatggcaaccccatccctcacttgatagcctgtcttcctgctggaggtgggctctataatttccctctccctactgtccagtgtttcatctaaggtatctcgcctaccaggtctctggtatattctgtagccccgcccccccacaacctcctctttcctgaggttgcctgtttccattctttctgctggccctcagggctttagtcctttccctcacccaataccagatcaggttcacctccactcactttccctcccaggcccctccctccctccccacttgtgatgtgattgctttcttctccctcccaagtatgactgagacatcctcacttgggcatttcagcttgttgatctttttgagttctgtagactgtaccttgggtattctgtacttttttttttttttgctaatatccatttattagtgagtacataccatgcatgtccttttgagtctgaattacctcactcaggataatagtttctagttccatccatttgccagcaaaattcaggatgtcatggttcttaatagctgagtagtactccattgtgtaaatgaacgacattttctgtatccattcttctgttgtgggatatctaggttgtttccagcttccggctatcacaaacaaggccgctatgaatatagtggaacacgtgctgctgtggcatggcccccacctctttttatcagaaaagatgttaagtataaggtctgggtatgtagctaagtgatagtatatatgagccctgagcattgatagaatcatagtaagacactctctcaaataaccaatatatatatatatatcattacaaacagatatttaaagtaatgaagaacagaattttaagacattagaaagttagaattcacaagcacatgtgttctctagctttttttctttcatcaaaatttcttagaaataggttgttatgtaagcctgtgtgtgagggtcattatatatactcagtttgtggaattttttccaaagatagttctgctaggtcacattcatcttaggtttgacatgagtaaagcctatattatcaaataatatacaatgcatattttcaacaggccctcaaggtgtagatgggccccctggacctcctggatttcctggacaacctggctctcctgggttacctggccagaaaggaagtaaaggagagcctggggtttcaggcattggacttccaggtcttcctggcccaaaggtaatcctagtctgatcatgtgtctgagaagtttcagtttgtctttaactgtgctcatctctaattcttcactaaacaaaccacagaatgacaaggcatgttctgagcaaaggatgtattccttcccttttctcaataaataatcttttattgagtaatcaacaataatattgccgggcggtggtggtgcatgcctttaatcccagcacttgggaggcagaggcaggtagatttctgagttcgaggccagcctggtctacagagtgagttccaggacagccagagatacacagagaaaccctgtctcaaaaacaaaacaaaacaaacaaacaaaaaatacagtgctgggttttttctatgttcatcacctttcacatacatgctttaaactttctgtagtactatttggcctggccaagcagccttgcagtatgatttaacagtttcccctattgacttaatattcccttgattggacgagctaaatacatagaaaacttgaagcactcattttatactctctcatccttagttgttaagctgtcagtgttattcagcatgttcaaaacttcacttaagcaagatgagtaaagtctagcaatctctggtgcaatacagtaaatatggctaacagtattactcatcttaaaatgttcagattaattatatgtgctatgtagattaagtttggttggtttggtttggttttgctgttttcgatatgactttcactttgtagttgagactgtcctagaatttactatgtagcccaggctggtcttgaattctatatcctactacaccttagctttcccactactgggattataggcatacatcactatacccagctcttttaagcactgttattaaaaaatgtgtgcatgcacacaaacacactctcacatactcatttatgcacacacgcacacacacacacacacacacacacacacacacacacaagaaggagtgagaaagagaatattggcagtaactctgtttagattatatcatgattacatgcttgtatccagaaagtacgtatgcatttactatgtacaaatttttgcacgtaaagttaaatcatctttatcaattgactttcattggattttgatttacattttgcatctataagagaataataaataaataaataaacataatgttttgatttgtgtatacattggggagatagtttcccttaattttatttttattgtttgataatttcatgttgcatttttaatcaaataagcttccctgtttcttcctattatctcctaccaatttcttgttatttaaaaaaaatagtgagtttatttgtgcatgggtgatgtgccatatacttgatgggtaacttgatgggtaacctctcaggggctgcattattgaagaaagctggttcttcctctcccagcctccatgaattgccactagcaccattgcatggggtaggaagtcatgtccacacctcccatgctcatatgctccatgctgagattattgtctggctctattttgcacaagtcttgcacatgctgtcacaactgctgaagatcatgtgggtaactatcctgctgtgtccagaaaatagtgttaaatccctggttattttaaactatgttttagaaacatggagacttattcattatgttcactatgcagtgctatgtaacatgtaaatttatttcatctatctggcactaaatgcatacttggtgcccaaaccctctgccagcctcttgcatttattttccataatctgtggtaaccagcattctacacgtagcttatctttctctaattgatttcaatgaacgtaacataccctggctccatccctgttgtcatagtgacatgctgttttagagcttacttgtagtttagtgtgcagcatttcttttattcacttgtctgttggtggacacacattccagttattttcaatagagctgtggtaagcacgggagtgaaggtagtttattttctttgtgtacatagctaaaagcaggcctgctggatagtatagaagctctgcttgacaaatttttgttacctttcttggtctaaggtagaactaggacttatagtgtagtagtagtcatcagctatgtgtgtgtggctagagcaataaaaatgtatcactggatatggactataacttccaactgagggctaccactcagaaggatataggttttctcctatccaatgaaaaaatttccatttattgtttttggttttcctacttccattgcctcttcaattttaagatttcaggcaaaaagacagattagctttcccatttgctttgatattacttataaaatagggcaaactatagctatattttaaggacatagattgtagcatgaaagagaagatgctaatattgctaaggtatagtaaaggctgactttggtcaacctacttagtttgccagtttgaattttagcaagagaaaagatacgaaatggaattcctagtctgctcaaactatatgtgaaacaccataggatagggaccttacaaaaatcatagcaaagctgagtgtagaataaatgcaaaaaatttcagcttcactgtatcctagccttactaaaagcacaaattgattttaattttgtttttgttttcctatggagatgcacgagtttcctggtctgatcttttgattttcgggatcctcttctccttattccttaaaacttatctttttctgaaacacatagtctccccagtaaatattagataaagcttaagctagtaaatttaattcatttcagaaatctttataaagtgtttaaaatttacttgccaggagggtggtaaattgtttgaagagacacaggtaatacactttagagactggtatcacttgtagaatttggcatactttacttatcataaatagaagtgggttgggtaccttccaggtagtttgtccctaactgaatattagaatttctttctatgttttattttagtatataaatttaattcattcataaatacttaaggccctggaaggatgaagctttatgacagagcacttaggttatctgcataaatgtctaatgtgaaaccaatttcagccaagttgttagtagatacccattttgtatccccaaaatgtgctatatttataaaggttcagaaaaaatatatatatatacatgcttagcccaacatttttaaactgttaagaaaaaagtaaggaaatgggtcactaattaaaaaactattaccataatatagaaatacaaatgtttcaaatggcaaattttatttactcaagcaagtataagaaggagacattctgtagatggtattgaacactaatgtgctgttaaagaggctatgatcctcatgagcagagcagtgagtgctgaggtaggcgtttagaattatggtgcattgttttcatcagtatttaggaaaacttttaaaactgttaaagttcgtaggttcttctaagactgtattgaaagaaatataatgtaaatactcattgaggaaacatagcaacatgtacattgcctgttgccacaaagattttttttatgtgtagtattgttttcttttttattagatattttctttatttgcatttcaaatgttatcccctttcctagtttcctctccaaaaatcccctatccctcccccccccccactccccaacctacccactcctgcttcctggccctggcattcccctaaactagggtatacaaccttcacagaaccaaaggcctctcctcccactgatgaccgatcgactaggtcatcctctgctacatatgcagctagagacacgagttcaaccatgtgtactctttggttggtagtttagttccaagggagctctaggggtactggttagttcatgttgatgttccttctatgggactgcaaacccttcagctccttgggtactttttttagctccttcgttggggaacctgtgctcagtccaatggacagctgtgaacatccacttctgtatttgtcaggcactggcagagcctctcaggagacagctatatcagactcctgttagcaagctcttgttggcatccacaatagtgtctgggtttggtgggtttttatgggatggatccccaggtgggtcagtctctagatggtcatttcttcagtctctactccacgctttgtctctgtaaccccttctatgggtattttgttccaccttctaagaaggatcaaaatatccacaattttgtcttccttcttcttgagtttcatgtgttttgcaaattgtatcttgggtgttctgagcttctggcctaatatccacttatcagtgagggcatatactacgagttcttttgtgattgggttaccacacttaggatgacaggagcctaataaagctgtctcctgagaggcactgtcagtgcctgacaaatacagaagtggatgctcacagccatccatggaacggagcacagggtccccaataaaggagctagagaaagtacccaaggagctgaatgggtttgcagccccataggaggaacagcaatatgaactaaccaataaccccagagctccctgggactaaaccaccaatcaaagaaaacacatggtgggactcatggctccagctgcatatgtagcagaggatgacctagtcggtcatcagtgggaggagaggcccttggtcctgtgaaggttctatacccaaatataggggaatgccagggccaggaagcaggagtgggtaggttggggagcagggggagggggaggggataggctatttttggagggaaaactagaaaaggggataatattcaaaatgtaaatagagaaaatatctaataaaaatatattgaaatgttcaatagcataattagttatcagggaaataaaaattaagagcacaacctggtactactatgttgagccacattcatagctatttttggctacatgccacccatgatccacatagattgcttgtcaagaatgatttcatgaaagatgacgattattagatatccactgaagaattggtggattgttcatggtaagataaaacccagccttttcactagaaccaagtgtagctactggcttaagcagtgcaacgcattaaagaatattttcatgaacactacaagttctaaagtcaaaattcaaactctactgcttgctaacagtatcactagaacattcagatggcaatgctttttcctaataggattggtaaggattagtgagagtgacatagccacaaagcacaggaatagcatgagctctggtatctgatagacttcgggccaaacgttaattctgctacttactgaagacttcaggctcttgacttctctgagatttggccttctcattttttccatggaaatgacaaatgtatctcacccaactgcagtttgtatcaagcccttaatagaatttccagcatacaataaaagccttataaataatattccattgttatgcaatcaacgtcacgaagagattttagttttgtctttattcatgttttcagggtgaacctggtctgcctggatatccaggaaacccaggtatcaaagggtcggtgggagagactggtcttcctggattaccaggaaaccctggagcaaaaggtcaaccgggcctgcctggattcccaggtaggtgttcctttcccctttcctttcttttcccctctaattagtattggaagcaatctcttatttggcagacttgcatcatgtaccggctagcagcataacctcaaggtagaatgttaatgcttctttgcccacatgcctttctgtacagaatgagaaggagagaatgagtattcttgcctcagcagtacaatatcttgtgggcagagacactagtttggtggggcctttactattttttttcaggtgataatgtactctgtcgagctcttgcctgctgctgatagaacattgtccacaggcacacagctggcggctgttggtagaacaattccagtgttcattcagatgacaaggactgagtcattcaagcaaagagacttagcactgtagtgcagtagacagcctgacctagattgctgtatctgttgtttcatgcttccatgtaatttttactttggcttttgaatttcacagtggcacagataggtctttggttctctctctctctctctctctctctcagtctctctctctgggtctctctgtctctctctgtctctctctgtctctttctccctctctctgtctctctctctagtaaactgctgtttctttctctttttctcctttttattcttttttcttagatattttgtttatttacatttcaaatgttaccccctttccctgtttccactctggaaaccccctattccatcctccctccccctgcttctatgagggtgctcacccatccactcctgccttctcaccctggcattcccctacactggggcactgagcattcacaggattaaaggcgtctcctcccattgttgtctgacaagggcatcctctgctacatatgcagctggagccatgggtccctccatatgtactctttggttggtagcttagtccctgggagctctgggggatctggttggttgttattgctgttcttcctatggagttgcaaactccttcaactccttcagtcctttctctaactccttcattggagaccccatgctcagtccaatggatggctgagagcatcaacatctgtatttgtcagattctggcagagcctcctaggagacaactatatcaggctcctgtgagcaagcaaatcacttaatggcatccacattagtgtctgggtttggtgtttgtatatgggatagagccatgctccaacatataataaggacacatgctccacactatgttcatagctgccttatttataatagccagaagctggaaagaacccagatgtccctcaacagaggaatggatacagaaaatgtggtacatttacacaatggagtactacacagctattaaagacagtgaattcatgaaattcttaggcaaatgcatggaactagaaaatatcatcgtaagtgatgtaactcagtcacaaaaaaacacacatggtatgcacttactgataagtggatattagcctaaaagcctggaatactcaagatataattcacagaccacatgaagctcaagaagagggaagaccaaaatgtgggtgttttggtccttcttaaaagggggaacaaactacccgtgggagcaaatacaaatatgtagaggtccatacaaagtatggagcagagaattaaagaaagaccatccagagactgccccactcggttatttttctcctaaccttttaatggaagtataacatatacagagaaaagtacacaaatattcctgtctataaataagtttatgcctgttatttgctaactctaaaatgggtcttttagaggccatgcggttttttcaagatgtttacattttttatgaactctcaaaatgtaatgctttctatcaaatattaaagacttgctgttttacaaaccataaataaaaagtgctaatatatcaaataattgcttaaaactgagccaccaatactgtatatgactgatacatttatcaggagatgtgaattcagtgatccaaggtagaaagactatatatatgcttcaactccttttgtgtttattttccccccctgaaggttgtaaattatctcattttcaaaatacactgatctttcttttagtacattgtactgtggcttggaatctgttcaatgcatctactccaaattctcatcaagaaactgttgacaccagaagcatcatgcatacatagaagccacacttcttaagcctcctcaagtagtaccactaactggggatcatgcactaagactcccaagccttcaggggagattcatattcaaatcagtactctagttattcattgggctttactaattgtagaaaattaactcatacataactcattcagtttttttctcttctgttggtttttaacccctttatactcttttagtgactgtcctagacatttcaatactctttatgttctcatacaatagcaacattataccatttcatataaaatataaagtaaatgtaaacagtgtaattctattctttatgaaagtctttctgactgtctccatgcatttcatttttatgtacatgatgaatcttacaattaattgctattatcattttatattgctggtgtcaggacacaagaccttatgcttgctaggcacgtgctctacaactgacttgcgtctctagctttatatgtgttttaagctctatctagagtttattgaaccctcaagaatttattataggaaggggaatacatttttccacgtacctatctattttccatttgaattgttctacattttttttacagcacagttacacttgctattattccctagagcctgatctactttcactgtcatttattatgaagtgcctactggtgtcaaaagatctcatatttacctaaacatgtctttatttcaccatcggtgtaagaaaaatttagccctgtgggtattgggcctttagagtttgaattgtgggtcttttgcatgctaaggcagcactgtccactgaaccacattcctagcagcaagtctatctttgacatttgttccctcactgagtatttttccactatcttttatctaaatattgtcctaataataaatccatattttaaaataattatttcctgtatattatacactgaggttttttctggatgcattttctgtagcatttttaaaggtgtgtgtgtgtgtgtgtgtgtgtgtgtgtgtgtgtgtgtatgtgtgtaggatatgagatcatccatgaagatacacaggatatggcatcagatctctagttataggtagttgtaaggttgggagtctctgtacttaatgggcataataggaactaaattctggtccttggaagaatgttgtgctaagttaaatactgagctctctctccagctagtaccattgatttgttccattctcctgtgacgagctgtcattatatttatttatttatttatttattatttactgatattcctgcatctataaaattgttactttagaagaattttaggaagatccatctatttcctcttcatctagttatttcagatttttcccatttatagtaataataggttattcaatattgtctcatttgttttggaggttttggcttgcttgcttccttccttccttccttccttccttccttccttccttccttcctttctttctttctttctttctttctttctttctttctttctttcattctttcgtgtttgtctgtgtgtctgtgtgtatctgtgtgtgtctgtgtgtgtctgtgtacgtacatgcagatatcaagggaaaaccagaggtcatttgttctgttccttcaccatgtggggtttgaggctcaaacttgggttatcaggcttgacggcaacctttttactcagtgaactatctcatcaactttggccatatttcctttcaagtttttggttttgtttagattttactttcacagctgttaattatcttcatgtttactgattcggttttttctggtttgttctttatgctgttgctatatataagaaaaatagcgggtttttttccttttaagagttacctcacacacacacacacacacacacacacacacacacacacacacacacacaaagagttaccttatttcaccagaaattgaccatttttcactcgtgtgcattttaatctgaagatttttttcttattaatttctggtgctggcaatgaactcagtgtaacacatgtacatacattttctcctgagttttataaccaattcctatgactgtaggttcttggccacattggtaaatcaattttaaagaagttttctacttattttaacattctaataattcaggagtctcattctgctgtttgctcttctatactgtttaagattgatattccttcatatgaggtatcacttgttgtgccttgtctagacttttatatttctgtgataaaatgtcatgagcaagacaacttttttaaaacaattttttattagatatttccttcacttacatttcaaatgctatcccaaaagtcccctataccctccctccgccctgcaccccaacccacccactcctgtttcctggccttggcattcccctgtactggggcatataatctttgcaagaccaaggacaacttttaatagtgtctgagagttgaagagggttacagttcataaccatcatagttgagaacatggtagcaggcaagcatcagtagctgagagctcacctcttgagacagttatgatgcacagagagctaacttggatggatgtggagttttaaatctcaaagccccccactcccagtgacacatctcctacaacaaggccacattagaagtaatcattcaaaaatacttccatcaactagaggttatgttcattcgaaccaccacatgcactgaatgttataaacggtacacatagggattccagattctgtcaaatttctttataaaaacgttgactattctatcaggtcatccattttttgaaaatcaacttgatcttacattgattgaatttaggctttattacaatggagaatttccattgcccttacccttaactgtacctcctagacctggtatatgagctttccttttaatctgtggattttctggagttatttccgttgaaattttttaggtaatgttttcattcattaaagtatattgtcagtaaaacttcttagctgtctttcattagaagatttttattgttccttaattcaattttatcaattatttctaagatgccttcccccatgaacatttgcagttccttgttaaatcaaagactaatcgtggtactgatgtgggatgactttgcaaattgacaactctcaaactaattcattttaatatataaaaatattttctgtatgtctcacatagtaataatgtaaggtctttagatttattttttcatgtatgtgatttttttgcctgcatatatttatatgaactaaatatgttacttgtacctgtttaagttaggcaaggtcatcagatactctgaaactggagttatgggtggctgtgagccaacttgtgaaggcaagaaatccaacccagctcctctacaagagcaacaactgctctcaactgctaagtcatctctctaaccctcaaataaactgtttaaaagcagaacatttccccaaactcatagcaaaagtcaaatcagagagagtcaaaatgtaagagattaaacataagacagcatctcccttactcagatgaaaacgctccacaggatagaaatgtgaaaagtctgaaaacgggaatgactttcgacaaaaagcctccaaagaaataggaacttcttgaagttatataatcacaagacaccaaatatggctgataatttgagtaggcttgaactttatcctttttcaaagtttcaaactaagaacctaaccacacagctaccttagtttgtttaaatgaatcactaaacagaagacgtgcctgagctgcgcctgtactagtgcctattgagatggagtaatgattgatgacactgttgtggtataatctcttgcaaaacaatagaaaatgaatacactgctcttctagctatacttcaatttcttctccactccaaatacgtctagtgttcactttcatatggttatatatctttctgtaagaaaatttaaacacctaaacaaatgaaaacaattatatctatacatattataatacagatagcatattcatggaataaatttttttaatttgagttgtcgaaagaatggcccatcaattcaaagtaattccagttcataagtcaaacaattaaaaaaaataggaactagagagttctctcagggattaagagcagtgattactcttgcagcagacccaggtcaatacttagcacctcatattggctcataaccatctgttactccagttccaggccatttgacaaccttttctgaatttctagggcaagagacactcatatggtaatatatatataaaacattcacatacataaaataagtcaaaaaagagaaagaaaaaatttaaaaactaatgctaaaatggaaagggtgttgaatatgccaaatagtattgaaaaagaaaaaaaccttcattgaaaaagctttgttggtaggcttgcactccatgatctccaggtgtgtagtaattaaggtggtattatacttacataaagattagtaagtaagagagcatagaaaaagacccatgttatacaataaagtgacctgaataaagtttctttacaaaatggaaaataaaggctatacaatgaaggttgcttggtgttttggctgtgactgatccttaaatggctgaactatctctctggccatcactgaagctttcttaaaatacaaaacacaacaacttcaaaagaaaataattgaaagatttcatttaagcaaaatttaaaactctgattatcaaagcaagttattataaaaataaataggaaaagtaaagtttaaaatcaattgacatatgggacagattggtatctgacaaatataaataacttctataactcagtaagaagaaatacaattcaatttttagaaatgagaaaaattttgaactgatatttcacaaaagaatatatgctgatggctggtcagtacatgagaaggtgaccaatgccattaaccatggaagtaaacacattaaaatcacatgactaacactgtggctgttttttttcctagttttttttttaattaatcattccattcatttacatctcaaatgatatcccacttcccggttatccctccacaaatccccatcccttctgccctctccccccttccttttgactctatgagggtgctccctcacccacccactcaccctacccgcctcagtgctccatcatccacctacgctgggacatcaaacctccacaggaccaaggacctccactcccattgatgtcacacaggccatccatcctctgctacatatgtatctggagccatggattcctccatgtgtactccttggttggtggtttattccctgggagctctgggtggtccagccagctgacagtgtccttcctatgggattgcaattctactctgctcctccagtctttcctccagctcccccactggggtccctgagctcagtctgatggttggccgcaagcatccgcatctacattggtcaggtgctggccgagccttccaaggaactgttgaatttttcgaagcaacagttttatatgttgatattacaacatatattgtgcatagatctggaacaactggctgttttaaatctaaaataacttctatattttaataaaacataaaacaaatcttagtctgacctagaaattccattcttggccatttactcaagataaaggcatatattttcacaaaaataaaagaagtcatgcaaaatgtccatagccactttattcattatacctaaaaaaacctggcaacaaaatcatgtccaacaacggatactgaatttaaaaccaagtattaaatctaatactaaaaattttattaccagtacagtatcactgaaattatttttatatttatggatacataatgatatctactcccgtcaaattaatttgaaattatctagcaatcatcaacatgttttggattcacttttggtccttattatttcaatgctaattctctaaatttaagcttcatttataactcataaaggaatgtactttttttaattattttttttgagtgttcagaagcattttatttattttttttaattaggtattttcctcatttacattttcaatgctatcccaaaagtcccccatacccacccccccaatcccctacccacccactccccctttttggccctggcgttcccctgtactggggcatataaagtttttttaattcttaaactgaggtttttttattctaggaacaccaggacttcctggaccaaaaggtatgaatggtcctcctggtaaccctggctttcccggagaacctggtcctgtaggtaagtaagaaagacagcattgctgttctgtaagactaaagcttttcatagtcaaatctgctcctgctgtgaagaagaaacagggtgctcattcacttatcacttcatatcggacatgaactgaataaatttcattttaaaattatcaaaatttatctctagcaggtattgttgtcccagctcacattttctagggagagtaattctctctatgaaggtcacgttgtagcaatatctttgtttattgacttttaaaataattcccgtcttggcccttacctgaaaagcacctcatccctccttaacacctttcctctcgattatcgtgaagttagactaaaatgagttattgttatttttgctcatcattaccttgctttactctttgttctataagatttcataatttagaggagcatttcagaaggatttgttactttggggtttgaaattttggtttgtttttaattatggggggtaggtattgtgcatggaggtgacatgtgccagtctgcgggaactggaattacaggggtttatgaacgacctgatgcagacgctgggaacagaactcagatccggtggaagaactgcaagtgttcttgacaactgagccatctccagcccacgttgttactgttaggattatttggtgctttaataggaagactggagaaggatgtggaaggaagctgaaaggatcagtgtaacctgtagtgttgttctttaggtgccggagggcgtcctggaccaccaggacctcctggtgaaaaaggcaagccaggtcaagatggcattcctgggccagcaggacaaaagggagaaccaggtactatagtttttgtatgtttgtttgtttcatttttttgaattttctaattacctcacggccttctttacagctacaataaaactctgtcttccttacaatcttctaaggtcccacacagttcccccttcctaattaacttcttccttggcatcctgaaaataacagctcatttttgttgaacaagttgcttttgtctgaagaaaaaagttatttatattgtccacttccttttacaagtactgacctaggcattttcaagtgtttcgttcattgtccaacctgtactttacttatgcattttcatccaagtgtacaaagtatctccaagggtcatcacatgtacagtgtgtgtgcatgtgtgcgtgcgttgcttcttttcaaaatgactgcagattgactaaaggttatcagtcttgctggaaagcacatttactcactgagccatccttccagctatgtagcttcctttctagaataactgacaaatatcaagtagattgtgacaacataaagaattatcctataccagtctcgaaaagagtttgttttcttatatgcaccatgagctttccagagccagaagaaggtgtcagatcccctggaaatggagttatagaagtctttgaagtatcatgtgggattagggagctaaacttacttcctctgcaagagcagctgagctgaaactctggtccctatagttttcttatgttgaaactattctatgttagaagtcaatcttctggggaagagcattaacttagtggtaatgcgtgtttctagaatgtgcaagccctaggtctgtccaagaaaagaagagttggggaggacagaagaaaaatggatggagtaagcacagggttaagaagagaggggactaaaaaagttaatctttagcatgtttgatataatatataacacttattagaaggaacctcaacaatcagctattttttttatcttaacaggtcaaccaggctttggaatcccaggacctcctggactcccaggactttctggtaaactttaaccaaacaagttaaaataaaaatattcttcagtccatttatttttctacctctaccatttactattataaaatacatctgaaatttttagaaaacagctcaacctatttttagggtacttcttattcctagcaaatagcctatgttactaagaaagtcatccttacagagacttcaataaatagcctttcattcaaatcataaatactgaggacatgacgcagaaaagaggcgaaaattgcaggaaatttagaagctttcatttgtccagaaaaccactcttctcttctgccagagtagtatcataggaacatatgaggcacttctgtagaaacacatgccaagagtaagaatttttcttgaaaactcatctaagagctacacataatgacatacacctgaggctgaagcaggtagattatgaattctgtgccaacctgggcctgggctatccaaagttctcaggtgagaggaggccattatgtgtgaatacatatctatcttccctctttagtatgtgatcttaaaataagtcctaaactctctctctcttttttttttttttgttttttttttttgtttttttttttgtttttgtttttttgagacagggtttctctgtgtagccctggctgtcctggaactcactttgtaaaccaggcaggccttgaactcagaaatccgcctgcctctgcctcccaagtgctgggattaaaggcatgtgccaccatgcccggctaagtcctaaactcttaacacaaatctgaataactacagatatgcatgttgataccttgaaatgatcattagcagttctatagaagttttctcaaactaaaaatctatctcctaaaatttccagtatgcttttcatgaaagtttaatataccactgtcttacggtttgtaagtattagtatttcataataaaatgtcaagagcagtttgtctagattatgattatgaacttttaatatcatggtctgaatataatagcagccattgaatctcattagtcttaaaattagatccaaagctgtgatagttgtcttcatccatcttgaaccaattcttgaagatatttttatacattttatatctggtctatcttttttcctcataacttccggtcatgttataattgccctctgttctaatatgaaggatgccggcattagtttttcattgctaataattgcttctgatgacagatacatgtgtttaataaagagaaaagattttgcatgtgtttgaagcaaatttaccctagtgaatttcattagcttatcatgtagctttaggcttataggtgagcttatgattcagcattcagtatgactgcatgtatccctaattacacttttacttctacaggacaaaagggtgatggaggatcacctggacttccaggaaatcctggccttccaggttcaaagggtgagccaggctttcagggattccctggtatgccaggtcccccaggtcctcctggttctcctggtcaagctttggaaggtcccaaaggaaaccctgggcctcaaggccctcctgggagaccaggtatgatcgtgtgtggtatgaaaaatgccctgtttaccagttcagttagttgattttgctggcaggttattcagtcttcaagattttagaatttgtcatgtgagaacttcttttaagaaaatagctaggttcatacctagcttgttgcaatatatacattcatttcaataatgcatgtattatttacctaaagttcatcttgaatggaaaaaagagaaaatggtaaggttttgttagtattgttattaaagataacctggcatcaaaatgcaacctgcaccttttttaatgtctgcttcttagcatgtcatcacagaaatcattctagtgatcaccaagtacatgcttgtgttccatatcagaagctgttgctatggttccgtcacatgatcagcaaatgtcaccaggcacaataaaaacttaatctctaggaactaggcaatcacatttatcttcagcagcacagcatggtcaaattgactcataatctcttcatacctcatgtctgtccctctctttcctgtgctcactctttagtagatcaattttgcatccaagggccagattctcatttttgtgtctctgctgcgtcattccattctattaattgggaaatgctcattctaaccccaggttaatgttgctgagctcaatagctcaatcactgttgatagcctattaaaacatttgaggtacttactattcattttgggcgggtaactgaaaattttgcctttattattttttaaagaagagaaatttgagatagaaagaaacaaaacaattgtcttttcattgctcaaatattcttaattcatttctaaagtatatcataaaactaaaagttatatttatattgcaagaattgaacttgattttactaatatgtgccctaaaacatgaattaagcagtataatgtactgaattcgggacatcattttcaaagtcagctgtaatgtgatctgacttgattgtttctgaagagagttgctttttcctttgtttaccactgaagaaagacagaggaaatattctcagccacattaactgtcttgcatgcaatataaagaactgaagccagtgtcttgctttgtttgcctgtcataattcaaataaaccaaactattatccccttatattctaattagcgctgcacttatttgtaactaggagtggagctctcagttgaacatttctgtaataatagtaatagaaaagcagtagccacaaacatgattttgcaatcactgtttctaaagactaatcaaccttctccaaagaagaatgcacatctaatgaatgtttgatttcttgatttgtttataaactacagatctaaaataaagtgttaaatcaatttctcttagaattaaatgttccaaatttgagctcataacaatgaacatcataatatgatttttttgaactttcaaactttattacgtgtagttttccttttaacattaatgcttaatagagatagtttggtttatataagatgcatgaatatgaactttcagagagttctattattaaattcaactttaacttgagagtatttagtataatgctatagtttcttgatgtttctaacagttttgatattttcctttttgttaatgatgacattgggctttggtgaacttccatccctacccaggtcctccaggttagctccttaactccaaagtagtaattgcatgaaatttgaaactttatcaatgtatttatgtacttatatacgtgtatatacacatatgtgcctgcttatatatgtatgtgtgtaatgccttcaaggttctaaatatattttaagagcatatgccaattcagttttgaaatggtggcctgggcctaagttgtcagaatattgtagcgccaagtatttcccttggaatggttccaaattatccaatcatggagatggactaaattaaatacttcaaaattcatacttctgtgtcatttttaattgagattttatagtactcaattttgtcaaagtatgcttttcctttgttagaaagtattttattgcattataaacttttaatgcaataaaattaaactcattcagaaaagcatctttaataataataataataataataataatgtaggtaatgaaatccttgatttgatacacacacacacacacacacacacacacacacacacaaacacacctctataaggttttcaaacagcttcatattttggcttgtcacatattttcaaaggtttacacattttttaacttctgagcatatttgtgtgtatatatatgggctgcaggtgcccactaatatcagaggcataagactcacctggagttctttgtatatattgaataatagccctctatcagatttaggattggtaaatatcttttcccaatctcttggttgcctttttgtcatattgacagagtcctttgctttacagtgtcctttgtcctttgcagttttatgaggtcccacttgttgattcttgatctttcagcacaaaccattgctgttctgttcaggaatctttcccttgtgcccatattttcaaggctcttccccactttctcctctataagtttcagtggctctggttttatgtggagatccttgatccacttgaacttgagctttgtacatggagataagaatggatcaactttcattcttctacatgctgaccgccattgaaccaggaacatttgttgaaaatgctgtctgttttccactggatggctttagctcctttgtcaaagatcaagtgaccatatgtgtgtgggttcatttctgcgtcttcgattctattccattgatctacctgcccttgactataccaataccatgaagtttttatcacaattgttccgcagtacagcttgaggtaagggatggatctggagaatatcattttgagtgatgtaacccaatcacaaaagaacacacatgatatacactcactgataagtggatattagcccagaaacttaaaatacccaagatacaatttgcaaaacacatgaaactcaagaaggaagaccaaaatgtggatattttgactctttttagtaggtggaacaaaatacccatggaaggagttacagagacaaagttcggaacagaggctgaagaaataaccatccagagacagctccacctggggatccatcccatatacaatcaccaaacccagacactgttgaggatgccaacaagtgtttgctaacaggagcctgatatagctgtctcctgagaggctctgccagtgcctggcaaatacagaagtggatgctcacagtcatccattggactgagctcagggtccacaatgaaggagctagagaaagtacccaaggagctgaaagcatttacagccccataggaggaacaacaatatgaactaaccagtacccccagagctctcttggactaaaccaccaaccaaagaatacacatgatgggactcatggctccaactgtatatgaggcagaggataacctagttggtcatcaatgggagcagaggcccttgggtctgtgaaggccctttaccccagtgtagggggatgacagggccaggaagtgagagtggtgggttgttgcacaggtggaggggggaggggataggtggttttaggaggggaaaccaggaaagggataagatatgaaatgataaagaaaatatctaataaaaaaataagactcacctggagctgaagtcacaaacagttgtgagctgtctaaaatgggtactgagaactgaacttgggccctttgcaagagcaatgtctacttttaaccactgagacatctatccaggtcctttgacacataatttttaaattgctttgctgtgaagaactaataagcataaaggaaaatataacttaatgtaaccagcacagattaaaggctcacaatcacatatatggtcatcacacgtagcaagaaattatgccaaagaaaaattatcaagagttacttcacagggttggaaaaaaaaagatctgttgcttctagttttcttttttctttttttttaaatgtgtacccaatctggtataaaaagttaaccatggacatctcaatatatttattattttcaagataaatagtccttttctcttttgtagaaaggaagtaaaataggtcaaaatataatcctgagatatgacttttgaaaatggggagggtttttttttaattggatttttttatatacatttcaaatgttataccttttcccggtcccctctccccctaaatcccctatcccacccccctccctctgcttctatgaacccacccacccacttctgcctccctgtactggggcatagagctttcacaggaccaagggcctctcttcctattgatttcggacaaggccatcctctgctacatatgcagttggagccatgtgtccctccatgtataatctttggttggtggtttagttcctgggagctctggggggtctggttggttgatattgttgttcctcctgtggggctacaaaccccttcagctccttcagtcctttaagtcctccattggggaccctgtgctcagtccaatggtcagctgcaagcatcttctgtatttgtcaggctctggcagagcctatattcaccacagtttgtagagggagggagatatgattctctatgtcaattgattccttgatttatttctaccataccaacccatgcacacgtacattcatacatgcatacacatatgtgcaaaatgttttatgtgtaagatctattgattaggaaaattttaaagatgcaagctctgaagacaaattttatcatgacaactgtaatagagaagaccccattataacaaagaaaaggaactaaactcagctccaaataaaacagaaacaaagacttccagggacataaggagagagttattgactgaaacttactaagaagtactagaaagcaagaggagtcttacacttacttcatatgattctcactgaaggcaggccaaggatttagacatcagagtgaggaatgaggaacttgatcagatgttaactactggagatttagagtttgaaaggtactaaactgatttggttggatttttcctgtaactgggcttcaaatgctaaaaaaaaaaaaaaaaaaaaaaaaaaaaaaaaaagaggaagggggataatgtggatgttaggtgagatgtagcaagaagtctcagggattctggtttaaggtttagtcagagaaagaattatttttcacacaggaaaactaagacccaaaattattgagaatgtggacttcccagtactcttctactagtagcaccctataattcttgcacaaactgttgatgtttatgatatggtttcttgataaattcatggagcaaaactgcttttatcatgttaggaaccttatagttagctagatcttagatctagttatctcctcctcttcctcctcctctttttcctcctcttcctcctcttcctactcctcccttcctcctcctcctactcttctttctcctcttcctttcttctcctcctaccccttctccttcttctccttcttctgttatctcacatctccgtcaatccctaataacatcatcttacattcttcctaagcggatgctcttgagtatattaagacagtgaaaatgatttaactatcaacaggataaagacaagattggggtaactttgaagcaattttcactgttattctgtctaacttgcctagaattcttctgccctgatcactgctagactggaatgcaagctaggattttttttcctgctatactagaatatatttgaagaagaaagagaaaagtatctccaatacttttttttttggtttttcgagacagggtttctctgtgtagccctggctgtcctggaactcactttgtagaccaggctggcctcgaactcagaaatctgcctgtctctgcctcctgagtgctgggattaaaggcgtgtgccaccacgcccggctttccccaatactttttaaaccaatttaacaacttcccctttgttaaacatgataaaaattgtaattattgaaagctagcctctgtgatggttacaataggagaagaaagcaactttgagtggaaattagaattaaaatataacagctgattctataacctacctaccttcagtttctttttcagttaaatttaagtacatgatttgaaaaatagtaaattgaggcctcacacataaaaattgacttggcatatagctcattaatatgtagccctttagaaattaaactcttagaaattttgctatgatatggtccaaagtttcctgtgctgatgaatcattaaaatacctcatatcaataaaatatctttctgaatattattattgagtcattctaaagctaatattcatataacgtatcttcactttgaactatgctaaaagcaattctaagctagttaattgagtgtccagactataagtctttggctaatttgttgtatgtggtttggagactatttacataaactgaaatatattattctaagtttccaattctcaaatgctcctaaatttttggttttaatcatcattgtgttcttttagcatcttacacatagcagacagtagttctatatttcgaaacttgactttgatccttatgtaaacatgcaaggaaggacagtatagataacactattacattcagagagattgaattacccacagtcatatagttacaaagaagcaaggtcaagaggaagttccaaggtcttttaactcgtggtactcaatggtcttgcactatttattctctttaaaattcaatgtttataaatcatagcaagaactctaagaaaagagaaattgtgtttagagttgatactaaccaaagaatgttctacttgtagactttaatattgttacataatttttcttctttaaatggttaatagtctgataatacatgcattgaataatactttaaaaaaaagttgttgtaatacttaaaatggcttggggtaggttgctgcatgccacaatatttttaaagtacccctttactaatagtcttcatatcattggaaaattggaatatttatttttaaattcaatggctgtttatgcttagtacttaaaacaaatactaatagaagatggcctcctgatttattatgaaaaattaaaatatgactttataaaaggtatttgaatagggcaaacaaaagcaaaagtcataatggttgtgccatagtttaagttttctctgagtttcaggtcagcttcctaattatatttttgcctgtgaggtttgaaaagttaactgttcctatcatattggttcactccgaacatcaaaatacatttttacttcatgtttgtatcaaagcatggcagaggtttaaatacttgttcacagttactttgttaaagaaaatgaaggcttttggtgaaatggtactatcttgccaactttaatgttttgaattgctaatatttagaaatatccagtagtcacgttaacatagtctcttaaatagatcttccctcccattaatggccaacagcttattatctagaataagcactattttaaacatatttagttctctatatttctggatgggtctgtttgcctattgattgtgctgtaggtataagaaatgcttacaaagagaattactgttcaacttgctctataatgtgaaccacttctaactcatcatctgattttgtactgtgtgatgtctgatcctgctgatatcgatcttttggctttggtgaactctgatcttcccaggttttcaaggttagactcttcgctggtcacttttctcctttattaaatgctttatatatgtgataagagagatgcactttattattataattcataagttattgaaaatgatgttatcctcaaatactaccctattgggttttgacatttttgacttattgatatttgatataatatcagttttttgtggtctgattgtttgtaatagatacttttatatataaatacctggtaaaactgaaatagccatacaaacgcctttacattataaactgcattaagatatttaattaagcaaacatctggataatttctaatctctgcatatagatttttttttgaaatttttacacacaattgccttaagctgtgcgatcaatgctgttttcaataatagagaaagaatgctattagatacagttaaaataaaactctgtttttactagaatcctaatttaatttttttgagacagtcaaaatatcatgtctgagatgacataaaattcccagtattttctttttagttgataatagaaactccaaatggagaataatgacatgcaaaggttcaatttccctatcttatatcttccctcatcattgtcattgggttggttcaaagactattcagttttagcttaacagcctaaattgctaccagacttctagcctaaattgtacaaattactgagtttatttagaaaatcttattctagtgtatttgagctaagcagctgtggtttatgtttttccaagtacaaagtaactccaaacctttcattacaattgcaaaaggatttttttgtgattgtgatatctgtttgacaagctaaggtgattgtatgatttaagttgtcaaaattaattgctgtattatcacgaacttgctctttgtcataaccagataattaccacattgtgaaaccacttaaaaattctttaaacattaaaaatatcataagatacattttatgtttaattttattactaataattaatagtaagcataactatcaaaacaccaacatttcatggttgttagtatttggtaggcactgtccagtgccaaagccacctggttgcttaagggaactgatatctttatttagaatgatatgttaaaaatgtagtacaaaattttaaaaaacccatggaaatattttgaaatgaattttatatatactatactgaaacaataaatatatggcatttaaaagatatcccatgtgccaaacatatcaataaaatgaacttaaagttagtgtgcttaactattttaaaactattttaactgctcgataagccggtgctcagatgttagatgtttgcctaacatacataaagccatatgcgtgactcacacaatacaaaaattgcacagtggtaaaaggtaaataaacatatcttcttataaataaagcagttgaagttttttgttttacggaaatccatctaacctaggacttagtcaaatgctatgctcatccctaagtaatttaatgtttatctcagtaagaggaatggcttgaattcctgattgctctacaacagtcattccctaagtgttggtcatgtggccagcagcactaagtactaggggacatatggagccaatacttcaggatgtgacccaggaaactgttttgatatctccctttccacaggagcatactgtaatttgagactaatgctatcctatgtctcatttcaatttgagtcaaacacgcgtacatggattacagaagcaaacatcatatccagagttgttttagatctgagtttactatgtttattagaaaataaaatacaaaggtctggggagatgttgctgagttggtagactatttggctgatatgcatgaatccccgggatggcataagctagatgttgtggtacatccctgtaatcctagcacttgggtcttagggcaggcagaccataagttcaaggtcatttttggtgcaataatgagttcaacaataacctgagatacaggaggcactgttccagaaacgaatgtaaacctaaggggtctaaaaatcagcattaatgacaaaaatgtctacatttactcagtcttcaccacaaagtaacaaaagatgactgatattttaaaaacctggaatactatactaatatgtggtcatttgttgtgcattaccaaggtccaccaggtacagaaggtcctcgtggaccccctggaaatggaggtatcaaaggagagaggggaaatccaggcccacctgggcagccaggcttacctggtttgaaaggagatcaaggaccaccaggactcccggtaagaagtgagactagatatttgatggtagaatagtgtgggtgacagttttcaaaatgggaattctgagcagcagaattttattaacactcaccacatagctcactggtgaagtaaaaagaaaatagaaggcaaggctcctagtcttcccatgaaattgtctttactgttttatactaaaagagttttggtgagagcaaacctatgaaaagaaaacttacatatacacatcagtacattgtattttagatgaatacacccataggaaagtaattatggcaagtaggaatagtttagactttggaattagagtcagggtcaggtttcagttgcactatttttctcagtttatgcttctctcttctataaccacagtgcagttatcaactttgcaaaatttaagagaaatcaactattttaatttctactctttctgttctgattttatcaattggtatagtaatgtaaattttagcactacactctgtaacaaggtatccagaccaaattgtgtgttccatttaactgctatgtctctttattctataatatggaatcgttccttagccttttttctttcatgattttaatacttaaaaagtgtagcctattctcactttaaaaatgtagcagaagatggccttatctggcatcactgggagggaaaccccttggtcctttggagatttgataacccagtgtaggagaatggtaggctgctgacagaggagtggatgtggggtgggggggggagagggaagaggggatgggggcttgtagatggggaactgagaagggggataacatttgatatgtaaaaaaataaccagtaaaataatagaataagccttcttttgtctaatttgtcattttaattaaattcaggttgtacatcattagctagaatattccaagagcaatgaaaatactgtccttatcaaaatttatccataaatttagcatctattaatgagttttgaatggataatttctactgggttaatggcaaaatggtgactttgtaaacttggcattatatccacatgtaccatttagttctactgtaggcaagagatgtcccttctattctacgcagtcacatatttattatggacatgggttcatgtttttttttccagtcatttataaaatttgaagctgtcattgcttattttgatattctcattgttccagatttgatagccatatcgagctggatccgatgacattgtgacatgcttctaaaactgctttttctttgacactttcttatattttgacataaaaatacattctcacattaggcctttttcagtcctattaaaagcttcacagctctacagttagtgtagtacagtagcctcttcaatcatcttgacattatatgttcttccttttagattcttaagctattttctctctcttcctccccccttcgttctcattttttgttgctttctatattatcagtggctctcatcaacctaattatcatcccaagattatatttgccaagtctttcagactttatcatttctccatctaccactccagatctagagtacaaagaaagtgctttttaataaccattacttactaaatactctatatcatcaaatttctaaacatgtaacaagaactttgtcatttgatccttcccaccactccataaagtaggcatacttttttctccatgatgcagaagagaaactatgggtaaaaggttaaatattttaaagtcacaggtatttggaaggctctatgccccagtgtaggggaatcccagggccaggaagcaggagggggtgggttggtgagcaggggagaggggatagggggtttttggaggggaaaccagggaaggggataacatttgaaatgtaaataaagaatatatctttttaaaaaatcacaggtaataagcagagtgagaatttggatccttccagtttaactggaaaaacagctctctaagccactgtgcaataactgaatctttattctactctgtcctagttatgattctgataccaatgacttttatttatttagggtaaccctggccggccaggtcttaatggaatgaaaggagatcctggtctccctggtgttccaggattcccaggtatttgaaagagtggtttaaggttttctttatatttttaagtatttttatttattctttgaacattccatatattcaatatattgttatcgaatgtacctctactaccttcctcaagatcagtgcaattgtctctctcccaacttcatgttctctttattactcctccttctcctctactatactatacactatataatatactactatacttctatagtagtagtagtaatagtagtagtagtagtggtagtagtagtggtagtagtggtagtagtagtagtagtagttgttgttgttgttgttataatactaaacaataccctaagtccaactagtggtgaccctattaagttcctttggaaaaaactggtttttgctttgctttgctttgctttgctttgctttgctttgctctgctttgttttgtttgtcttattttcctacataaggctgtcttgttgcatatttatgccattttattttatatatcatctttccaggaatgaaaggacccattggagtaccaggctccactggccctgatggggaaccaggtcttactgggcccccaggtaagaatttttcttctcctaaggctgtttatgcctgatactttgaaacatgaaagactttttgaagtatccgtttgtctttccaaattatcaacataattttcttaccagcatcatttcctaatttcttaaactctttatttagttctattatattgatagccaccttattaagtttaagttagaagtacctagccccattcaacaggaggaaagctagccagccagaatggagctttcagatcaggcctagctcgattcctatgaattccttaactcaagtctgtggtatcttcagtaatagggccttaccatcaagttttgggtaaccacgagcctgtaatatttggggatgacctatggtaactcactacccagtaactgcaaaagaagtaactcattacctgcactggacttttcatttgttagcctgtggtatctactagaggtattgctattctgataatgagttaccacattttaacttgtatatatgtgtatatgtgtatatggatgtgtatatgtgtgcatgtgtgtgcgtgtgtgaatttctgcaatagtaggtttccatatgatgtgttcaaaggtatttaatgttactatccatcctaattgcccctcctctacactgccttcctttccccaccccaatttaacccttacagtttttagtccagttttctatctctcctcctctgaaatttcctctctctggtcctttattactttcctgacttttatggatattccaaatgaaacaatcatctgatggcttaaagctaacttccacagattagagaaaacatggcatttatttttctggtatgggttacctattcagaatgattgtttctaggaccattcatttatgtgcacatttcatgctctttttcttaatatttgaataatataaatatactatattttaaataccctttcatcagttgatcaaaatctctagtctgttttcttttcctggctattgtaatgagaacagcaataaacatcaatgaggagatatctcttttgggattactcaagagtaatacaactggatcacatgtagatctgtttctagctttctgaatcacctccactaattttcaaattggctgcacaaggatgtactcctaccagcagcaaacaagtgttcctttttttccaacacctatgccagcatttgtcattttttttgtttttgtttgtttgtgtatgttatatgtatatatatatatatataaataaataaaatatagacattctgattgggtaagataaagtctcaaagtattttaatttgcatttccctgatatctaaatatgttaaacatttttaaatgattttgcatcctgtgtttagtgtatgtatgtttagcattgctatgtcctggtggaattttttcctttaattagtgtaaaatttccctctttatcttctgattagttttggctttacatttgtttcatcagatattagagtagctacactatgcttgtttttgatccattttcttagaatatctttttccatccttttaccctaaaatgctatctatcattggtcattaggtatgtttctcagcagcaacaacaaaaaagagacagatcatgttttctgatccagtctgttaatctgtgtcactttattggagagctgagaacattaaaagtaattgttgaacaacatgcactgatttctgatattttgttgtcttgtgatgttttattaggcttcttttcatccaatattctgaaaattttaaatctgttcgttgtgcgtgaggatctttacccttctctactgacctaagtattactggaagtactctctgtaaagctagcttatggatcttaaatgctttaaatatatatttatcctataacgttttcctttgtcctattatgactgataatttgggtggatatagtagcctgggatggtgttttgggcttttaacaacttgaataacatcattccaattcattctacctttcatagtttccactgaaaaatcaactgttattgtgactttcttttaccattgaaagatttaatatcctttctttattctgtccatttttaaaattttgtatggggaatttatttcctggcccagactatggtgctttgtatacctcttagaccttgatttctttccttatattagggacattttattctatgattctggcgaaaatattttctgtaccttttatgtgagctttttctccctctatacctattcttcctagatttggtcttttatagtggcccaaagttcctgtatcttccattattggaattttttaaatttgacattttctttgactgagtgatccaattcttctacctattcttttagacataatatttttctcttccacttggtctaatctaatggtaaggctttcatctaatttttggtttgcatttctgaatatttcatttcaagattttttattttgacatttttgtcagaagttctatttctttattaaatactattttttatatcttgaattgttttgattatttaatcctgtttttgagtgcttcattctagaattcattcttacctcttcaagttccttgataattctcatttttactattttgaaataccttgttacatatcttgagtcacttttctcagggaacattatgacaggagtattaatattttgtgaagactttttgtttagattattcatgtttgtgtatctgtgatgggatcttgaaataggttgttgtcttttctttgttgaatggatatttgaagctctgattcctagaacccaaagttatcatgcaacagaccagatgaataggacttcctgtttagtctttgtgcactttagtgttgatgtcatgtggtgtttcagaagtagtctcagctaaagcacaagctaagcgaattttctaagcacccaaataagccttctgtaaagttaggaaatcctacagcagatcttcaggagtgttgagggaaggttctcaggactgatcctcaagcagtagatgctagtagaattgataatgcaagcctaggatacctacctgaaggagaggagcagggtaggggaatgggaaacagggaatgagggtgcgtataatgctaattcttggagagtgacagtctttatttagggcatggaaaagggtggacttggtaactagcatctttgattctgcattgacaagcggccagtggtacatggcagctatagatggagttggcagctataatctaggcttttttttttttttttgagaggaggggagcaagggttttcagcatagaaggatggagttagctggatgagtctggcgtttctatccagatgagggattactgaaggtgggtcaaaaggctggaatgggctggttttaattttcttaatgaaatgattacaatttccatgaatacacttctgtttaatgtggtagcagttaagtacattcacttgttttttttcaatttatttatttatttatttatgtcatgcaaatgcatcttctgatcttaggacaatttggcatctgtttctccagacatttcctcttcaccatctttacttttatgtgttttgcttcttaggtcctcctgggttgcctggtccttcaggacagagtattgtaatcaaaggagatcctggacctccagggattcctggacaacctggattaaaaggtctaccaggacttccaggccctcaaggcctaccaggtacctttgtaggtcattttttatggcccatctatttgagaacattcccttgattcactttttacatgcaaatagtttgtctctcataagaatcccagcaaggaaaagaagaaggggctaccacagaccccacttctctttttcttaaaaatgttaaaataatttaggcccaactggatttcttttaactcctttgggcaagctaatttaaatggcttggtggtatgaaaatctatttctttccttgtaggtccaattggccctccaggagatccaggacgcaatggactcccaggctttgatggtgcaggagggcgcaaaggagacccagggctgccaggacagccaggtaaaatgactaaaacagtgatgttggtcatggtatttatgcgttcaaggcctttggatatggggctctacttggagctgacaactaattacctatggagagagcatgaatagctgtcaaatccagagctggggaaaaataggaaggtacatccaaagaaatatgctataccacgacaagcataaatattttacattttcttttatataatgcattagaaatccaagacattcttccccatattcaagataatcacttttcaactattttgttttattttattttattttagtaaggttagacctagggttttagtgtgggggacaggcaactattgagatgcttcctctgctccattcaatgaatttcagtctgtatattcaaattcattaactaccttagaacattttttcatctttcttcattttgtgatattatagaagataatttccccaatagaatgtagtacatatagatgaaaagtttaaatgatcaccatagaactttgaagattgtagtaaaatcttatgcagagaaaatatattgatatacagatttttaaagtcagtcattaccgtattctttttataatattaacttttgtttctgctaaatgtatttcgtcctgttggttttttttttaactcagtctgttatgatataaccatagttggcccagtctttacagtgtagcctgcgctggcccccaaatcatgacaatcctcttttttcagcctcctaagtactgagaatcagtttcttagatttctatcacaagacaacgtaatcacaaaatgaatttgcttaaacttatttttaaaaaccactaatatgattgctaaaataaaagccaggcagtaatggcacatacctttagtcccagcacttgagaggcagaggcaggcagatctcttgagttcaaagccatcctagtctacagagtgaatttcaggacaaccagtgttatggaaagaatctctgtcttgaaaaaaaaaacaaaaaataaaagattaaaaacataataaattgttaatatgttagtaactatataatatagttatacaaacataaagaatatgtattagaaaaagaggatctttggtgacaaaacagtatagtgatacatatggaccttcttagagacaacactgccaattcagtaacctcgtgtttccagagaatgaacaaattagtgacatctttatcacaggcattggtatgaagtgttctaaaagcaaaaattaccacatacacaatagttaaagccctgggtacaaggagaaccacgtggcacattaaaataatgccttttggatgctggagagatagttcagtggttaagagcactgattgctcctccagaggtactgagttcaattcccaggaaccacatggtggctcacaaccatctgtaatggaatctgatgtcttcttctggtgtgtctgaagatagctacagtgtactcatagacagacaataaatcttttttaaatgatgcattttgaaggcttttaaagaatatgttatgtattttctaagcaagtatcatttagaacaattctccggatgtattaaagaaaaaccttttcaacactgaagctattgaacaaagcagctggtgacattaggtcataagattcaaattcctttagtatatagcaagaaaatagataacatgctggtttcccacaggcaaatcttcttcttacctaaaattctgttcaaaaattttagtgcttaatgtcttcagcctattccaggaggaaagaaatgcatttaaatctctttgagggcaaagaaaataactcatttgtctctctacccattatatctgacaatgcttttatagacaccacataaatattgaacaagttaaccaatcactattctttattaatagccacaatagtggcccagagcttgcttaatcttgtaagccaatgatttcgtacaaataggtgcccgtggattggatggtcccccaggaccagatggattgcaaggacctccaggaccccctggaaccacctctgttgcccatggattcctcatcacacgtcacagtcaaacaacagaagcaccacaatgcccacggggaacagttcatatctatgaaggcttttctctcctgtatgtacaaggaaataaaagagcccatggtcaagacttgggtaagaaaaatgacatctaacttctttccatgccttttgtatttatttcaaaaatcttcttaggttctagagtaaccttggacaaaataaaaatgtacaactctattctatggggactataaattgaagagcatatcagagccaaataacttcagtcactataaattttaaatgaataattttaacttcaaattaaaaacattaaaagcattgcagctagtacgaggtatcttttttcttggtttaaagcaagatgacttcaaagacatgtttccttttccttagtctattagtaataaagcagttgtccagggcaccctatagtatagcagctgcttgattatgcactgtttgtaatttatggatggcagattcttattatgcatccccacatgtcttctctatatttagtcaatggcatgaggctgcactgatgattatcaagacctctcgatccccatgatttctcttcttttcttttcttttcttttcttttcttttcttttcttttctcttctcttctcttctcttctcttctcttctcttctcttctctcctctcctctcctctcctctcctcccctcccctcccctcccctccccttcccttcccttcccttcccttaccttgccttcccttcttcccttcccttcccttcccttcccttcccttcccttcccttcccttcccttcccttcccttcccttcccttccctttcgtttctttcctatccttccttttccttcccttcccttcccttcccttcccttcccttcccttcccttcccttcccttcccttcccttccctttcgtttctttcctttccttccctttccttcccttcccttcccttcccttcccttccctttccttcttcccttcccttcccttcccttcccttcccttcccttccccttccccttccccttccccttcttccccttccccttcttccccttcttccccttccccttcttccccttcttccccttcttccccttccccttcccccttccccttccccttcccttcccttcccttcccttcccttcccttcccttcccttcccttcccttcccttcccttccctttcttttcttttcttttcttttcttttctttttttccagtttcagcattggttgataagggctaatcattttatctgtggctgtttatattaaaatctaccctccacttcacatccatgaaaacatttaggaagatagtctaggctctcaccttctgggatatctatggttagaagcctcctaacatcttattggctatgaaagtagttctgagcagcagaacttcggaagtgtctgctgcttattctttttgtttgtttgtttgtttgtttttgtttttgttttttcttttttttccattttttattaggtatttagctcatttacatttccaatgctataccaaaagtcccccatacccacccacccccactcccctacccacccacttcccctttttggccctggcattcccctgtactggggcatataaagtttgcgtgtccaatgggcctctctttccagtgatggccgactaggccatcttttgatacatatgcagctcgagtcaagagctccggggtactggttagttcataatgttgttccacctatagggttgcagatccctttagctccttgggtactttctctagctcctccattgggagccctgtgatccatccattagctgactgtgagcatccacttctgtgtttgctaggccccggcatagtctcataagagacagctacatctgggtccttttgataaaaatcttgctagtatatgcaatggtgtcagtgtttggatgctgattatggggtggatccctggatatggcagtctctacatggtccatcctttcatctcagctccaaactttgtctttgtaactccttccatgggtgttttgttcccaattctaaggaggggcatagtgtccacacttcagtcttcattcttcttgagtttcatgtgtttagcaaattttatcttatatcttgggtatcctaggtttggggctaatatccacttatcagtgagtacatattgtgtgagttcctttgtgaatgtgttacctcactcaggatgatgccctccaggtccatccatttggctaggaatttcataaattcattctttttaacagttcgagacagggtttctctgtgtagcacccacatgacagctcacaaccctctataatcccagttccaggggatctagtgccccattctgacctcagtagatactgcatgcacgcagtgcatgcatgcaggcagaatatcattacatgtaaaatagcaaataaaaacaatttaaatatgaaatctaacataacagatactacaaaacattaatttttttatcactgtgacatttttgttttgttttgttttgagacagggtttctctgtgtagccctggttgtcctggaactcactctgtagaccaggctggcctcgaactcagaaatccgcctgcctctcaagtgctgggattaaaggcatgtgctaccacgcctggctcactgtgacatcttaatatataatacagatcgaaaatggaatccattcagtattattttataactttccaaaatgtatgtttttggtcaattagagtttgttctcaaacttggtaactataaactattcctatcttgatactctttaggcctggaacagaaaaagtctataaaaaaatagctgaaaatatccaagagtagtatttattgacaggactttgctgaggcttgagttatgttaatgaataaacaaagaatgtaaacaacgatagctttgatgttaaatattatctgatggaatactttctggtataaattggtagaaggactacattatgtttttctaatttttgtgattatattacaattgcatagttctgccttcccttttccccttctaaatttgtctttgtcacacacacacaaacaagcatacacacacatgtatagtgtgtgaatataattaatataatatatatttataaatgtaacatgttcattccatataatgtaccatatatacatgttttcagggctgacctttcggtattagataaccaattggtgtgatcttccctggaggagacaagctgaattttggaatttctgtctgagagggagaaaagaaatattgaaaaacagtaatatgttaagaccttgttatttgggatatgggaagagcgtgatatcatggtttaatttttttgacactgtaatagtgattccatactcttataggtacccaaaaagcacagacttgtttaaacatcatagtcttatcattatgggactttctcttatgcacattttccattgttttatgagaccaggtgtatttacagctgtgtactaaattggagaacagattggcccttggtcctgacaaggctggatgccccagtgtaggggaatgccaggacagggaagcaggagtgggtgggttggtgagcagggggaaggggcataaaataggggggttttggaggagaaactaggaaaggggataaaatttgaaatgtaaataaagaaaataatctgataaaaatgaaaccaaacaaacaaaaaagttactgtatcatatacataaaactatcaaaccctttgtctaacttgatttcgcaagaacaacaaagatagaggacaatttcccaaaaatttataaacaaagaaactggataataggttaaatcagttaataaaagccacacaagtaatagatagatttaggacttgaacacaaaccatggcaattcttttttcccattactttatttatttactcactttacatcctgattgaagctccccctctcctctcatatagccctttccccatacttccctctacttcacctctgagaagggagaggtccccctgagtaccaacctaccctggaacctcaagtcactgcagaactaggtacatcctcttccaccaaggccagataagacagcccacttaggggagtagaatccacaggcatgcaacagacttaggataatcccctgctccagttgttggtggacctgcatgaagaccaagatgcacatctgctacatatgagcaggggactgtgtttagcccttatgtgttctttggttggtcattaggtctctgggatccctcaagggtccatgttagttgactctctttttcttcttgtggagtccctatcccatttgggttcctcaattcttcccccaactcttccacaagactctgtgctctgtccagtgtttatcgatgggtctctgcatttgtttctgctgggtggagcttctcagagggcaattctgctaggctcctgtctatcagtctaggctgacagatataaacatagctggaactccaaggtagttgaaggaggaaagcagggctataatgtgtccctactgatcctctgaggacagcttggcacatcccttccccccccccaaaaaaaaagatgtcaggattgcattcttttgtctgtcaaacacagggcacctgtgtatccaggccagaagtgacaatatagctgtcaacagtgtcttcacatgttgtatcattatgacaaggctttaaccaacaaagagtcatcacagtctcatagtgtgtccctgtgaactgtagtccctgtgaacccaatatctgtgcagtcacagaagtgtttcctctatgcatagatagacctctatggagatatgtctaactggcacatacatcaaggttgtcttcacagtggtctccaaggaacctctttccataatggcactgtgttccaggatggaatcaatggctactcctgttcctgtgtgcctggataccacagtggcaattctgaatctgtccacttttaagttgctcaatgctgccattccctttcatgtgatcttgaatcaattacttttctttcagccaattttgtatgctgggttacttttttcaactaaatcaatgactttcaagctgataacctttgcaaagatccctaggcctttccagaatctatcacatactaattccaaatgattgagggtaggtggtcagtgctagagattaaaccgggtatctcaagcatgctaggaaaaccttgtacaactaaaccataatacagatctataatttccaaatgtttctgattcttaccagtcctcattttgagaaaaatgtagcccttcagacacagaagaatatactcattttgttgttggtggtggttttttggtttttttgagacagggtttctctgtgtagccctgtatgtcctggaactcactttgtagaccaggctggccttgaactcagaaatctgcttgcctcagcctcccaagtgctgggattaaaggtgtgcgccactactgcccagctaatactcaattttcaaatcctcatttcctgtgtttactttctcctacagttgatctgtatttgaggtggttaccttttctacacactcattgagcatccatcgtcttttattttatggaagaattcatattcaaaagaactgtttaaactcattaagacatagttttggaggatctggagaaatggctcaataattaacaatgtgtactgctctagcacaagatccaaatttggttcctagcatacacaggctgaactcctcacaagtacctgtaattccaacttcagggtatctaacttcctcttctagtgtctgagagtattacactcacatgtacaaacccacatacacacacacacacacacacacacacacacttcattaaaaataaaatctttaaaatgaaaagaaaatatatttgggtggcactagaaatatagctcagtaacagagttcttaagtagcaactcctaggcctggttttaaacactacaaaaaaaatcaaaacaaaattagaaaaaaatatttctaacaaaaaaatgaatgtactcttcgtttagtaatttaaaaggtgtattatatcacttgtgagcgagtaattgtagtaacgacaggtcaaagcaaaaagtttaacatataaaggtatttaaatttttatttcaaaaaagaaaaaaatagcctatttaggctgttttaccactgtgaaaaatgcctgagaaaaacagtttaacaaaatatagggtttattttgtcccatagtgtcatagattacattccatggtcagatggattcattgtttcctggccttgattaggcaaaacatcgtgatagaagggtatgaaagaatggatatattcatttcctggttatcagaaggtagagaattgaaggcctatactggtaggctttcttctttagctttctctttttaatccttcttcatccccaacctgttggatggtatcctccttattcaggatgggctttccttttttttttttaggacattttctttatttacatttcaaatattacccccatttctcgtttcccctacaaaaacctcctaccccataacccctccccctgctcaccaacccactcactcctgcttccctgtcctggcattcccctacactgggacattgagccttcacaggaccaagggcctctcctcccactgatgtccaacaaagccatcctttgctacatatgcaactggagccatgggtccctccatgtgtactctttggttggtggtttagtccttgggagctctggagggtctggttgattgatacttttgttcctccgatggagttgaaaacctcttcagctccttcagtcctttctctagctcctccatggggaaggggaaccttgtgctcagtccaatggttggctgagagcatcaatcactgtatttgtcaggcactggcagagctactcaggagaccgctatatcagggtctgtcagcaagctcttgttggcattcacaatagtgtctggttttggtggttgtgtatgggatggattcccaggtgggacgggctttccttaacacttccgcagacacatctaaagatgtgctttactaacatcgtagtgatgagggatgtctcagtccaccgaggttaggaacctagattaaacaatttaatcttgactttcctttcctttgttcttctgaaagttttttccttcttcttttatatttatttaccttttggtttatctctaaaactctctgtagttggttagcatttttattaatatcctttatacacttaaagagattgctaacccacacaagataacatattgaacatagcttagaaaagggaacatcatggaacaagacatgggtagagctacaaagactttgtgtgtgtcatcctttattactgaaaaaatgtataaattttcatcaaaagacaccattatttataggatccataatcaattaaaaaaacactggggaatatgtaatgatgcataccaacaaaatctgcattcattgtaaaatgtatcttgatttataagtgataaaatgagtgagtcgtagggttttaaaaattgttgtgtttgttttctaaaaattctgcagcagtttcattgtgaactgttttattttatggctgtaggataaactaaacatcataatgcagtccttcatctttttcttttcgattcatcataggtacggctggcagctgccttcgtcgcttcagtaccatgcctttcatgttctgcaacattaacaacgtttgtaactttgcttcaagaaatgactattcttactggctttccaccccagagcccatgccaatgaacatggaacccctgaagggacagagcatccagccattcattagtcggtaaggcactggtttagctttgacatttaccaattaccccttagtttagctagtaagaaatcagtgtaaaatggataatccatgatactcacccaagttaagtatacaagagtgatttttaatattcaacccaacattttagtttgaactatatttcttagagatcagcttttgactaagccctatgcaaaatattttaataaaaagagaactcagtcaagttattatgcaaatatccccatgtatatttcttctggtttttactaatttgggatgcatccagcttagaccaagtgctacaaaagatcaaactggaaaaaaaaatggaaaaagtataaggaaaggatgtttaatcctaagtgaagaaatctggagatatatgtctcaaagaaatgtgttttgaactggtctgtctttggtagattggtaaacaactagacacacatacagttttaaagggaaagtcatactaaggaaagaaaatgagaatgggtagtatatgaatgtatctagaatgtagtatttaaagttttcataggagaaaaggttagaagttagcttgggcacagatagcagaatgatttcactgccaatttaaagcttggaatttatttagtgcattataatgagtagcactacaagccctcaaccaatatttgggataaagttcagggaagattaaggagctatcagtgcacttgaattgtatagtgacagtcgtcaggtcacactgaacactattgctatggtcctgaggtaactggattagatcttgcaatgggaaacatgcatcccattattggagtaagctaaaattgggagttgaagtaatagatgagttttggcatgcttttaactaggccgggtcctagcaaacacataagtagatgctcacagtcagctattggatggagcacagggcccccaatggaggagctagagaaagtatccaaggagctaaagagatctgcaaccctgtaggtgcaacaacattatgaactaaccagtaccccggagctcttgactctagctgcatatgtatcaaaagatggcctagttggccatcactggaaagagaggcccattggacacgcaaactttatatgtcccagtacaggggaatgccagggccaaaaaatgggaatgggtgggtagggaagtggggggggggagggtatgggggacttttgggatagcattctaaatgtaattgaggaaaatacgtaataataaaaatattaaaaaaataaataaataaagtaacaaatagatgttggtaccattaacggagatgtcctggtattttccatattgaatcaatcacttgagcatattagatagtgctattttcattgtgagcctgatgcaaggttctagtaaccacaaggaatgaatcattcattactgatattgactacaaagatgtaacctagtttggcttatttgcaaaatcattgtttcctttgtagcatagctacctaaatctctctctctctctctctctctctctctctctctctctctctctgtgtgtgtgtgtgtgtgtgtgtgtgagagagagagagagagaaagagagagagagagagagagagagagagagagagagagagagacatatagcatgcaagtgtgtgagggagtttttttcagtttcaactttatggagtaagagtttccataatatataatgaattgtgtagacaaattttgctaaattgacctccattatgtttcaagatgtcccctcatgttctttattaaagttttgatatgttcattaacatgtattctgtggctgtttttacttactttgtcatttttaaccacatctccgactgcctgggcacctgcccagctgttttgggtttgttgtacttacccaaatatggccaaatggctaataaatgtctttggcagaacaatagtgggtggatattgagaaaatatctgctttttgtcttttccagtttactagacattcttcttaccacaataatagcattactaagtgtctacctcaagttgggccctttgacagcaagtatgtagaacacactaagccaaactcctacatcaattatcacatttactacagcaagtgtgaatgcaaatttatgtcacaatggaaaataaaaatgcaatagctgtaattctacaatgtactgaaaggcttacagtttttgcttataaatgcattatgcttgagaaaagagagttcttatgcaaaaaaaaaaagattgtcaaagtgcatttttctcctcttctaatcactgaaaacagttgtcaagggcctccataataggaaggtttctgaagaagagcaattgctgttttctacgccctcactctgtaattcatatcctctccccctttcctttaccagatgtgcagtgtgtgaggcgccagctgtggtgatcgctgttcacagccagactattcagattccacactgtcctcaggggtgggactctctgtggattggctattccttcatgatggtatgaaacacccatcttcccttttctcatcacagctgaccttctatataagtacatttctcacaacttgaaccatcactgtcacttgcatagtaataaaaagctggaatcttaaataacctctgtccaagcacagtgctctcccacccgcattttctagagtcagtttttataatatgccctttgcttttgttgactgtttttgatgcagatacagttctcttacctttactcatagtcaaattcattgcattctaatttgtggccaggttaggtatatattattgaataatcactataatagtatatcacatatgtgttgttgaacattttccttatcttttcagcatacaagtgcaggagcagaaggctctggccaagccctagcctctcctggctcctgtttggaagaatttcgttccgctcccttcatcgaatgtcatgggcgagggacatgcaattactatgccaattcgtacagcttttggctggccactgttgatatgtcagacatgttcaagtaagttccttatggctttagttgaaatctaaatgtttcttcatagatactaggaaagagagattctattaatgggttgtttacccctagtaaattttaggaatttgttggagcaagtttttgagtcttacctcgttctccacatgtaactaacttgtaatacaaactttactttgtcttgtaactgtcgttacaggtggcttagtattagcctttcaataccaaaaacagtcaggagttgggatactaaagtgataccatctcaagaagtgaaactataatgtataggaacttataacataatttttgtgaatgtttttgggcacatcacctgagtctttgagggatgaaataacacataactctgaatatttcaatctctttaagtttgtctttatttttatgtattgcttttttcttggtatttttatttaaaatcgtattacgtattgctcataaactggctaaacttctcccatactataatattaagaatggttaaaaaatacaaagaaacaaatacataaaaataacagtagtggggacaatggtcacaaaaaatacatgtgacgatatagagaatgaagtttaaatatattgtggagtattattctgccataaagtattaaattatatatgaaactaatgaacatgatattcaaaataagccatacttagacaaatatccatattttctctcttattcctggactctgggttttacacacacacacatatatgcacacatgtatgcaaatgaagtgaaagcaagattgtctgggaaaagggaaaaggaaagggactatgggaatgatagagagaaagggaagggaatgggggatgaagttatattgtaagttttctttatggaacacatcactacatgcaatgaatgcaaggcaacaaaatttttgttgcatacctgtgatcagtagtagatattaagccatagcaatcaatgtatattaagagattaagggcaaacgtgatattgctcagcaggttaagacacttgcccctaagccccacttagttatgtgccttggacccacacagtacaaggaagagagcaacttctacaacttgttctgacctttacatacatgctgtgacaggtatacttggacatactgacaggcagatagacagacaagcattttaaaatgaaaacatacacttaagtcccttgtaaagctgtttaacaggaggagaatgtctaaatatgaattcatccctataatagaatttaggtagcaaaaatggaaacacaaacctgattgtttcattttttttttatttcctagcaaacctcagtcagaaaccctgaaagcaggagacttgaggacgcgtattagccgatgtcaagtatgcatgaagaggacataacttgttgaagagttccttgtgttttttttaatgtgattatatatatatacatacataaactattatatgtgattcccaggatgcaatgtctcactcactctccccacctttaccactgctcccaccaatggtgctaatatcctctatgacgaagagaacatgctgactagcaaccatgaagattcagatgtacctcagcaatgtgccagagcaagggctccatccttccttatgaaagcaataggaaagtgactatacttctggggctccaataaattccttcaaggattgtaaggcgaagttcatatgctttgcctagttactgaaatggcacatcaaaaattcaatgaagagaagagttatactgagtaaaagtactgagtgcggtttgaggaagtattctttttcatggtgctactaatcctaatgtaccacaggattttaataaaagagtgttcatcttactttgctttgtaagtaaaagaaatgtgtatatgctgtaaacaacctcttagttcaaaatgttgagtcatttagatgtgatctggcataaaccctactttactgaaaaatctatgaaatcttactctatagacagcaagatatacatgtgagaaaatgtatcctttcatcgagttattactgaaagcaaattaattgggagtttttaaaaaaaaatttaagtaactttgaccagaattttagtggttcatataaaacttatcaaattatcatatccaatgaagcaatctcttattttatgtcttgttttacttaatcctgacagttttgagaaaaaaaataccaaattaattaataattcttattattctggtgctatgcaagaattattctcctgtgggctcatttgtgtaagaagacagtatttgcttagtcttctcccttcaattagaaaaagccaatggacttttaaaacctttatattttaaacatttttattaagaatagtcataggataccttattttcttaactgtcatcttctcactgaattttttttaatttaccagtatcaacttaattaaagatatatgttataattatggttcattgtctctttctttagcataagaataaaaccatgttcattt

SEQ ID NO: 684 - DNA, 213851 bp, mus musculus; identical to SEQ ID NO: 683

SEQ ID NO: 685 - DNA, 213851 bp, mus musculus; identical to SEQ ID NO: 683

SEQ ID NO: 686 - DNA, 213668 bp, mus musculus
cgcttccctcttataaatctcttcccccaagtgcaccagcataaccgggacactcactgtcccctttctagctctcttctcaataacccttcaagattatgtcaatcggtctgaagggacctgggattccctgcgggtgctgacggagctgcgggagccagagaagaatgcaagtgcgtggagtgtgcctggctgccggctggttcttactggccctgtgtctgtgggggcagcccgcagaggctgcggtaagtcctccctcccgccccatcactgctcgctccaacagaaaccactggagcctttaccttccctactctttgaccttggccagggaagtcaaaattggctttaagtagaaagaaatataattcccaactctggtctgagggaaaattccaagtgtttaaaaacagggccgcttacttctctgtagctacctcttctggggcaagagtgggcagagggtgtgggaggcacattaatgggtcactgggctctggaggatatttaaaacttttcttcctctctatcccccacccagggtagctgtctaccagctagcttctttcactacttggacccagcccaagcacgatttaaccttggtttatagtttaaaatttggttcctctaaaattgaactgtggtcagtgtggtaatagccttgatggagttcttctcttggcatatgctcttttcttaagccacatgaacccaccccccaccccaggtttgtaaagttctgccctgttttctgacctgttgacatcattcttttacaaaagataaaataacctatcaaccaggacgaagtaaagaagcatacatagtcttatgcttcaggagttttgcacattaaaaaaaaaaagttatgggtttctgttggcttgcactttttaaactcataaaggcacctgaacaacttgagagtttgcctttcacccatttaaaggacaagaagtctcagttttccaatgggaatgagctctatgggttagaagagtgggggaggatgctcacacgaaatgacagagcaaaaagttccacttgcctttaggaatgtagactggataccacagcctgttcctgagcaggaaatctgggtagtcccaacacccactctccttctggagataagaggtaaatgcaaaggaatgaagggctttgctgcagaaaatattctccagtttgaagtctaccctacttaatttcatataaactgtgaacaactaaatgtgtgacaaattatttaagtattatatttgagtacacagaatggatgtttaaaaccacttaaatatggcatcatagcttaggccttcacatggtggagtgactatcaatcctttagacgcagctacaatattacagacatctgggtctacatcaaagttagcttccttttggactcagcacacctcagatcacattgccctctgtatatgctagaaaaactgtgtatactgctgttacaaaaagtaactttgatgttattgtaatcacaacataattatgatagaaaatctgtgggaaaacttgcacatctaaaatgttttagttatgcataccatcattttcctccatcaaagtagatatacgacttaataatgttcttttggtgcagagcatttttgatggggtatggtttccgcagtcaatatggctaaagatggttagaataaattataattgggctatagaaaatagttcatttgaagctcatcttagtgccttttgtttatagcatttgccctatgggcaaaaactttgtggatgacttctgaagcaatccttcctcttagttaccatttatacttgtgtgtataacaacactgcatgccagttgaaattcatttatattaaaaataagatttttttttattgacaaaacttatgtgcaagcttactttcgtattcttaaagtaacaagtgtttgtgaagtaattgggatttccccctcctatacagttttgaaaggactttttagttcacactttcctatggttagaattttgttcctcttttaaatctaggggtttgttgttccttcctcacaaataaatgccctagttaaatgaaagttttaatcatctcaaaaatatgaatggtatctgctctccatacttgtgctgggggtattggtcaccttctccagagtgaaacttggctgtacttggcttagtttttcaccaatgtcttctaatattgaggcttttatatcaggaagaacattacttcttaaattaatttactttttcatagttatatgactttactatctctggagtcatgccaaatttagataacaaaaatatgtgaactttctttttaaggtagaatgtttattaggtagaatacaataacccaggtattgaatggtcagcagcaagaaaacagggtaactttagtctgtaaggatcatttttagtgatagaaaaaaatcatatttttaaatgttaaggtgactatggctatacaaactctgtcaaagagataagcttgtagatttaatgatatgtctataaataatatggagaattatactacttctaccatacaaatgtttgtaagttatttttgtttttcttggaagttatagtattatttctacaatttaaaccatactgtgtaccttgtgaccatttataagaacttgtcaagggtaatagcaaggcttttggccattttttttctatgaaatgttctattctatagaaaaaatgctcatcttgctttcattattgtttgtgtttacattgttcagtgtttattatgtgctaagtactatgttaggatagtaagacaaattttgatatttagtcctttatgtgatgctagggattgaacccaaggttccaagtgtactgaatttgctctgtgatttgttttcttaagagagtactaatgtatttgtgtgtgtgtgtgtgtgtgtgtgtgtgtgcgcgcgcgcgcgcgcattaaaagctacttactagatgagaaaactataaaacagaggttaagcaacttgctaaaaatcacataggttgtgaatttcaaattcagagtttgcccctaagtcccttatattgtctcctttgcatgtaatctatagaattatgctatgttaacatatatatgaatctatattacatttttttagacacagaagatgcagtgttggtgataatggggtttgcttctattactgcttattttatgtaaagtagtatagcataatgtaaataaatttactttttaaagattaatttgatctctatgtctatgcagactgagatagtttaaatgcaatctaaaagcaatcacaggttaaatgattttatgtaatctcaataaaatttagatttataaaacacctacaacttctgatagatgatttttccatgaaaataattgacctatgtttcttttaagcttcctcagttagtttgaagtatgcagaaatgtccagaaatatgcctgttgtcataaataggaaatatatggtggtacagtcttgtcaaaaatgatcaattcactttgttgttttttactaactttcctacaccttcatatgttgttttgttcactcaaccatctatctatctttatatatatattattttgtagttttaataatcaaattcaggacattgcacccactatccgaaatctttacaatatacccccacccccagctctgtgtctacagtattatgtatatatttctgtatgtacccatcgtattatttttttaacagtgcataattttccgtgtttttacttgactcttgctgtttgcaagatatgatactctttttaccttgaattacccttgacaaattggttagaatagtgtctgccaaatttgtccactacaaagtcgttttctttcctttataaataagctgatcttattagactgtacagggtgatattgggagagagtctaggaagccaaataatctatatctcatgatagtttcttcagaaattctagcatctgttaatgtttctggcattagtgattgttgtagttaaatttgccaaaggtgctttcaattttcaaaaaatttctacataaaatatcaaattttactataatacattttcactgttttaaatttactatataattatttattcgatatgtaacaaaaataaatattttctttatttttatttataataaattattattttattacaagtatttactgaaattattataaatatatacagaccaggagtctattcacagctgtttctatatccttcaatgtgtttccatcagctttgagcatttcctctattactagcatcataaaatggtcatctcctttccttcttctaatttaggaatgagccagttcaccaatgagtctattcttttaacaaaatagaggtatttagaaaccaaggtgtggatgcttggcatgctcattctgattgaactgtcattttatagcccttttcagcagacaagcctaggaaatgcatactatcttagttttatctataatcctatcacacacacacacacacacacacacacacacacacacacacacacacacacacagagctgtaggcaatgtacctaaatggaacaatacatacatataaatatttgcttctgacatcaatctattagaagctttctatatgttggaaattataattcataacaatatctcaaattgtagttaaatatcactgaataaacacacatatttgctgtggtggggtctcttgttttgggggctttggggagagggtaagggagatgctgggaattgaaccccagaatcttgaacatgctaaacaagtccttctgcagttagctacaccctcatctacaacttgctaagtctgctccttcattctctacatggctttaaaggcatgtcatgatatttcctgtgattcagctttcttgtacattactttttacagtatactctttccattgtaccacatgaaaggttttctaaaacacactacaggatagatattttggttctctttcttgcttatcagcctttgctcagttctaacaaaatagcatgttacattttcagcagatgcatattgaactcctaataacaaaagagttgtatttatactgttctattcaggtaatatgcccacaacactatccctgcacacatctctctctctctctctctctctctctctctctctctctctctctctctctctttctctctctgttagacaattatcaataaaattaatacaatttcctgctttaatggagcgttcttgtttctccataataccacagcaattgatgattctacctttctttgaacaaatgtaatatttagcattttttagactagtctgtgcttgatcattttattttatagaattttttgttctctttattatattatcattatttggaggcaataattatatgctccctatttaaagagtttttgctgactgttttgtctatgacaagtgatatttgatcaacattgggaaactagaaaataagaaaaaatataatggaacaaagaaaaatctgactacaattctactagcagtctagaaataccttctattacctttggtgatttccccttttatagacatagtttttaaaaatagtttaagtatgggctcatactttgtgcaatttaattttagttttaagttacaaaatctttatcttagagtatgaaaagtctagtttaaaaacattaattttaagtagcttctataaatacaatttatatttctgcagaccacaatttatgcattcaacttcttgttttcttgttaaggcaggatctttctacttagcccaatcttccctccatcttgcaacccttcttctccagacttctgagtgtttgaattacacaatacaccctccactgtcttcctacttttgtaagatatatttttaaaattcaagattttcactattttaatcagttattccatgaacatttcttttttatttttatttattatatctaagtacactgtagttgtcttcagacacacaaggagaggtgtcagatctcattacagatggttgtgagccaccatgtggttactggaatttgaactcaggaacttcgggagagcagtcagcactcttaattgctgagccatctctccagccctccatgaacatttcttattttgtattttaatctctaactattactgcctctatcctgagtaattaatgtgttaaacacttttgctactttaattctttgaatcattaattagatgctaataatcaggaaacatatctacacataaactaggcaaacttttttagcaatgacatttgttaaggaaatagtgctatttttactttttaaaaattatattctctgaacactagaggaaggcagggggaccctgaatagcaagagtaggattctgggaggcagaggagaacacagcatacagaatcaactaacctgagctgatatgggctcacaaagactgaagtggcagtcatgggacctgcatggatttgtgctaggttccctctgcataaactctgtggttgcttagcttggggtttttataggattcccaaaagtgttgggggaggtgtctctgactctttgcctccccttgggacacttttcatcctaccgacttgccttctgaagccttaatttgaaaggttgtgcctagtcttattgcaatttgttatatcctattaggttgatagccctgggaggcctgctaattttttttctaaagatctaggggagagggtatattggaggggtggggggagtggaggtatgggaggtttcagtaaggatataacatatgtaaagtataacaataaaaataaaagcactacaacagcaaaatgttatatttatttataattgacacataaagcatatacataaatatactgctgtgtggtgttttaaaatgtctattcagtttccctatgtactttctgcaacctctggaaattactctttgattagcaaattctctgatcttatttatagactgtgtaggggagatttttagtatgtgtcttaatgtgccttacttttttcacataacataacaaattacattcctcccatgttgttgtaaggacctgtgtttgttcttttatatgaatggataatattcagtgtatatgtgcattgcttcttttttcattatctaggaatggacacttaggttcattgtattctgtattgtgaaccatgctgcagtgaccactgatgcatagatgtcacatacagatttaatttgcttctgttatatactcagtattgagactgccgaatcagataataggtctacttttaataattgaggaatgcccatacattccataatggctggtttaacttgcactctacccaacaatgttccacctgctgcccttttctctgtatcattgcaagaacttactgttttgcgcatgcatgcatacgtgcatgcgtgcgtgcataggtgcatgcttaggtgtgtgtgtgtgtatgtgtgtgtgtgtgtgtgtgtgtgtgtgtgtgtgtgtgtccgtgttcatgagcatgcatgcagaggataaaggagggccttgggtgccttctttattatctccatgtattttttgagacagggtctcttgctgaacctgaagttcaacttttgggtaaggctggtcactgtgtttcttgcatccttctgactacatttctcagtttgtgagttataggcatgcaaagtcattcttggcattttttgggtgcctaggatctgaaacaaggtccctgagctttcatagcaagcactcttatccactaggtcatatcccagctccccccccccttgtttctttttttttttattatgtattttcctcaattacatttccaatgctatcccaaaagtcccccacaccctcccccccgactcccctatccacccattcccattttttggccctggcgttcccctgtactggggcatataaagtttgcctgaccaatgggcctctctttccattgatggctgactaggccatcttttgatacatatgcagctagagtcaagagctctggggtactggttagttcataatgttgttccaccaatagggttgcagatctctttagctccttggatattttctctagctcctccattgggggccctgtgatccatccaatagttgactgtgagcatccacttctatgtttgctaggccccggcctagtcacacaagggacagctatatcacggtccttgcaacaaaggcttggtagtgtatgccatggtgtcattgtttggaggctaattatgggatggatccctggatatgacagtctctagatggtccatccttttgtctcagctccaaactttgtctctgtaactccttccatgggtgattgtttccaattctaagaaggagcaaagtgtccccaaaggtcgttcttcttcagtttcatgtgttttgcatcttataccttatatctcgctacaggatctcattctgtagcccaggctaacctcaagatcatgtgatattctcctttttgcccctcaagttcctggattacaaatatgctcaatttttatctgggttaattgattttgttctactgaattttagaactcattatatattctaaatattaaccacttgtgtgatatatccatgtaaattatcttgtctcactctgtatcgtatctatttattgtcatgattgtttcattcctatacctaaagattttggatgatataatgcttagtctttccttatgtgtgaatgtttatgtgagtcacacagaagtgaactgtccaaggtaagtttgtaaatgtgattaggacaaggtttaaagcgttctgggattatgatctgatcctaagattattccatacatgttaaaacagaggaatcaaagtatatcaaaaaaggtgggggtgtatttcattggttaggctgttaaattctctccaaccccccataattccagctccaggaatccaataccttctgtttacctttatcccttccataattcctccctatgattggccattttacttgtgtcatcatttaacaacattttattaaaactatctagggtatttattcacaaggacctagattcaaattctgcaaattttacattccctcagttttcttccttaagtgaaagagcccacccattttaaatggcactttctttttacctataataaggctattatgaatctcaatccacaaactgtctacctctcctagggaagttttgtgatgcatctggaatgtaaagcttttctaccttcctccctgactcttttcactactccaccattgaagcctagtaggtttttccttaagtagctgtgtatttgtctatttctttttctctctttcaccttaccttctgcactactccagaagcttcactctgttagtctatgttatccttgaggcaggaacagcagaattaaacttgtcaggatgtttggaacatgtggctctctatccattcgtaccattcctacttggttttctctctgtgttttctcaatacataaatggcttcattgcttgcctgccaactttgtagcttctacaattaaaatgtattcctctacaaagtcacaaactgttgtgtaattacttctccaggtggcatttaaataggtgaactttcagtgtctgaatgataggtatctgcttttgccaaattacttttcaaaatgattttaccaaataaacttctacccataatttataagagagcctaggagataatcttaagattattttctatctactacagggactatagagttgacgctcaatttacagccacttggttggttgatttggccctatcatctaatgattttctttttaaaatgtaatcattctatcatttcatccccttatttaacgtagcaaacacggattgaaagtcattttccaaaatatactcttgttaattaacattataaatgaatcacccagacacttagctaaatctttattacaaaattagtttgggatttttaagagaagaaaatcttaaggggtattggagagacatcttgactgtgatgtctgtcacataggctcctttaattttaggaatccagattctcattttatgcatgaatgcttgaggatatttaccttcataatttgtgcaggtccaattgtcctttattcctttagcagcttctgctggcctttaaccaaaaggcaggatggtgcctgccactttgttgaaatgggactcttgaatcccttgttatttgctaatggaagacaatcaaaggcaaattctacaaatgaagcaggtttctactataattaattctttaattgatcatttagtcacaaaaatctagcattggttacaaatggatatagagagcaaaccatcatttataaggaagtaataatctatttaatcaaattgcatttttcatagtgagtaattaaataagactaagcaattaaatcaaaatatttgaatattcctcctacaagtcaaagaattaggtttaattctagagttttttataatgtatataacatttagtcagatatttggagaaaagtggccttaagaaggagagactagggactggagaaatagctcaatggttaagaacactgatggctcttccagaggtcctgagttcaattcccagcagccacatggtggctcacaaccatctgtaaagggatctgatgccctcttctggtgtgtctgaagacagatacagtgtactcatataaataaaataaataaataaatcatttataaaaagaaaaagaagactctaaacagatacgtggtggtgaacatctttaaattccaatattcaggaggcagagacaggtggatctttcagaggccaccctatggctctctaagccaaggcccgagttgtcaaggtacaggcatgggcattttttaagtcaacttagcagcttatagacatggaaaagggttgcctgactatattttcattctctagccatagtctgttagtctcacactcttagtaaacgttggattctggaagagatactaaattttcataaattttatcatttaccactaatttaatattttaagcaagatcaaattattgtatgaatttgaagacatgagtagatataattttgtgagattaaaatgtactcacttgctaaacttttaataaatgccatttaccaaataatttttctcctaattgaatccacttttttttttttaaaagaggccagcctagtctatagggtaagttgtaggatagtcaggaatacacaaagaaactctatctcatggaccactccctaaaaaaaccctgagacatcatgaaaatttatgatatttcctatatattctctatttataagactattctttatttcttaaagaaagggaagtccttctcacagtctcactatttaataaatataatatgatttccttttgcatgcaagaaagatatattaatgcatttatatcagagtgctttctgattttagggttgaatgtttaaattttgtggatttattactcttttaaataagtcttctgtaaggatctactaatccttttccttttatgtatatgactgtatggtatatgactgtatgatgcatacatacacacatgtatatgttgttgttgttgttgggaaccaattattggtctctctgcaaaaacaatacatgctcttaaccaccgagtcatctctctagcactgtaaataagtcttttaaatgttactatgttttaattttaatatgatggtgttagttactgttttattgctgtgaaagacactgtgaccatcgcaagtcatataaaataaagcatttatatgaggccctctttacagttttagagggttagtccattagtccatgatcaccatggtggaaagcaaataggcttggtgatggaacagtagctgagggctttacatcctgatcaacagctaggagagagtggaggggaggggggcctggtttgggcctatccccagagacacagctcctccagcaaggtcaaatctcctctaacaaggccacacctcttaattcttcccaaacagttccacttactagggaccaatcatttaaatatatgagcctgatcctgggtgcagttctcattcaaactaccacaatggaaccaagtggtagaaatctttaatctagttattttaagatggcaagaaagtccagaaactacaacttttgtaatcatttgctctacagaaaacaactaaattattatacagagaacacaaagaggttggtgaaatatgatgctagtgccatgcagaggcagctgtggaagatgtctgttcagaaacttgtcctagctcacaacagtttagtgattagaaagctgtgaatgtaatcttgtaatcttatttatcttggtggcacagagccaataccagacagaaaatggaaatattgagttatgcttatcttttctgctactttcaatagaatttccaatcaaagagtttgttctccatgctgggtattaaaagaaacattctgattttataaagcatagcagaagtagctgttaggtgatcatagcaatttttaagttctaaggtggacaaaagtttatgaaaccagaattcttgtcttgcacaacatatagatgggtttcttatttataatttagtattagtagttgttaagtgagtgcatagtttgtctggggaaatatcaatttatttgaaatatgcccagaaaaaaaatgcccacctaaaaaaaaatcaatagattaacttacgggaactttcaatatcaaaacttttctaaaaaggcatttttgtatatgagacaagtccattaatcccaggaaagtaaaacacaaaatagctacctaacaactgcaccaaaactcaacttcatgtaccatttctctacaaattttatagtcatattaattcatggattttgtatttattctatagtaattttgtatatatctttccccttttatttattcttttctcacatattacatctatgcatgtcttatatgcactgtattaatttcatatctgcatgtatttgaatagtatgaatagtattcagtttttaattattaatgattaggaatacaatagatttttacctattgacctatttgctgtagttttggtgaaattaattttaacatattttatagggttttcatcattatgtgcatgattatgtcagctgtgaatcaatataaatttaccaaccctcccccacagccttaacaatagaacctaggactttatgcatcctagggaaggtccctaccattgatttccaaccttagctttctttatagtgttctccttttgcaactgcttttttctccctgattttattgtccatggtatggcctttataagaagttacctttcctaaggcttaaaacaaattttccacagctatccagctttttttatggcaaaagacaaatgtagaaggaattattggagcaaaatctgcttcagcattaagaatattatagagttatctgtgttgtatgaagaggttaaaggtcaatgttgggtgtctttttcaatagatctccatactatattttgacatagagtagatgggtggccagtaagaatatggctatgcctcgctccacatcaccagtgttgaggttacaggttcctgtcatcagacctgtgtttgacatgggtgctgaggatccccacttgtgcatcaagctttgcacccactcagccatttctctattctttgcatttacacttttaaacataaatcctttttatttgtacagtcttacagctagaagttgtcatcaatgtgtgaatgcttgtatgtatgtatgtatatacatatgtatgtatgtggatatgtgtgtatctatttctatttacacatctactcatacctatagtataagaattagctcaagaacagtgatcatattacatacttctatactttgcatcatctagcatacttacattaaattaatggaaaataaaaacttagggttaattacttttctcatactcaaagtatcatttttaactataggatagtgctatgtgctgtgatttttataaaaggagaagattgggatcattcacataatatagagaaacactgtatgctttaatttctttttatgcatttattattattattattattattattattattattattattattattattatttacaatccagtcattgaccctcctggcttatttctatgaggaaaatgtatcctaacatttctttattttgacttagctttatcttgtagtgcttgaaaaatgtcctatgttaatatattttgagccagttgaagttaatatagcctcatgaagctttctacaataaaaaggtatatttcagctttgttatcttttctgagtagtttttctagctggctataaataagccagtttgttcagggtctataccaatggtaattttcagattttctttctctttttaaaataatacagtcatttccttttacatgagatttttaaaatttagctaaacagtctcctgccccatgttaaatcttttatcttgtaaatgtttatatacccattttgtgcattttctcattaacacaccatgcttattttctaaagacactttacaaacttcataagaagagagataatatatttctcccttcctgttctcaaaatcgagtgatcgttttgggttcaatgtctttgcttcagcaagtatattgaagttataggaatttggttaatggtaaaaagattcatccttaacagtaacttctctcaattctatttgcttgcttatcttttatagcctatttgggcattccatttttctctgcagttccagcagacttcttttttgttacagtacaaactcattagaccttatcactgtcttcatgctttcatttatgtctagagtataatgggaaaaccacaaagactaatgctggcaactaacaagtgatatcaaactgaaaaggtcaccatttttagaggctgaaataaaggttcatcctcagaggctcagatttgttatccagactaattgactgccatttttggatttgtagcatgacagtctttccattaaggatgttgtttgcattacctatacttcattatgcagagacagggaaaacagagacatggtattcctttagatgtgtgagtcattataatatgaaatctacaatcaatctactgaaaaataatggcagattcaaaattaggcattactgatttttgaggtactgtcaacattatactactcagggtatgttttaaaataagacctcaattgaattgggaaagactggaattttttagtggtaaaattgtattacaggctgtactctttcttagctttgcttgcatgtctacttttaaaatatatgtcatatgttcatattgtttagaacatatttttaaattataagagtgtttaaacatcaatagactggggaagtattacaagagacaatagtctcaatatagattctgacaaaatcagttaataatagaaatatacattcattagaactgtaacttggttgcttttaggtaaaatattatggcacttaaaattttagctccttttgtaaatttagaaagccatcacacacacacacacacacacacacacacacacacacacacacgcacacacacatgcacatgcacacacacacacacccgtaatagattgacagtaaattttctatattatcttgtatctaagtttttttttaaattgttgtgacaaaaaatcgtgatcaagtcaatttgtaaaacaaagagtttaatttgtggcttatggttttaagaccatcatgacagggaacttggcaataggtagtcaggcattgttcagaggctccagagatctaacttagagcttatatctgatccacaagcataaggcaggaagacagtttgggaaagctcaaaaaccacccctagtgatgcacctcctaatctttcccaaagaattccaccaactagagtaccaaacattctaataaatgagtctgggggggggcaacattctcattcaaacaaccacattccactccccatatgtctgtagctatatcatagtgaaagatgtgtttagaacaacttctaaagtcgcacctcatcatgaaacttctttaataagatagaaatcctgcgaaaataatggattcatataagtgggaaggagtttgctccagagtcttggctgaagcgtcttcaggtgttatgcgttctagctcaatgaacattttctgtgaagattgcgtgcatagaaacaatatttcttttatatggagtgattttatatttttagtgtaaagcagataaagaaggtttattccttttggtcaaactgagtagaggcacacagaggacaagtgaccacccaactccatcttttagctacgtggagatattttaaagaatgttaaagtaacaataaaccatgtttaaaatctaagtttgtactatattttacatttcctacataggaattgaattagaaaaccaattttttaaaacacatgttaacctccttgtgaaactcttatggcccatggttttatcttatgtctgcagatatggttgactattcatccctaaacaaggtatttttctatgcccttttaggcttagggaaatacagaacaggaaattaaaagaatttaagggctaaaaaccaggggaaagggctgctgaaaaaaaatgaacatcttctgaacaagacagaattataactatgcactcataatggcttcagatacacacagaataggaatgtcaatctaggtatacattgaagaaaggtttgcaagccctactactcatctctaaactagatcctggaagagggatagtcactgcctccagttgtgtatataccgaacttcagtagatagtccaaatccagttgttatataagctgccttggttaaagaaaatgggtcacagggaaaagaaaggagggaaaaaaatagaagtcaagagttaggaaagggaatgggtagagggaagagagaaggagtaggctatagcagggaggatggagggagaaagtcatttcaatgcaatatatacatacaagaaattgtcaaggaactaactagatgaaaggagggaaggagcaaagtttcttagcagtcctttgagatgaaactcaaaagccacccaaatggcatacatagctactgctatatttaaagcacagctttatatatagtgaaaagtcagcagccttgttcttggatatgcttttttctttcccgagagtctttacttctgttttcaagaaactccaacattgtatcatactgaccagtagtaaccccagttgatatcccttttgacagtatctctgggctgggtctcttgatgtaacacatctgactaaagacatttatttaaagtgaaacagaagaccaggtactgtggcttatgcctgtaatcccaggacttggcaggctgaggcaggaggattatcatgaatttatggtcagcctgtgttacatagtatattctatgccagtctaggctttgaagatttttgttttcgttttttaaattaaagggtagaaacatttaaaggatgacatgttttgacttctttctttccaatttgtatcccctagatctccttttgttgtcaaattgctctggctgggacttcaagtactatattgaataggtagggagagagtggacagccttgtctagtccctgattttagtgggattgcttcgaatttctcaccatttagtttgatgttggctactggtttgctgtagattgcttttataatgtttaggtatgggccttgaattcctgatctttccatgactttttgcaaactttatatgccccagtacaggggaatgccagggccaagaaatgggagtaggtgggtaggggagcagggcaggaggggggtacagggaacttttgggatagcatttgaaatgtaaataaagaaaatatctaataaaaaatcaaaaaaaagggaaacagagctaaaaaaaatgacatgtactaataaaatactgatcctaaggttatgagtactttttgccattaaatgcattttctcttttaatagctattaatttttccataaaatattcttaaatattgattgcatttgattatgtgaatatttattgagtattgaattattatttgatatttctatatttttggacgttttgaaacagagctcactcatttgtatagtcttggatggcctgaaactcactctgtagactagtctagcctcaaactcagagatctgcctaccttttgccccaaagttctgggattaaaagcatgtgccatgtaacctggcttagcttaggatttagacagtttactcattacttttgtctggaattgttttcatgacatcagtgtaactaaagggaaggaaaagtaggtttacaagcaatacaaagttttgttttttcaatcacgatttccagtaaataacagcagctttccaaaaggaagaattttaaacattttggattgagagcatttgtaatttgaaagagtcatggtcattttctagtagacacattaggatgggagcttagcagatgttaggccctgtgcttagttctagtcacaccccctcaatacaatatttattcaaagtgttgagccatattacctcctgcaacctttcctcatctcaggtatgaattatcaaggaaaataaaatttcaaagcaaacaaaccttgatgaatttagttgggaggcaattctataataaagctgaaaataagacctcagcatggccttttccagcactacaggatttccctataataattacctctttaaaaattaaaggagagagaagggttagaggatggtagacactaagacaggagttttccttattatacccattctcttagttacagtaagaatttttcaacacgtgctgtttaaagctaagtacaacaaaattttaaaggtttgaacaaagatctctattgtcaagaggatgtagatttttctcattgggtcttgaagtgtataggcaaacgcagctgggagaaatgagagtggcattccattagacatgccatgtacatgctctttgaggattctgcacgtctcttcgccattcctttgtcaggtactcataagggagtgtgggagggacttttggcttttccacattgctgccttcatctgtttgatcacagcaagctgttaggcttgactttattaatgaagcagagagggaatgctcagaagctatcttggataccaaagaatgagtaaatggatggacactctgctttagtagtttggtgttgtgcactaggcaggaaatagtcttgctctgcatggctgtccaaaatatatgaaagagctagctttgaagtttccagggcagtgtagtgtagtgatttagtttagagcattgatatcatacttgattttagttgtttctcctcttactaccaatgacactattattagtagattaagatatattaatgcccgacagagttaatatttcataaatgaaataactgacttcccatgggatatgtaataatttttcaaatgtaatttagatcaaattataatttttgtgtaatacatattaaaatattattagggttggtcttagacctagtttatttgtctccctttccagtccatttttgttttctatgacactttaccataggttgaaaagatggtgctaaaacaggtttttagtttatcttatgaatatttgttagtcactttgtgatttgtgtatatatcaatatttgatatatttaaaacacatgcacttttggaaaggtggtagcttattggaaatgaaatggctccaaaatagaaataggaaaacagggaaatgggaataattctaaagagaaaatcagaactaacatgtttgtatgcagctccattgagggagaactgttgaaagtactttctcgcaatttcttaggaaacgtttgtagactttacattactagattacttttggttaaactgagtgataataacagggaagctatgaatatctctgtgcatatatgttacgtttgtgttgattataccatcttacccaaagacaatttaagtaaatactttaaatatttcagtaaatacagcatggcatttagcaaattttaaggaaacaagtgaataacttagctattccaacaatgttttgcctccgcattccttggcacaaacagagacctcaatgaagcatccctcacgggagttgcctggggacatcttacagaaaaagcccaggtctcaattcagcctcctcctttattattttcttttgtaaaatcattattattggagtataatttacatatgttaaaacacaccaagtcttagtgaaaatgttagcgaattttgacaaacatgtttactcacagcatcagagtactgaccagtttcaacactctaaatagtcagactcgcagttttgcaaatcaaactctatctgtacactgggaaaatgttgaactgctttgtcactatgaagatctacgtacaagccactttggacatgtgattttcatttctcttgtatgaatgcaaaagaataaatttgctgggtcatataagaatatatttaaccttataagtaacactagaagcatttgctgaagtgattgtattatattacatttccaccaacagtttatacatttttttaacttactgacttactgggtatgtaatgcaggacttacatagcatcaggatttttcctttttctttcttttctctctctttttccaactggatattttttatttacattccaaatgttatcctctttccaggtttcccctccacaaaccccctatcccatgccccctgcccctgcttctatgagggtgctcacccacacactcctacctccccgccctggcttttccctacactggggcatcaagccttcacagaaccaagggcctctcttcccattgatgcgctacaatgccatgctctgttacatatgcagctggagccacgggtccctctttagttggtggttgagtccctgggaactctgggggttctggttggttgatattgttcttcctatggggttccaataaccttcagctccttcagtctttcccctaactcttccattgaggtccttgtgctcagtctgatggttgactgcaagtatctgcttctgtatttgttaggctctggcagagcctctcaggagacagttttatcatgctcctgtcagcacgcacatcttggcatccacaatagtgtctggttttgatgtctgcatatgggatggatccccaggtggggcagtctctggatggtcttttcatcagtctctgctccacactttgtctctattttgttcccccttctaagaaggatggaagtatccacactttggtcttccttcttcttgagcttcatgtggtttgtgaaccgtatcttgggtattctgagcttctaggctaatatccacttatcagtgagtgcataccatgtgtgttcttttgtgattgggttacctcactcggcatgacattttctatttccatccatttgccaaaaattccataaatacatcgtttttaatagctgtactaatagtttttaatagtagtactccattgtgtaaatttaccacattttctgtatccattcctctgttgaaggacatctgggttctttccagcttctggctattataaataagatcagagtcacatcatgtagccccgcctggactagaacttgctgcataggctaagttggccttgaactcacagagatccacttgactctgcctctctagtgctgggattaaaggcctactccaccacaaccaactctcaatcaggatcttttatattatggctatcttggtaatggatatgaagtaattatcttggttttttaaattgcattttaatttttgttgatcttttcatgtggttattgaacattcaaatctttttgtcttgagacaaatatcctcttaaaatgttattaatattatagtaactgcgtgtatttgtgatgttaagaacaatttacatattgtcattgcatcttcttttttatttatgtttttatatgtacgtgtatgatccaaggatacccaaactattttgcctagtctgtggactatatttttttttcttaattgtatatttgaattagaagaacttaaattttttgatataatgtcaaatttatcatttaaaaatatttatcattgtttttacattatgtacaatactcctttaattattaaatgttgcttatttttattctacatatttaacttaatctctataattagtacttttgagccaatcagaattattttctgtacagtatgaaataaaggccctacttaactataaatatttttattttttcaaaatactatctgacatccgaaaagtacattgtgtccattttgtccttccccagcctcagaaacccctcagtcaccttgtgtaatgttagctttatccattctggatttttcatagagttagaatcatacattccaacctatacatctctttaccaacattttaaaactttttatggccattataattaaacagtatttaatgtttctttgttatagtttcacttttcattttgtaatctgtaaattttcacatgttttgtatgaatttgtccataatttttgtaacaatatctctattcaaagccttttttaaaaaatgggtcatatgtgctttttcttttgatttaaaagagaaatgtatatattctggatattagacaagttgattatttgcatatattttctcccatttcatagttgtcttgtcatttttgtgataatgtctctttattatattgtcttttttttttaagaaaatgtttcttttagcccatgcttgtcttgaactcactatttggacaaaactggccttgaattcctgtgtgttctatattgctgagttacaagtgttaactgccattcctggtcctaatgtcttttgatatgtaatttaaaatttttcttaacgcctatttttttattttgttgcttatacttttgatttcatacctaagccacatcaaaggcaatgacgatttggctctactttctcctaagagcgttctggatcccacgcataaatccaagtcattgctctatgttgtgaatgctgtggagtagaggttcagttttattattttgtgtatagatttctttttgcccagcactatttgttaatattatttccctattcaatactatcctcacttttgttagcaatcagtttatcataaatatgtgggcttcttactggattctcatcatcccagttccccacagtttggtgtacttatttctctacatttaaatttgtaatcaagaatcacaaatcatacaagatctttttctttttctagatagttttgagtctttgggtccctctacaattccatgtgacttgaagaatggcttttatgcggtttgaagattagcttaccatttgtgtaaaaaaaaagaaaaaaaagttgttgaaattttaacagtgttttcattgaatatatgaattgctttggatattggtgcaattcttaaaggcactaaatctttcgatctaagcactaaattattcaatgtaggagcatacactctctttccatttacttgggtcttttgaaattatttttctcaatgtttggtaggatttctgtgtctatgtcttttatcatttagattaaattttatccctgcataagttgcttaaattattttgtaagtgtaatttcaaaattttaacattattttatgtgtatgggtgttttgtctgcatatatctatctgtacactacatgtgtgcctgctgcttgtggaggccagaagttacagattgttttgagttaccatgtgtgtgcttgtacttgaacctgagtcctcttcagtagagactgccatatccagggatccaccccataatcagcatccaaacgctgacaccattgcatacactagcaagattttattgaaaggacccagatgtagctgtctcttgtgagactatgccggggcctggcaaacacagaagtggatgctcacagtcagctaatggatggaccacagggctcccaatggaggagctagagaaagtagccaaggagctaaagggatctgcaaccctgtaggtgcaacaacattatgaactaaccagtaccctggagctcttgactctagctgcatatgtatcaaaagatggcctaatcggccatcactcgaaagagaggcccattggacttgcaaactttatatgccccagtacaggggaacgccagggccaaaaagggggagtgggtgggcaggggagtgggggtgggtgggtatgggggacttttggtatagcattggaaatgtaaatgagctaaatacctaataaaaaatggaaaaaaaaagaaaactcagtattcacaaccactgagccatttttccagttcttggaaatgttttcttgatttcagttttattgtaaatatgtataaacaattctgtcatggtcttatataatcaattgtgaattttcattacttattaacagatttcaatcaattgtgtcaaatatgctcattgtttattttgtaaaattaatagttttagttatgccttttctttaaattattttattctgaatgtgtgtgtgtgtgtgtgtgtgtgtgtgtgtgtgtgtgcaggctgatctttgtgtcctttgacagttggattataatggagctctctggatctctttgaggttactctatgtagaaatttttgaatgtccatactcatatcctttagcatacaagtaaatctttttcatattatttcttcaaatgatttttttcctgaggcattatctttctctttttgttgcagactaccatcatgtgtatgctggactgtttaatggggtcatttaaaatgtctctagatcttctcaattttcatgtttttgttttaaacaggataattttgaatcttttatcttcaaatttgtgggtagtctcttctgctaactaatttttgacccctggattaaaattttcatttcaaatattgtgattttttttaacttattaactttctctttgattcaaggcaatgaaggtctacatatggtttctaaaatagataattctacaaatagagactctctcataaaactttctgtgttctttataagctttgttgatattttaattttctcttatactgctattgtggtttccactcaactttataatttagtacagaattttctttagttccttgaacaaaattaagatgcctatttcattgtttgtccagtaaagccaatgtctcaatgttttcagaaatgaaagttcctgatttggccatagttctattttttcttgtacttttgtgttttttttttaattaacaaatagatgtttgactattttaactgggagtcaaatccttacactctactaatgttgttactgaatgctgcagttagccatttgtttaaactctttccaactatcttttgcaaagaccatctctatttctatgtcttttgttgaaatcagcattcatttgctggacttcagcttttatttttcttttgcaatgctgacactcaaatctaatgcctcacatgtgctagacaaacactgtaccaactcatagcttatgctagaacaatgtttttatatacagctccttgaaggaacagaatgacagaagaataatgaatgtttaaaatgaagaagtagcttctttttagagtattgattttgcttttgggtacttctttaacatctctaggcaatttgtgtagttatatgaagatcagttaaggtgaaagttttcaggagttttcttgtgtgcttagatttttaaatatctcagtaccccgggcatttttcattaccctaatatttaaaataagccttcttagctttcttgacctcgttttggtgctctatagtatatgtcttacctttaaattttacccaaggcaactgaatattgttctcttaaaaggtttccaaagatgcttactgttctttttatgagttaataaaaaaatcagtgttttgcatcagtcttttaagtaattctcacaggacttggaactgataatttagaatgaaagtttgtaatgctctttcaggaaataaggtaagggtccttaactacacacatggatgatctctttcagccacagagtcaagcgaagtagatgagtcaagggcaaacaaaaccaaaacatatgttctgtcaaagctgctgttggttagtgcttgattttctgtgtttctatggtgagatatgtgcctagtcttgcctagtccaccatttcactgatgttccaggtttttttttttttctagtttcaacatgcagttgttttgcactgctgttgttattgttctacttttgaaaagatggtagattatatatttaattgtatattggttttgttgctctttaacaaaccatgtatggatagcctcaatttctggaccctgtagccttattttgttgtttaatctctgtccttataccaatatcacactttcttgattgctataattttaaattaagatcgaagtaaagccagtgcaagtttatcttcattatgaaaacttccttgtttacatataaattccaggaattgtatcctaatttctgagaagttgcatgggattttgtatttgtcttataaataaattcacacatttcctgatcttcagtttgctgtttctttaagctttctagcaggttcttttatattttatgcactagttttcttatttattatcttataaattcttccggatttttttgttttgtttttttgtttgtttgttttttcgagacagggtttctctgtataaccctggctgtcctggaactcactttgtagaccaggctggcctcgaactcagaaatctgcttgcctctacctcccaaatgctgggattaaaggcatgtgccaccacacccggctttggaattttttttatttctatttgcacaattttaaaatgattggttttgaacaatcctttgaaatcttcattgaaagctcagtgcattagtattcagagatgagcctccaaaagatgattggacccataaggactgtaacttaatcagtagttcattccaaatttttagttcaaaccccaaaggatttaacagtcctaatggagtcatggcctatatggaggaagttgattactgatgacttcattttaaagggtgaagtcctttatcttgtactcaatgtctgccaatcccaattcacatcttgcttgctgtctggccaccataaggtgagtggcttctccactacatgtaccacactctctaccatgatattcttctctgctttaaactcttagcaattgaatcccccaatcgtgaatagatagaagcctgtgaaactatgggtccaaattaatctttcctgtttaatattaacttattttaatatgctttcattattttagaatatcatatatatgtacatgtattttgatcttatttattcctcactcctctctgtaactcctcccagactcactcctcatttactataaaacagttggacatatctggagatattctttactgttaaactgtctagtgagtacaggctagtgatgctgctgagcattctacaatgcccaccatggctaatcactcagtttctatgacaacgaatcaaccagcctgcaatactgcttctgtagctaaatactgcattaggtgtagggtttaaaaacatgtactgtttttaaatcttttatatgaatatgttgtatggagaatatatttgttctcatagcccaccattctttccttttatctttgatttttacaaatgcagactctatttatcaaatcataagcccagattagtaagcacttttctttgacaattgtctatcaccgagaaacagaactttgtgaaaaagcactacacacattttaccaaaaaacatttttacatgtttgaaaatttaataattttgagataccatgtattgatcaatgaaattttggaaatggtgagttctttataagacagtggtcacacctgtctctggagctcaggagttcatatcctaaaagaggagctagctatcaaatgatctttaagctgaaatttgatttattcatttatttaaaaaccttggatagttcagcagttaagaatactggcaaaaaacaaacaaacaaacaacaacaacaacaacaaaaacaaaaacactggctattcttccagaggactcaggtttaaaaacccttgccttatgaatgaaaatattgatcagaaggatatgtgacttattttctcctttttgacttatcctaaaatttctgtttgaaaattgagattacaatatatgtcagaacctcatggattctgattattagttatttttctcatttctgtgacaaatactgggcagaatgacttagaaggaggaaggactaatttgaggatgcaattaccaaggtagatggacagggcagagcagagaagatcatgcccaatgcatagaagctgtatcagagagtccttgtggttgctgcctttctccttttttcatttacttctcccaggtcccaaattagagcatagtgtctttcagattcaggactgctctcaatccttagtcaattctctcaggaacctgcctcattaaaccttctacattctacaggtattcttaactaattaatcttctaggtgcttctcaaatctatcaagctggcagtataaattaactatcacattatacaacgtagcactattctatgagatgaaatggcaacatttgtttatatgtgatatataatataaaacatattatatatgtatatgtatatgttagaatgtatggtactgaggggaaacttagggtcttacactaactgggtcaggctctacactaaactagagccccagccctttaaaaaagtcttggactatgattttactaaagtgctcagtctagcctggaacccactatagtatatgctgtcttttaatccatgttttttctgacctaacctccaaagcttaatttaattaattattgttacatgtatatatgtatatgtgtatacatacgtgtgtgtgtatgcagtcataaattcaacctgattagcctgtataataatacttatatgaatgtttttgcgacttagccaatcagtactataaaatatattcacattttacgtaaaatatgtctttaacatagtccagtggcccagcaagtgcaagtagatttgagtatattttaaaataaatttttacaactccatgtaaattatcatttggaggctgtgtttaaaattagacaaaaataaatccaagaatttcaatctgagacattacagtggcctctttttgttgaggaatgcttccaggagttggagagtaccaaagactaaccttggaaaatagctaagacatagaatggccaagtgagcatccatttctgtatttgccaggcactggcatagcctcatacaagacagctataacagggtcccttcagcaaaatctttccagcattgtgcaatagtgtctgggtttggtggctgattattgggtggattcccgggttgggtagtctctggatagttataactgtcttgtatgaggctatgccaatgcctggcaaatacagaagtagatgctcacagtcatctattgaatggaatacagggcccccaatgaaggagctagagaaatcacccaagaagctgaaggggtctgcaaccctataggtggaacaacaatatgaactaaccgtacccccggagttcgtgtctctagctgcatatgtatcaaaagatggcctagtcggccatcagtggaaagagaggcccattggacatgcaaactttatatgcctcagtacaggggaatgctagggcctagaagtgtgagtgggtgggtaagggagcagggcagagggaggttatagggaactttctggatagcatttgaaatgtatataaagaaaatactaataaacaaaattggtctttaaaaaaaaaggaaaaaaaaagaagaatggcaagtgaagggatgtaatgatggagaagatttgagagagaggctggattcctgaaacaaatcggagaacagggctgggctgcatttttgagactaagctgcccaacagagcttcatgtttggtaatgtggaaaagaattattactactttcttgaatatcttaccacaattgggctgtcaatcgttgggatttttctagtgaaagtagtgctattaatacccactattttattgtcttgggtttggttgctcaatttttccatgtgtattaaattctgagggctacatcaacagcacaaacttgttgacatgcttcccatgatggtcatagactctaaccctctgaaactatgagccccaaattcaatgttttcttctgtgagatgctttagtcatgatttcttgtcataagtaagacaatgatcattgtcaaagtaagacaacgacctcatctagcaataacacattttcaaacttttttctcagaataagagatcacaaataagtattcctggaaaaggagacatttactcaatggtgtaaatgaattatagtaccttttgtcctaagaaaatattttgttgttgtttgggttcctagtcacttccctgttgctgtgaagaaacaccataactgaggcaactcttaaaacagaaggcatttgatttgggcttaaaatttcagaggcttagcccattctcagcatggcagagagcattgcaatagagagcatggtagcaaggagcaatgcccgtaggcaggcagatatggtgctggagaagaaattgaaagctacatcctgatccacaggcagtgagagagaatgagtttggcctagccttttgagacttgcctttgcttgtggagtataagaattataactttgataaggggtaggagatagagataggaacatttttattttacattttagaggatgtttctactttatagtgcaaaagcaatttctatgtacatactgatatgagttttgttgttcctggttgatctttggcctagattttgcttgagaagaatgctagtaaccttgggaatctatggacttccattacacagagagattacaacttgggaaaagttcagaagttaagaagaaaaccaaaaacacaataatctcagaggaacaagaaagaatgtctacctttgttctgatcccctataatgtaggccaatgatggcctgaaagtagcagttgtgttgtagttacttctctggcctaccaaaatgcttgctttttgaataaattgtatttaaattaatcaaaaaagaaaaaggaaaaaaacagacatatgcatcacacagttctggaggtgcaaagtctgaagttgatggactggcagggctgttctttacctgattgctcctcttcctcacttctaatgatggtcagaaattcttatattatggtttctagccagtgagtctctcatcttggtggcattctacatgtgtgtatctctgatcaaattcctccattgtactcaggcctaaggccctgaatcaagtatgaattcatatgggttcattatatttacaaagactcttctttcgtttaaaataacattctgagatagtaaagagtacatgaactgggagacactatccaacttaatacataatatataagacttcttccttccttccttccttccttccttgctgtttttggcagtactgagaattaaactcaagccaaaagcgctttatatattctaaacttccatcagattctaatactacactcattgtacaattaacatagcacaatcaacaagtgaattaaaattccctataaatttcctttaaatatttgtttgcattgaatgggatatcagataatttgcaatggtttaaattatgtaagatatttatcttaaattttgttcctcattgatatatcatacttataaaatatattttatattacaagaaaaatagaattttccctcatttagaagtttaccaagtggccagaattcgcatagaatggtttaaagtcttgctatgtctcataatttttcccttcaatacctaagccatgttatagggaaggttaaaagttcaatgtgtatttaaatgtattcattgattcataaatgcctctatacttttttttacatcaagtaagaaattgttattatagctttgtctatggcactacagataacttccattacagcacttaacagagtcagtgacatttcatcattaattacttatgcgtctatctttctaactaaattgtgaaatcatagaggatgtaaataaattcctcttcagcactcattaaataaatgaacttggatacagcttttccataatcctaacaataaagaggcgaaagtagatagatacagtaaggccagcctaggctacatactgattttgaagccaaccttggtcatgtaacaaaacttcctcaaaaccagaacaaatccaaaaataaacaaggcaacccaatcacaaagggtactatgctacattattatatttaatataacattttcaaatgataacattttagaaagaagattagtgaattccgtagttgaggacagtatcaagatgcatgtttttaatgtggaaacctttagggttgtaactgcagtggcagccattgtaacacacatgcatgataaaattgaacataactaagacacagatgaaaatcagtacgaataaaattggtataatgtatgtaatatctatattcaacacatatcctagctatgagcatagtcaatcattttgcaagctattactcttggaggggaatgggaaatttgtattaggggtgtctacatcatttctcataactccctataaattcaaaagtttgctattataaaatgcttaccatttgaaaacatatttaatctgatacataaattggatttgattgtcaacagtgagcattttataaaataaaactcagtgtgctgacaaggctcacatccttattgttgggatttcaggaatgtgccactgtgtttccctagttttttttttccattttctaaaactgctgcattgcattccatattccatatgtattaatttgttaacttacatgttgaatgaaatttatgccaattccagtttggagctctttcaaatgcaagttctataaatattactgcaaaaatttttgtgtgaacatgttttctgtctttagtataaatgactagggctacaattgctgtttcctatgacagttacctatacaagtcataagaaactaccaacctactttaaggaatggcaatccctcattcccttcccaaattcaccttgtaatcctgaaatctccccaccattatcaacatgttatcctttcactacatagtgatgtttcagtgtgcttataacatgcagttccatggtagctaacaatattaattatttttatgtgttcatttgccacctgtatttccagttctatgaaattgccagtcagcgtttttccaccatttttaacctggtctgtctgtcctttgtactgtttgttgagaaatctttgtatatcttagatcccactactctgttggaactgtgatttgcagacaccttccctgagtgtataggctttataatctttaagtttataatcgttcatagaaagattttaaatatgatgaatacagcaaaatctaaatcaatactatttccttttgttgattttgtttgtggtgcaaattaagaactctctacctggtcctagatagtaaagatttccttctagattcagttttctacataatttacaattgtagtcctaagtctgtggtccattctgaattaatgtttttcacagattctattttttttttttggaatttagatcagcaaagtggccacactgagatcttttcatggtagatatctttaaaaaatttattattattattattattattattattattattattgttgttgttgttgttattgtttcaagacaggttttctctgggtagctgtggttgtcctggaagactgttgctctgtaaaccatgctggtcttgaagtcatggatctgtttttgcctcccacgtactgggattaaatacttgtattaccacaccaggctcaataaaatatttttcaaaaaggttgtcaccatgtgaagatgatgatcacaggggcatttgagaaggtgtgggaggcaggatcagtacttaacagagtaggtacaaaggccaactctggtgtgtgcatactcagcacttggtggcagacaggtagctgtgggccccaggctgaccacaggcagcatagctttcttgcaggcagtctccagagcttggaggttcctaggaacacatgccttaggatgaagagacaatgcccctgacaggaatgtgttccttccagggaggagcctttgggctgcaccattgggatgctatcgggctgcctgtgtggagatcttcttgccttgctgtgtacctactttcccccatggcttaacttttcactgttgtgcaatgtttttagttgttcatgtgttaagatgtattcacgcatgatgagtccagcaggagtggcaaagtaggtcctgagacccttctttaaatatctgaaacacactgggaaatactaaccccatcaacttgtcaacctctcagagcataatcaaaagattaaagcaaccaagaaaatacttgagggttaaaaataataataacagttgaatttcagttacagagatttgtaccattatatgtaccctgatttgtttgattctctgccctcaagcttgaaaagtctttgaagataacagtctgcattttactgtattcgtctgtttagtatagtttcccaggacaggagaaagtagaagtgaccttattattaaagaattctgtttttctcactttgagcagtgtagaagtctcctaaagggtcagcttacagggcatgttttggagaattcagaactctctgaagaatgaggtagtttagttgccttggtgcatttatgacaaatatttaagaataatacattatctactgttcttgggagtacgaaggatgccatttggacaaacaattttgaaaacgtgatatgaaagcccaagaaataatatagtttgaagaatcagggcaaagttgctcagaggagacctgcaatggcttgaaaccttctagttctgcatgacagatagtggtgtctaacttagtataggaaaatttttgtgtaagtaatgggactatacacatttaagaagacaacactgttttatgcattataggaagtctgtctccgatggttaatagctccccagtaacacaataaggaaagattttagtgaccacacataacatgaagtctagaatacaaaagaagcttagaaaagtcaccaaaaaagcagtaatgaccccaagcattgttaagaaatcctgtagatggatgtgaatgtgattttatatttactccactataatattaagaatgtactttcctttcttctaccttatagtcaagcactgcatgcccgtgctacatttgtagccaaaagtattctgtttttatagaaaagaggcacacacaaaaaggagaaaatgaatagtataaaaattaacataattttctcacaaggtggtccacaaatcctatttactacgaaatggcattatatcagcatggagagagtttgtatacaaagatctcagagaaactttcaggatgatctcatactcaaaagaactactcaagaactattcctgccaattagaggacctgcttgtaatgattttggacatatacccaggagtaacacgtcaggattgcaagataattccgctcttgctctttagaggagctgtcatactatttcatagctgtaccatttttatattccaaccaataatggataatggtttctagttttttctgcatccctggtcacattatgcttcttagagtagcgaatctcatgtctcaaatggtatcttctttgtgtctttgacatcatttcctcaatggttgttgacagtatctttttgagtgcatgctgattgttttctgtatgttctgtgaagaaatctacttgattcctttgttgacattttgtatatggggtctttctctatccaaaaaggccttaaaatcacaaccttcccaaccccacctcctgcatgctgtttattatatagttggattttttttacacattatcatctccttttctcacgctccctctcaccattacaatctccagcatcctttctactttcatgtcaaatgtatagtaaatgtacttggagaagtgatagatgagatcatttttatcttaattcagcccctttggggaggaattcaatctagtggcctggcatctgttttgcagtatcatatgctgccttttatttacatactccacttgatgaaccatgctgtttgtagagatcgtgagtcaatatatgtactgatttttcacttccattatgtttattaaaggagaatacatgaatacttcatgtacataggaactaaacagcagctcatgttttaaacccacttctttctaataaaaagatgttaaaacgaatggtgtctgtggaacttttgctgaggggggaagagagggataaatgaaactaagaatgtttggaaaagctataggaaaatattatttcatgttttcctaaaacaccacacacacacacacactttttggacatttatttggagtgaggatgtaattaaagacaaagggccttaatgtcataggatttgcttccttaaaatgacatacatgcaaaaacctttgcttcctctcggcaacataaagctgataccaaaaaaattaaaccctgaaagaacattgatctttgagttttaagccttcccaacagtgacataataaattaattttggttcagacagccagtctgtgatattttcttatgggaaacagaatgaactagcatgattgcagtgttagtaaaaatcaaacattccaaattacaaatttatgcacttcatattgagagcacaaaatagtgtagcttttaatattggcaagccagaataacatttttattaaagatatttgcttgttcctcatcctgtgagcatgacagattctttcctttgtgtaactatgcactcttacacctatgtgaatgggcttcagccagtattaactattcttatgactaaaacaaagtatcctttatctgtgtaactggagtgttgacaagtctttttataaagaagttatagtcttgacagagctttcttacttaggctctggatatcatggctttaggagataattcttatgtgttgtctttcattctgtgagttgtctcttctctttgtgaactgttttctttgctgtatagcagcttcttagatataatcccaattttctgtttttgcttttgttggtttctttggaactcatatccaagaagttattgtttatacttatacaatcttaggaaagtttttattacagttatctatttaatgtgtgagtggataccctgatgcacaggtagagtttcgaggtcaacttaacaggagttcattttcttcttccaccatgtgggtgatagagattaaattctagtcattagggttagaggaaagcgcccttacctgctgagccacttctctggcccttacactgatatttctaagtgttttcttttagtgtggtggttctcaaccttcccaatgctgtgacctttaatacatatccccatgttgtggtgacccgtaaccatacaattattttgttactacttcttaactgtacctttgatactgttatgaatcaaatataaatattgtgttttcccatggacttgggagactcccgtgtaaaggttgtttaaattcccaaaagagtcatgacccacaggctgagaaacacggtcctagaagtttccttctttaaacacatttatattattttctcaagaacttcatacatggtattttgagcatttttcaccttcatctcctcccatatgtacctttactccataaacacccaactttatgttaaaaaattttaaaacacattagtgctatctatatacttttaggtggatggtcatccaataaaatacattagacttgtcagggtctgcacccttgaagaaaactcactctttcttttctcccctggcatctatcaactaccaaaaattctttagctagggatgcagctttacagtcaagtcctccttccatgctgagattttctcttgctgcatgctgtcacacctgctgggaatttggatgcacaaatgtcctattgtgtcaggaaaacactgtttccttgtactcacccagggcccctggctcttattctcctacctcttctgcaataaaccttgatctttgggaggaagaggtgtgatacagatgtcccacttagggctgagcactctgcagtctccctattctctttactttgactagttatgggtctctgtgttaatttccatctattgcctaaaagagaagcttttctgatgaggtttcatatatatgcctagctatgggtacagcaaccagtcattattagttggtttattactatgtctcattaccagagtactagttgtaggtgctgcttcagggcttatgatttgtcaaactataggttcttgactctgataactatatctgtgactctgataactatatctgttatggcctctatcttgtggaacagaccttgaatctaatgagaaaatgatttggtacttctatgatattcttgctactgttataccaggaactgatgacatcagacaggttttcattatagcacacaaagttcacagttaggtagtattgatgaatacatttcttctcttacagaatgcatagtcccttccagcactatgaaatttagcctgtgggagtgaagcttcaaaaatttcctagtttaaagttgaaatctgttagaacctgtaggttatgataaatttttatttgattttttggtgccagttggtagatatgtgttatagatagctcttcttcatttgacggtccagtcttcctggcatcatctgctgaagagaatgtttcatctctagtctatttttggtgactttatcaataatctttttgttttcagtgacaagagccaccattaggagctggcatactagtttgatgtcttaccattaatttatatcccagctcatatgatgtgtcttgaaattagatactgtagtatttctaattttcatctttttatttcatatttgtttgaccatccgaggtctttttgattgtattgaacttacaaagtcatttgtgatatgataaacagcttaaattcttctggtgatgaatatacttttatatagtgtgcatgtgtcttcagtttgttatgttagtgttttgtaattttcattttagtcttttctgttcttagtaaattaatttctcattattttattttgtattgctttgaatggtactaatttcctaaaatgttgttattggtgcataaaatcctattgacttttgtttcttgactttaattttgtcaaatttctgaatttatcaattttaattgtatattaagagattttatatattaataggttttatatatcacactatgcataaatagggacaatttgattttctgcttcatgtttgcatgatcctaattccttttttcttgcttaattgctctggataaaacttccagttatatatgcaataacagtaatgagagtagacatcctcacttagttctagatatttatttatttgttctttagttcagactttattcccctccctgtctaccttccaactgttccccaatctcctcccctggtctccaagaggatgtccccactgcccctatcccaccccaccagaactccccactccctgggttcccaagggttaggtgcatcttctctgactgagtccacacctggcagtcctctggtgtatatgtgttgagggcctcataactgctgatgtatgctgcctggttggtggctcagtgtctgaaagatcctgggattccaggttagttgagactgctggtcttcttatggggtcaccctcctcctcagcttcttccagttttctcctatttcagctacagggtcagctgcttctgtccattggttgagtgtaaatatctgcatctgactctttcatctgcttgttgtccctttaagtttttcctaactcattatggagatttttttgttggtttgttgtatatatcttttattttgttgaggtataagcctagtacacttgattggtttggaattttccatcatgaaggaataataaggggcaatgtttagttttttttttttttgttgttgttgtttgttttgagaagatcttctctgaatagccctggctgtcctggaacatatcatgctataccagttgttaatgcaattaacagggttcactattttccccagcagcctacacagtaccttccactactatgaaatctagcaaccggggaggaaactttctggtcagtatcaaatttattttcccatgttctgtgaccaaacttcatgacttctgcaatatggtcttagcatcaagttatagtggctaacaacgggttatggcaatagtttagaaagcttgagagtctttgggacacctctggccaatagtccaaaggtaacatttccagacctgcaactgggctatttaattgataactccaattaaactctattatgtacacatattttaatttatatgtgtgtgaatttatccacattatatgtgtgtgtgtatgtatgtatgtatgtatgtatgtatgtatgtatatgtatggagcttataaaataagagttttccatatggcatttaaagacatccttggtgctaattattgtatggataaatggataatctcttgtgtactgtgtgaaagtaccatctatcaatgacctattagcaaaaggcagaaagtggaaggcgggtttgagatgttccggtagagagattggaactctggaagatagtaagaggtggaagattcaccacctggacactgaggaaattgaccatgtgaaactgggaagaagaaaccagtcgcagctgaactcagggtagaataagccattttattctaacctgagttcagctatgtgggttgaataaaaaaaaattaaaaagaataaaatgggttaataagttgagagtaagggaaccagccgaggcattttaaaaaaataaaattaagcctctgagtccttattcaggaactggggcgcgggtagaaaagcctatggttacaaattacctctcccctatgtcctcctctttcataccttcctatccctttccccactctaagccctctaccattattgcctttccttcccttcatatctgtcacctgtgttctaccatccttcctctctcaatctctgtttctgtgtcagctgaatatattgttttataccttttaattatgctcctgtctagtttaagtattaggaccatatgaggaatctacaaattttaacgaagtaaaacaatccaatttaaagataggcaaatgatgggaaggtgcatttctcaaaagaagagatacaagtatataaatgaaagatactcagtatcattatccacctgagaaatacaaatgaaaaacaatgtgctacaattttacctactcagccttcagtcctggatatacaacttgttttgtttgttttggtcagtttatacatagtaaatattttccctatatctgacatgcctactcagcatattaaagatgatatatgttgaattcaattttgaatttttgataaaatcttatttaatattttatttatatctgttctttgtcttatctaacttggtttaagcccaaattataagaatgtttattagatattttcttcatttacatttcaaatgctatccccaaagccccctatgttagttcatgaagtttgcttattttttatttaaacattgtgggcttcagttatagttttttaatcattggtctattccaaattaggtatgaggtaaagaccgaatcttattttgtacataggggcatccagctgttctagcaacatttgaaatatcttttccctcttgattgttttgacagttttatttaaaactagccataggccatctcacttctgttttctttctttctttctttttcttcttcttcttcttcttcttcttcttcttcttcttcttcttcttcttcttcttcttcttcttcttcttcttcttcttctccttcttcttcttcttcttcttcttcttcttcttcttcttcttcttcttcttcttcttcttcttcattttccttttctttttcttttctttggttaacattatgatattgccacactatacctttaaggcagtggctctcaacctttctaatacagttcctcatgtcgtggtgaccacaaccataacactatcttcatggctacttcataactgtaatttttctactgttgtgagtttcaatgtaaacatctgataggcagggtttctgatatgcaactcctgtgaaaggcttatgtgaccttccaaaagggaagtgacccacaggctgagaaccagtgtttgttgtggcaaaattttgaccaccctaaagttaacatgcaaaatatctaataaagaaaagcaaacttttaacaaattataataaattctagtttcctgataagaattatgattcacctggagtactttcttcaataacctatccactataatttcctgaatgtcattactatcaactgaggacatatttttaataattgagcataactattggtaaatttgaacctaactttggttaacattgcctgggattcaaaaattgtctcaggcatgcaggataactgcactagttttacacgtaactctaggagtagacaatagaagaaaattggagaatagaataatattaagaaacctaaccagggaatttagacattttaggattcccttatggttcgtggacaggatgttagggagtatatcagactgaattttaattttgttcactgtcttagttagggttttactgctgtgaacagacaccatgaccaaggcaagtctcataaaaaaaaccaacgtttaattggggctggcttacaggttcattatcaccaaggcgggagcatgacagcatccaggcaggcatggcacaggcagagctgagagttctatgtcttcatccaaaggctgctagtgaaagactgacttcctggcaactggggtgagagtcttaagcccacacccacagtgacacacctactccaaccaggtcacacctctaaatggtgccactacctgttccaagaatatacaaaccatcacattcactatttcatatgtaaaaatatcatgtatgcgcttggtgagaattctagtcactgcatttctgttttccggatatactattatcttattaaccttgttgtttggttgtttctgtattccttgtaagtcatctctttttaataatagcaaaatgttttctggttgtattctattgtttattactttccatatttactaacatttcagcaacatttataaataatgttcatatagcttgacatttaatttattagaatctaaaattatgaatatttgagctgttgcattgtctatgcttagatacggaactggttcttgttctcaaacgtctgaaggccacattttttgttatggataaatttcaagaaatgttattcaaatgccgggtcaaccaagtctctgttctttttgtttttcttagcagttttcccagatttgactccttttaaattttgatttttagtttctttcaggtttatgatcctccctgtgcattctttattttgattctgcctgtcttcatttccaaattccatgtttttacaagttttaaaatcaaatttagtctgggttctctgatctagctctactttagctgtgtgcaaattttctttcacattgagttatcatgttcgcatgatggattgttccttgtttttaaaatttatttgtttgtttgttttacttattcactttacatcctactcactgccccctcctgcacccccctcccacactcctttccctttcttctctgaacatgtggtagctcccttgaatattcctccccaccctggcacaacaagtctctgcaaggctaggtgcttcctctcccactgaggccagagaaatcagccgagctagaagaacatatcttacatacaggccacagcttttgggaaagccccgttccagttgttcaggacccactgcagatctgctacatatgtgcaggaggcctagttccagcctgtgtatgtcctttggttggtgattcagtctctgagagccccaggggtacaagatagttgattctgttggtcttcccgtggagttcctatccctttaggagctgcaatccttcctcctatttttccataagagtccacaagctttatccgctgtttggctgtgggtttatgtctgtctgtgtcacttgacaggtcaggcctctcagaggacaataacgttggtgcttgcccatgggttggtgcttgcccataggttggtgcttgcccatggggtggttctcagatgaggtggttattgattggctgcaaccccagtctctgttccatactcaatccctaaatttcttgtagacaggttaaattttgggtcgaaagttttgtgggtggtttggtaactatctcgtcaccagggttcccacctggccacgggaggcaggctcttccggttccatattcctaattctatgaggcacagctaagggctcctctattgattcttggatgcctcccaatcccaggtctccgtctcttcctagagatgtaccccacctctatcccagcctcttggagatttccattcattctcatagccacacagccatgttccttgccacctcccattctcctcccaaccacctccctacccacttccctccctacatctgccttccacatccattccattcccccttccaagtgaggctcaagcatcctttcttgtgccctccctcctgtccagcttctttgggtctgtggagtatagtatgggtatcctgtattttatgactaatatcaatttataagtgagtacatatggtgtgtgtcctttagggactgggttacctcacttaagatgatattttcaagttccataaattaacctgcaaaattcatgatctttgtagttgaataatataacattgtataaatgtaccacgttttctttatctattattgagttcagggacatctaggttgtttctagttcttgggcattacaaataaagctgctatgaacacagttaagcaagtggctttgtgggatggtggaatttcatttgagtatatgcccagaagtgatatagctgagtcttcaggtagaactatgccaagttttctgagaaactgccaaattgattcccaaagtgatttttacaagtttgaattcctaccagcaatagagatgtgtttttctccatagtcttgcccacatgtgctagctcttgaatttttgatcttaggcattctgactggtgtgaggtggaatctcagagttgttttgattttcatttacctgatgtctaaggacatttaacatttttttaagtgtttctcggccattgaggattcttctgttataaattctctttaactctgtaccccattttcaaattgggtcatttggattttttgaaggttagcttcttgagttctttatgtattttggatataagccctctatcagtgtcgcgcccgctctcgaccagcaagaatgacgcgaccaccagtccttctaacagcagtttattcagtcctgattcttcttgtttatatctcccccgaaccctgggcctctcactccttttatactctctctcatccacgcaccgcaggccacgccccctcgccagtcacgaggcttcagctaatcagggcagcaggggcaaatctccaccaaattggattcacctgtatcctggtacacctgcgcagcacttaagatgtttgtgtcttatatgaggaagtcaggtgcaagtcatatgacttagctgcagtccctggcgcctttgggactgccgccacacccgctccccacatatcagatgtgaggttagtgaagattgcttttctcaatctgtaggttgctgactatgcctgttaattgtgtcttttgccttacagaaacttttcagtttcatggggtcccatttatcagttgatgattttagagcctgattcattggagttatgtgccagtgagttcaaggctctttctcactttcttttctattacattcagtctatttggttttatgtggtggtccttgatccacttggacttgagctttgtgcaaggtgaaaaaatatggatctattttcatttttctacatacaaatggccacttagaccagcatgatttattgaagatgctatcatttttctattgtatgtttttggcttctttgtcaaaaatcaattgtccataggtgtgtgggtttatttttaggtcttcaattctattccattgatcaacatgtctgtttctgtaccaataccatgagggtttgttgttgttgttgttactgttttaatcctattgctctgtagtacagcttgaggccaggaatggtgattcccagaacctcttttattatggattggttttgctatcgtaggtttttttttccatatgaaattgagaattgctctttccgtgtctgtaaagaactctgttggaatattgatggggattgcattgaatctgtagattgtttttcgtaggatgaccatttttaatatattaatcctaccaatcaatgagcatgggatatctttccatcctcagaggtcttctaagatttctttttttcattgatttaaagttcttgtcatacagatgttttacttgcttgataagagttacaccaagttattttatattttctgtgactattgtgaagggtgttgtttccctattgattcatttttcctataaggaactctacaaccctatctttcatattcatttgccaatcatctccttctcatctgtgcacaccggtctcatttataatgaaaactatgggatttttttcatcacaattgtataaaatgacaatagattttgaagagtatatagacaaatttttctttggaaatacttgtcccctatgactgatgagtatggacaaagtactgtcaattttaataggaaatagctagttttctaattactgaattgatcctatataggacatatatatatatatatatatatacatatatatatatatatatatatatatataaagaatataagtgggtttttgtatttgcattggtttgtgagcatgttataacattttccatacttcatagttgtgttttgtaattagtaatgcagttacatactttaaaataccttgccttttccttttggccacaaaggaaacaagcagcattgaagcgttcttgcactggatgaatatgtcaaaccagtgtttctgtgatttctgcttcttagaaaccacaaaatcaggatattttgtgtagaacacttgtctgaacgaatggcatagcaaaatttaagatcacattaattcattggactatgagtaccagttgctgagattatcagccaacaattccattaaaaatattcttgcccattcataagggaaaaaacaatttctcctttctctcttcctgtaaataggcaacaaggaggcccagagcatgttagtggattttaacactggtatagaaccttggatttggactcactagatcttaaatgcacttagaacacagaatttgattgcttcataggagacattcagacatatttatgttttgcacaactctgaagtttttcttcttataatcatgattctgtggtctttttgcttgctgctttttttttttctatgatgttagtactttttcaaggccaggtgtcttatggttctctaaaggaagagaactggtagactaaatatctctcagttagaatgggacttataagtctatggtttgagtagtccaacaacagctgtcagaaatgccaagaatccggcagttgttcagtacataggactggatgtcttagcagtcccattcagatgttagagtcctgcaatattcctagagatctgttggtcttcacactctatttcaatccctactaagtagattctcatgcctgccaaagagtgccccaggaacaagatttaaacttgccagggaaaacaatggcaggcaagcaaaaatcaaaaccttacttcttttatttctttttatgtgtgctgccactagaaggtgtggcccagatttaatggggggtcttcttgcctcacataatctaattaagaaaatctcttatgggcatgcctggcagcttgggtctgagtatactccagatttagttaagttgacaaccaaaattgaacattacaagtccacctcttgttaacttgacatacaatcatatcccttatctcatgcttgaattccaataaccaagtcataattatatctaacaagctataactacctcacatgtagccccaaatgtgttaggtattttagaataggttacagtgtcactggaggaatgcttagtcttttaggggtctttttcagactgtttcttagagactccttcttaaagcagcaaggaagcagagagacagatcctagcatataggtttctttacgctttttaatgcatccaggatcttagccagtggaataatgttcctgacatacccagaagtttgtctccttggtgattctagatcctgttaagttaataatcaatattaacaatcacaataatctataaacacatcagaccattatattactccattaatctaagatttacacattagttaaaaataaataaatttatacctggggtttgtaacacaagcatatgtagcccagctactctagaagctggcactctctaggatgaactggagagcattgcagtagtaaacaaaaactactggtgatgtagttctgtgatagagctcttccctaacacatctgagctcccagtactgaggacactgagaatggaggattgtgactttgccagcaatgtggaaaaaattagtgagttccaggttcagccaaattctatgccaaaattctatcatcaaaaaatattaattaatttctatgtgttttattatatatgtatgagtgctttgcctctgtgtgtgtgtgtgtgtgtgtgtgtgtgtgtgtgtacaccatatgtgtacctggcatcaatggaagtcagataagagtattatagtccctaggactgtagttatggatggttgtgagtgctgggacccaaaactgggtcatggacaaaagttgttaaccactgagaaacctctccagtcacctctccaaataaaattttaaattacattagacatattccaagctaaaaatactggaagatagtcactaaaatatgaagctttcctgaatcagttctaaattaattaatgtggagtatatgatgatagtcaccattttaatctctgtaaaacaaccttagaacccataagagactttttcaaacttcttttatttttagaatttaagtttcatttttttaattattaagtttaatttactactactgtaatttggctggagaatgaacctagagtttcatgagtgataagatctctctctctctctctctctctctctctctctatatatatatatatatatatatatattatcttaagtcagaagagtagttgttaaaaatgcaccttatgattataatatacaaaaataagccagatgtgaaggtgcatgtctataattcctttacttggaaggtgaaggcagaaggttcaggaattcaaagttattatcatgtacacagaaaattcgaggctagcctaagctctatgaaatgtctttaaaaaattagtgacaaaatataaactaccctaaccaagaccaatctttcactcctaagtttgatgcagtgatgaatataaattagacaaggtaattttcatatttatagaaaatcaatttttccaacccaattactttagaaatgccatttcacataaggtctatctagaagtactcatgaataaagatattgcctaaggactggacagatatctcagtgagtacccagcttcagtttctcacactcatatcaggcaacttacaacttcctataactacagttccaagagatcagcagctccctctggtatatgttagcaccacatgcatgggatatacatacatgcaagtacttatataaagaaaataaaatttaaaaataaatcattttagagtttggaaaaaaaatgaaaaaaaaaaacccctatctgatgcaaggcatagacttagctttcttgcaccaaatgtaaggttactggaagtaatcagagaaacttagctgtggttttagaagattacagtattagtagtgaggttactggtaaattttccagagaaaatgctagaaatgccatcatttgttaattgatgttgtcaaatatttgggctcactttgatcaatgtgagtttatggtcatcccgcgtctgccatccttctgtaacctcccttctgtttgcaatgctacccactcctccatggaatacacaacagcaaccaagttcctaacacagagagaaatatgcattattcttctattatcacaatctatttcaaagtattacaaagaaaacaaatagtattagtaagttatatgctatgattgtgaattacttgtaggcatcaagttttaattttacatgtgtgcacattatcgagtttgtgtatataatgtgttgctttctatctctctgtctgtctctgtctccctccctccctctctccctctctccttcccctgcctctctctcctattctgcacacaccagcctagctggccttgtgagcctcgaggaattctcctgtctctagctcccatcttgctgaagaagcattgggaagtcagatacacactactgcactgataagtggtgaggctttgacctcagttcctcacatctgtacaggggtgcccagtaagcagcctcccctgcttctctataatattttagagaaccacttaatattttttaactctgaatatggagcaactggcaggtgctgttttggttaaaaggctttccaactgattaatgtgttcagcaataatttgatttttaaagaaaacttccattatagcgagaagaaaatgtttccccttcagagaaaatctggcaaaatgtcttggcttttgctcagaatttgtaagcaaatgagaatcaatttgaaatattggagaagtcaagggagtgattctggctctgcctctgttactgatgggctctgaattttctcacatttaaagtgataggagcacattagttaatttataaaatccattacaactcttctaacacttttattgtaagcatttattatgaagagatgtgatgtgtttatggcttgtgataggatatcatgcaaagttgtacaaaactattcaactatgagttcaacaagcactttaacagttgttcttccagtggagattttgtgttgtgctgtgatgttcaagatgatcttctacaggaactaggttcagttcccagcatccatatggcaacttacaaccatggtctatacaactccctcttctggcttccataggcaccaggcacacacatggtacagatagagacaaatacccacatacacataataaaatataaaactaaactaaaataatgtcttctaatagtgtcttaaacacacaagaagagccattacatattggaatgacatagatattgggtacctgtggccccaaaatttaacttgtactgaaaatcatcagtcctcttcgtcatcacattagaattcctcaatcagtaaaataatgtgcaaatatttttatcaacacctatgttccattgttcttctaatattataccatttccaggtaaatcagtaagttgtgttttcatattttgagtatgtgaatgttattgatatgctatttcttgtaattgtaggccttttgatatagttaccagctactgcatttatccatgcagtgcatttattaagccatctttatttcaacaagtgctatagtgtatatattttcctcacttttttcctacactttttagagtagaagactaaatactaaagtgtctgtgtaagcaggctctttgttattttctggcttataaaatctaatttgtgtcaacatattaacgtatactcagcaactttattaaattattttctgatgaaattcttttgaattttctatccctagggtcatttaatctgtgtgacatttgtgggtttttttccaaaatttcttttcatttcaaaaattgctagtacttatgttaaataaaacttcatcacatattatgtagtatgcatatatacatttacatatatacttcttgatttaaaaaaacagtctgatatttatccttcatattcagtcctatgtatctgttttctggcattgtttggttagatttgaatcctttccttaagttcaatagaattatactgaaatattatgttgtatatgatctttagactatagtatatggtcacttttaataaatatctgggatttaactcataagttgggcttcttcatttaatgggtacattcattatatcatcaatgtccattagtataagtttgttagtcatgttcaaatattcatatgtccttacaggttttttgtttgtgtgttatactggttatgagaggtttgtttaacaactacatagatttgtgtacctttatcaatctgttggtttttactttatatatcttggagatattattagtgtgcataatttaaagtattttaaacagaatctttcttgtgaccaaatcttttttcattgcagtgaccttgttttatcttttgtaatgtgttttgccttaaaatccattttgtctaaaattaatgtagtggtaccagctttctttggtgattattgtgcctagcttcttcttttatttcaacctttctatgtaatcttaggcttttgatgtctctgataaacatcatatcatacattctgaaatttgcttccttttttgaaattctaaggatatttgtttccaacattttcctcagtggtcttacctaagattttactagcattttcaaacatagtaagaatatgtaataaaaacaattatatcttcatctagactcagtatttttctgtgtttgctttacacatctgtctcttgctgcctagtgtttctatgtgtgtgcaatgattgtttaaaagtaatttacagacagtaaaacaccatatacctaaaaacctcaccacaaattgtcttatattagcctaataaaatatcacccttaataaaattaataattttaaaggcacatgtctgttatagttgtttatatcctgcttttgttcattttcttgaaattccaaatgtcaagatgatgtttgaagaaaatattccatgggcatctaatgtacatcttcagaggtgaggggctatcctctcagtaaactttattttcaaggatgttttaggaaaaaaaaaagacttgagaacttatgatagctattgtactttgcaagaaaaagccagataagttgacttatcactgtactaaaaacatgatctcaagaaatacagagttgctacccattatgagatgtggaagctctgtgaatacccaacttctcttcagcaacagcaagccatgtaacctatataaggttcattttgcatgtttagcatcaccctgaggaaatgggagcttattgaagcccaggatatgggcctacattcttatgacctattcagaagtctcatatttttagaaacatctcataaccttggggtaagcccactaagttttcaagtaaagaaatgtcttaatattttttagttgttgacaagatgaccttcctatattttatttctttacttggattttaaatagcatctttgatatataatttacacagtattcagtttgtctattcaaagcatatgttcagtagttgtatagaatatgtatatagaattttacaactataccccaaattatttttggaccttttttatccatatgttaagaaaaccacatcccttagctttttcttcccattgacatcagccacaagcaactgtcagtctgcttgttcatataattcaatatattctcaacatttaatagcagtaagtgaatgccagcataatattttgtatttgtgggttttttttacttaatacaatatttcaaaagcttatggatgtggtagcatgaaacaatacttccctcctcttttttgtcaaatgatatttcattgaatatatatactacagtttatttaattagttcatcttgatgtatatctggatgttttctcacatttggaatattatttgtaatcatgttttgtaatttgtaatgtagacatacataagaggttttacagacatatttttaattttcttagatatatgcctaaggatggaatagtttgctcaatgtgtttaattgttttagtaagtgctagactgctctaaagtggctatattgttctgcaactctaccagtgatgtatgagggttctattctcagtgatgttaatattctctgtctttttaaactagaaagagctagtatgtatgaatttgtatttcatcatatttttggttttcatttccctcatgcatggctaataacattgagtatgtttgcacatgctttctgcatacatctctttaaaataaataattattcacatttcttgcctgttttaaaattgaagtacttgacttcataatgttatgagggctatatatatgcatatgtatatgtatgtatgtatgtatgtatgtgtatacaatatatgtatgaatatataatactatatatttataaatcatatttctcataaatgatatataaatataccctcataattgatatgtgtgtttaccctattaagtattttcacttttcaattctgattattttcaaattaaaaaaataatttaatttatactctcactgcagtctcccttcacgcctttgccctcatctgttcatcttccctttctcctcagaaaaggggaggcctcctatttatattaaccagtcttggcatatcaagttgcagtaagactaagttcatcttctcttattaaagctagacgaggcagtccaggattatgcaaagggtcccaaatgtgggcacagagtcagagacagctccttttaggaatcccacatgaagaccaagttacacatatgtgcagaagacctaagagagagtcctaagaactcgctggttgacagtttggtctctgtgagcccctatggttccaggttagttgattctatgtgttttcatgtggtgtctttgacccctctggctcctacaatcctttttagctctcttctgcaagatttcccaagctctgcataatgtttgttggtctcttcatcagtttccataaagctgctgggtgaagcctctcagatgacagctaagttggggctgattttaatagtgtgagaggtaggctctctctcatgcatgggtctcaagttgggccctcaatttctccttcaactttaaccctgcatatcttgtaggcagaaaaattgtaagtggaaggttttgtgggtgtgttggtggcccaatccccccacatgcaaagtcttgcctgattacaggagatgaccaatttaggcttcatattccccactgatagaattcttagctaaggtcaccatcacagattcatgagagtttctattgcactaggtttgtagctcttcccagagatgcctcccggattccagttgtttcttccagtaccctctctctctgtcctctcctcacctgcttctttctgttcctatctccaccccatccaatcttctgttcacctaagttgtctattctatttctcatttcagtgagattcaagtgttcctccttgagctctccttgttacttagattctttgtgtcagtggagtgatgcaattttcaacaaatatctgcttaggagtacataccaagtttgtctatctgggtctgggttaattcactcagaatgatctttgacatttttgttatgataattttaaagtctttaaacagatttgcattatgtttattcatgtgtgtgtatctgtagtgtgtgattgaatggcatgtgcacatgggtgtctatgggggctagaagagattgtagatctccctgcaggtgaacttacaggtggctgtgagcttttgacgtgggtgctggcatctacactgcctctctgcaaaagctgcaagcatacttaactgctagccacctctctggccctttttgtgatttttcaaagagggactgattaaacagatgtcaggaatatggacttcagtgcttccttttcatctttttataattttaacttctcaatatgttacccattttaagaaaaaatactttaaaatccacaaggagacataaaagaccaaggatagccaacacaatcctgatcaaaataaaaaaaaaagatatgtagaccaaatagaaagaaattgaaaaactaaatgtaagtacttcatattcagccactttatatttgaaagagatgccaaaaatataacctggaggaaagaaaatatcttcaacaaattgtgatgtgaaaactagatgtccttgaatataaagggagtagggaggaatatatggagcagttcagaaggagaaagagggagggaggaatgcaataattaagttacaatctaaaacattacaaataaagttgtactcttcaaaaaacatggatgtccacatgcagaataaaattagacccttatttatcatcatactccaaagctaactccaagtggatcaacagaccacagtgtggaacctggaacagtgaaacagcttgaagaaaacagaagcttctgtatatgacatacacataggaaaggactttctgaataaggtttcatttacccacaatttaaagccaacaaatgacaaatggaatttctgcgtggctaaagaaacaatcaaccagaggaacaacaatatgaaccaaccagtatgcccagagctccctgggactaaaccaccaatcaaagaaaacacatggtgggactcatggctccagctgcatatatggcagagcatggcctagtaggtcatcaatgggaggagaggcccttggtcctgtgaaggctctaggccctagtataggggaatgccagggccaggaagcaggaatgggtgggttggggagcagggggaggggggaggggaaaccaggaaaggggataacatttgaaatttaaataaagaaaatatctaataaaaaaaagtgagagaaaaaggaagcctacagaatgggagagactcttgccagctgtgcatctgacagagattcaatattcagaatatacaaaaaccaaagagtgtaaatgaacaaacagacaaacccaaatgaccctttcaaatgatggacctggaaagacagggatctcaaaagaagaaagaaaaatggcaaataaacagctttaaaatgttcattgtacctaaccactgggaaaatgtttgtcaaatgaactttgagatttttctcttacccaagtcagaatggcaaagatcaacaaaacaactaccaacaaatagtgttggtggtgttgagaactggtttagccacttgaactcaatgtggacaattctcaaaaagctaaaaataaatctatcctatgactcaggcataccactccttggcatgtggtcaaatgactcaacatctcattccacagataatagttaggccatgtttatttctgctctattcaaagtatctagaaaataaaaaccacctaaagtacccttcacccaaagaatggctaatgaaaatatagtatatttgcactgtgaaacactattcagttgttaatgaataaagtgaaattacaattttcccataaatagatagaattagaaaagactgtactaaatgagatgacacaaagctagaaagactaatgtcatatgttctatgtcatctgaggttctttttttaaaatttattttttattagatattttcttcatttccattttccagatattaagatgtgagtaaacaatctcagtttctctttttctaatgtttaaaaattatggtttgagtgaagagtgactctcagaggctctaatatttggacacctggctcccagtcagcagcactgcttgggagggtgttgaaggtataaagaaaggtacttcatttacacttgtgtacttttaagatgcttcattatgtataaacacatatttcaatttacaaaagatgacaatgcccaaaatacttcaagcaatattctgatcagttttattttcacattttaacttctaaaattatttctatacttatcctatacctactaagtaattaattatttcgagcaataaatttttgagcagttccatactgctttaattattatagttttaagctatgttttaatgtggtataatatacactttgttcatttttctttaattttttctatattttctctcaggataaaaaagaaaaaaatctacagattcataattatcatgcattaacaaacttctatgattttgtagaaataaactttcccccataatactgaagcaatcaaactaggtcttgagagacagaagcaagagttgtacaagttacatgttagtctgagacataactctgcctcagaaagaagccaataaacacgacttgttgattgtacttttcatgtagacttaggaattcttttcaactgagatacataatatttattttatctcactattggtctcatctaaatttgtctttaactgtatggcttggtgtagtagttattttttttcctttagaaatcttttctgcctattctttcgagtgctatgaataatttttagactcaagggaattgtctttcttaactataataatcattgataccagtcattttcttttacttggtaaatcctatagaactctagttaaagcttaatctaccacgggagatcatattatccctatctgtcataaatgagaaacaaaccctagagtgtatagacaacatatccatgatctcataatgaatcagttgctacagaaagatcaagatatatttcttgtatgttattagtttttattttaattactgctatagcattattccacttaatttaaatttcattttcatttgtttacagctggatcagcaagcacccaggtctgcatagtttttatatcactcatagattcactattgtgctttgtgcttactagatattttgtcaatatgagtagatgctgcctaaaaattaaaagctgttccatctaatgagatatatacttaggaccacctcttacggctactcattaataacttcatgaaaagtgccatctaatggttggtgtgttacaatgacttggcttttttggtgtgtccccgccctcttcccccgccccaaaaatgaataacacaatcttatttaaaaaaataacctatctggcataaacagattataacttaaaattttaaattaaattcaatcaaaatttttataattcttaaataatgaatatttaattttattttatgtccattattgtgactccaggaaatggagttgcagacagttgtgaattgccatgtggggtttgggaattgaatatgggtcctctggaagggcagccagtggtcttaaccagtgaggcatctatctatccctatattcttaaatacttttaggggtttttctctctaaagtatacttcacgtttgttcataatgaactttgatatgatgaaagattaattttgagaaacattggatataaggaatgctacaagtatataaaatgtgttatttgtttatacattttatttttaagatttaggggttattgttagatattgagaagtgcaaatacatgtgtgatgggagttcatattatttttaattgtattaataaaattctattagtcgtctttgcactatattcggaatggtaatcccttttcagaggaaaatttattataaatgtctgaaaatgcaaaggatgttatttttaatttataacaaaatctcctctgcatatcttcttaattaaaatgtagatacacttaccaatgtcaaatattgttacattattatccattgtaaataataattaccctttgttcttcaattaatttctgtaattgagtgttcacaatatgtacaatttaattcagatattatgactgttgactattcttttttgttgttttgtttttgtttttgttttttgagacagggtttctctttataaccctagctgtcgaattagtgaatgtgtggcttctaaattttgtaaattcatagtttagaaccaataactcatctttgcatatgccagaattacatattttaagttgacctctgttcctaaactgagtattttatatgagtttatttatatttttatcttgtgcctaacaagtcttcttgccttcaataataacccttctcatttgatgaatgactgtgtgtcaacaaacctagaatgtagttaaacatgtaatactgaaaacaataaaatctatgtccctaatgtgtactagttacgactgcataactatctagtttgcttcctattattgtgctaaagtccattaccaaaagcaaattggagaggagaggggttgttttgctttcatgccccaatcactgtcaatcagcccgttactgagaaaagtccaggcagcaagtcaaggcaggaacctggaggcaggaactgaaatagaggtcatggaggagtgatgcttattagtttgttcttctggcttgctcagcttgctttcttatacaactcatgactacctgcccagacatgacatttctcacagtgggctgggccctcccaaataaatcactttgggggagaatgccccacaggggtcattttctcaactgagtcttcctttccaaatgactctagcatgtgtcaagtatataaaaaaaacatatccaacacaataacagactttaagctgaagtgtcagattgtgcttttactggaacacactcctttataaccaggaaaacaggtttcaacaagatggtggcatctagtttgagctgaagttaaataatatttagggagattctccagtaataactagaggaagacaagataggaggctagcttacatggtaaactacaggtgctaaagatgaaacaatgattaacagagttttatattttccttgtacaaaactttcagaagccagtttgacaaaatgtgttcaggtttgttgtgcataaatgctgtgttgtttgcatatgttattctaattcctcttgggttgttttgtcctaagcattccagctctatagtagtgtatgttttggggattagaatgtcccttactatcttcccagtctctatgtgtttttatagtagagaatgatacttttctggctccagaacattattccctagtgtggttgaattcagagcctctagcctgaagcttggaatggttaagaattgagctattagtgatgaaagagcaggcacatagggaaaagggagataaaatacagtattagatgctttatgatccacttgtgaatgctgagaagtaagctgacatcaagtggcagttattcttggctagtttccatggtcatgtgctgctacagactgcgaagtgattcattacaaatggaagaagaagaagaagaagaagaagaagaagaagaagaagaagaagaagaagaagaagaagaagaagaagaaggaagaggaggaggtggaggaggagaaggagaaggagagaggaggaggagagaggaggaggaggaggagaaggagagaggaggaggaggaggaggaggaggaggaggagagaaggaggagaaggagaaggagaaggagaaggagaaggagaaggagaaggagaaggagaaggagaaggagaaggagaaggagaagaagaagaagaagaagaagaagaagaagaagaagaagaagaagaagaagaagaagaagaagaagaagaagaagaaggggaaaaaaggtgttcttacaacctggacaagtggcaaagcatatgaacgagaacgtcttatgaattctcttttcagtttagcatctttaaaatgttatttcttagctggacatggtggcacacacctttagtcccagcactccaggggcatgggcatgggcatgggcaggggcaggggcaggggcaggggcaggggcaggggcaggggcaggggcaggggcatctctgtgagtgcaactccatactgagttcctggatggccagaaactggatagtagagacactcttgtcttaagaaaacaaaagcaaaaaggtatttctcagcatgtaaaggagatgtctacaaaacccagcaacttgatttttattgcttcatgttgttttccaaataccacacatattctacagcatgtgtgcaacacacacacacacacacacacacacacacatgcatgagcacacacacacagaataaataaatgtaaaaatgaagagatacttattagtttagaattataagcttttatttgctcattgtgagaaattgaaagaaatacatataacaagatattgaatataaaaagccattgttggttgcatgcatcctttcatagttttcttatattgattttgcaagtgtgaattactgccttaagttgatttttaagttggagagttgctgttaagtttgtatttaatgattttcccctttatttcctataggcctgccatgggtgttcttctggatcaaaatgtgactgcagtggtataaaaggagaaaaggtaagttctgagtaaaaaaaatagatatatcaaatactatttgtaaattaattgtacaaattatgcttctatcagtgtccaaataaataaaatagattctactgcattgcttaatttagagtgggaacttacatagatgagactgtgtcaggatcagcaaacatctcgatgaaacatgatatcataaatattttaggtttagtaaacataagttcggttacattttattttctgttggggattggatccagggctttgcaaaatctaagcaagcagtctacaactgtgccacattcctagggggggttctcagaaaattggacatggtactaccggaggatcccacaatacctctactgggcatatatccagaagatgttccaaccggtaagaaggacacatgctctactatgttcatagcagccttatttataatagccagaagctggaaagaacccagatgcccctcaacagaggaatggatacaaaaaatgtggtacatttacacaatggagtactactcagctattaaaaaagaatgaatttatgaaattcctaggcaaagggttggacctggagggcattatcctgagtgaggtaacccaattacaaaagaactcaaatgatatgtactcactgataagtagatattatcccaaaaacttagaatacccaatatataagttacaatttgcaaaacacatgaaactcaagaagaacgaagaccaaagtgtggacactttgccccttcttagaattgggaacaaaacacccatgggaggagttacagaggcaaagtttggagctgagccgaaaggatggaccatctagagactgccataatcgggggtccatcccataatcagcctccaaacacagacaccgttgcatacgctagtaagattttgctgaaagtaccatgatatagctgtctcttgtgagactatgctggggcctagcaaacacagaagtggatgctcacattcagctaatggatggaacacagggcccccaatggaggagctagagaaagtacccaaggagctaaaggggtctgcaaccctataggtggaacaacattatgaactaaccagtaccccccagagctcatgtctctagctgcatatgtatcagaagatggcctagtcggccatcactggaaagagaggcccattggacttgcaaactttatatgcctcagtacaggggagcgccagggccaaaaagtgggaatgggtgagtaggggagtgggtgggagggtatggaggacttttgggatagcattggaaatgtaaatgagtaaaatacataattaaaaaaaacacaaaaggacaataaagcctcagaaactactgagaattcttaggatgcacctagggaaaggacaaggaaatgggcagggaatgggaagcagagattggggagaatgaacaaaattaattatggataaaagtcctctcgaaacatctattactttacaaataaatcattttcttctgtcttgttttagatagggtcttctttgtaaccctggctggctttgagctcactatgtagaccttgagcttacacagaacaacctgcctctgtctcccaagtactgagattcaaagtgtgagccatcatctccagccttacaggaattttaataacaataataataataataataataataataaatttctagctcttggtctagacaaaatacacctcagatgacatttaacttgatggcttttatcttccagtgccttatttgtctgtgtgtcagtaactgacatcaaattaagaatttcaaacaagatcatgaattatagacaggagaattatgagaaagggatcttacattactctttcctctttttaactcaataaatatttttaatgaataaacaactattaataactatatatgaagttatggatcatatctttagtgaatattccagttagatatagaagtattcattcgtgcagtaaaagatgctaaaaagtcctggtgtcaacaatttcatcaatttatgttatgtattcattgtatgctgtgatcttatttacaagttccattctgtcatgtaacacagtacccctgtactggctaatttgtgtcaacttgacacaggctggagttatcaaacagagaaaggatcttcagttggggagatgccaccacaagatccaactctaaggcattttctcaattagtgatcaggtgggaaaggccccttgtgggtgggacgatccctggactggtagtcctttttttgttgttgttttgattttgtttcttttttttaatttctttttttaattaggtattttcttcatttacatttccaatgctatcccaaaagtgccccataccctcctcccctccactcccctacccactcactcccacttcttggccctggcgttcccctgtactgaggcatataaagtttgcaggatcaatgggcctctctttccactgatggccaactaggctatcttctgatacatatgcagctagagacacgagctccggggggtactggttaggtagtcttgagtactataagaggaggctgagcaagccaggggaagcaagccagtaagaaacatccttccatggcctctgcatcagctcctgctttctgacatgcttgagttccagtcctgacttccttggtgatgaacagcagtgtggaagtgtaagccgaataaaccctttcctccccaacttgcttcttggtcatgatgttttgtccaggaatagaaaccctgactaagacaatcccctaacagaacatctcttaagagttcttgaatagtagtctagataacacttgtgtgagtaacatttttaggggaatatctttgcaacaagaatgctttctgtagtgttaaagtattaaagaggtttcatttgagatcacaaaggaggaaagaaagtggaagggaatgtcttttaaagaaaggaagcacacatggagaatttacatgtatgtagatattattgcttatacttctcagtctgcaagatgatggatgggtaaattcttaccaagagtcatagttatggtcacaatgacctacagaaaatggttcaagactccagagtgcctggaaaagaaggaaggcatgttggaatgaatataagacagcacagagtggaggacaaaaaataaagttgaagattccattcaaattcttggttaagttttgattttatatgtattgagggaaagtcacagaatctaataaaaagaagagtagaggcttaaaataactaagtatagattaaccattgtttggtgaacggataaaactccatttaatcaatcagtcacgaactacttcatacaaaaaaaaaatgctctttagaagaaaataagagaatctagtatctctttctacagtatgcaattaaagcttaccaagtaaacacaaccaataattttaaaaaaagacaaatcacagaaaattattaaaacaatacagatgctacattttggaacttgaagcagataaagttaatatatttattaatttaaaaggaaaacctgttcaaaattgataaacatgtagtaaccacagatcactggcaaatacatgaaaaagaaacttgaaatttgaaaaataaaaagcagtttatccaaggagtatgatagcaaactgttggcttggagctgctgacaaatgcagatttccaggctccacaactgtaagttacccatctcgttctggtcatggtggaaaataattgattttgacaaactctccacgtggctcttttacaagctgaagtctcagatctatatagcttcattttgacagtagctaaaattcttctaattatagtgtggcaactgtctcattgtggtacagaattataaagagaaaataagaattatacagaacaatatattattgttttaatttcttcactaagaacttagccttgaacttgcacaatttgcaacattctaactgaaaataatttataactagttaccaatataacactttgtcttaattttttcctatgtccacacacaattgtgtttcttgacagttctacattatccttcttgaagtactattctcatgcttcctggagtaatatacaactggcatactagcactcaggcagcataagcaagatgactagaagttcaaggccaacttacatgagacactcaagaaacgaacaaacaactatttttatgctcattttcaggaaacacttttattgtttattataaacagctcttcttgaaaggggtgctatcttaaagtacttttaaactccagatcttaggtaatcagtagattaatcttctttaaactggtgagctgggatgtgcccaagggtagaatacttggctttgtattatatctgggactgtagatttgatatctatcaccacacaataaataaactagacttatcatgagatagtttttctttggataatttatcaaaacctgaaatattgcctttattctgggtttaagtaaaagcactcactagaaaataaggatgtcatttataaatggattttttgtttattttattagatattttctttatttacatttcaaatgttatcccctttcttagtttcccctccgaaaataccctatccctttcccccttcccctgctccccaacccatccactcctgcttcctggcccaggcattcccttataccgggtcatagaaccttcacaggaccaagggcctctcctctcattgatgaccaactaggccatcctcggctacatatgcagctagagccatgagtccctctgtgtggtttctttgactggtggtttagtccgagggagctctgggggtactgattagttcatattggagctagagaaaatgcccaaggagctgaaggggtttgcagtcccataggaggaggaataatataaatgggtttctattgaatatttgttctattggacactaaaaatacaacattgaaaaagccatgactgtttccatgtagaggcgaaggagatggtggtgtccaggttaacataaacttctgactgagacagatgagctgtgttctatgtatcaagtttacacttaggaaaattataaaacttctctctcatgacttttcacacataaaatgaaaataataattttactttgtcttaaaatggggagaaaaaagtaagataaaacaaaaccctgaaggaggttaaacagtctggaaaacagaaaaacattcaacacacgtgggctatttttacagtctttcgagttttaagtgtttggggaaatgcttaagaaagttgctaataagaacttaccattactattttcaattgtccagggaaaaagagaaggcaataaaagaatctaagtaatacttatatttaaaagatagcaaaaagagaataatgtatttcacaaatcatttttttaattcaaacatgggcaagcaggataagtcggtggtttgtttttaagtttgtctttcagaaataggcaaccacttctcattcagtctataaatgtgtgaaaattacagcacaaactgatagtggtttaaacggattatatgagtacctctgaagcaaatctaggcacatcactagtgttagcttttcttcctgttcatttaaagaaattaggtagaaaaccatacttttagtccattcttgcacaggaaagctatatttcttttactttagcaaacattctacctttgaaattctcaagattgttcttcttgttcttttctgctactgtatagcatctacttttctgtctctagttctgtgataatgggagggaatttcaggatataccattaaaaattataacattttattgatatcaacataattaagcttttagcatcctctattttcttctacaatttttactggtacatatgtatacatacatgtatgtatataacaaaaatgattaaagaaaaaaaggctatcaatttgtgtgaaaggtgggtgcctgggaggggaagggggggcaaagggaaggggagagatgacgtaattttattgcaattaaaagcacataacaatttttaaaattatttttacattaattactttaatgtacatctctctgtgtatgtgtgtctctgtgtgtgcatacatgtacatgtttgtctctgtgtgtgtgtgcacacacatgcatgtgtttgtatatgtatatgtcacagtgtctgagtgcagaagtcaattctcttcttctactctgtggttcctgagaattgaactcagtcaggctttacctgcctagctactccactgggcagcatcctctatcttcagtctttggtcagatagtacttttgctttgaaaatacacatagcatactctagacatttgacaggggtatgctctaaatgccagctgaaaacccaaaatttagctattttgtactttgggaaatatacaaggactaggttcttttttctttttacttttctttctgagtggaacttgtagtcagagttttaatcctagttctgctagtaacagaccattcaataatgtgagataatctagctcttaaaatttgaaaattgtgaaattcttaatatacctgcttgccttctttattatcgaatgaggttaaagcagttattatattctcactttatctctgatatattatctaattctacaagtagcaaagaggttataattaactatatatgatatatatttgggatgatttggattttttcttctcacattttacagacttgtccatgttattagatactgtggacaaaacgtatcactatattatgttactttcatctgacagtcgtttgaacgttcgaaacacaactgtgtctgtgcttaaaagttcacaaatgactttacattcttgtttaattgcagggagaacgggggtttccaggtttagaaggtcatccaggtttaccaggatttccaggtccagaaggccctccaggacctcggggacaaaaggtatttgtttcagtagccaatcaacaatagcagaggaattaaaccaccataaatttgagacaagctatcaaatcgactaaaagtccactgaatcgtaatgagaaaatagtgcttaaatcaaaaaacagagttgaaggaactcttattttctgtattcatttatcccttctttcccatttttcctccttcaagcagtgattaattacctatagtcctttgtctaggagcagaaccccataaaattgtctcatttttatattaacatgtgcattgatactgttgttgttccagacttcttggtaatcttgctgttagaagatttctacctcttcttctgtgatggtttcctgagtcatagatgcagagatgttgatgcaaggctggattccccccaaaacactgatctcttttttttgtccagttgtgtgtggttttgctgttgttgttgttttatgatgttcttcatttgccataatgagagatttctttgatgaatggtggtaactagacttattcagaaaaagtgtctcttcaccttagtgtttctaatgcttcaatttggatattattgtcatagtcaggtatttttcaggatgtcgtttgttatatatggtttttggaattctttctactttaaacttgtcctggggagatgcaaataaacatcttctcacccaccccctatgaacaccaatggcagacaattttatgatttatccaaagtccaaattgtgttgaccaaagaatttactggacttgccaactgaacatgaataagggatttcctacagaagtgtaggtgactgcaaaacagctgtatcactacaaggttccaccatatcatggataatgatctcatggaggctgctatgaagtctcactttgaatcagcttcctaactctatgtactctagcatcaccctaaatcagatattgaatgggggagggtcaattgcttgaatctcagataagtgtctctagaataatttttcctctacctactaggaagtgttaaagttcaattatcattaccataggtctgatgcatatatatttttctgtgaataagagtagcatctttatgtgtacgataagatagggaatgggaaaagataatagtgaattttgagaccaagaagagtttctttcagtttttaatggctcttttggctccgagcccttttcagtctgtggtagattgactggtaaagtggtgtatgaaaggtccaactctattcacttgcccaaaaagcaaaaaaaaaaaaaaaacttgacttaataacatttccctctagctttattatttcatataatgatggtgtaccatatcattagaggattaagaaaatcaaatggatatcaccaggtagtctttctaagaaaggaggaaaattaaatgcttggagatgttttaatataaagctagctataccagagggtagatgttgtgagaatgagggtacaactgtgaggaggaagtttttttttttttcagattcagcaggaaatgagtcttgtggttaaatgcactgaatagaacttcatatgaacactaaggaaacactaacactctaaatgactgactacatagaattttgaaagatgggccattcaaatgaatttcctaggtgctataacacagcaagtgtaagagtggcagtataatccttgccacccaggaatggcaaagaagtagtgcagacttctaaatcatgaactgagcataatacagcaaaacaactaaattcttccacttcgcagcacactggaacttaagcaacaacattctgaaaataaagtgggaacacaaattgattaattttcagctatgttatggaaatgagtgctttggaatagaatgtaatttgaaccatagaaaaagctgtttctcaaatgtgagtttatctgggaacagggccagagtttcttgcataacatggatattaagagtaaatatttgtggtttattaaaagaagttacattacaattattttgaaataatttagcattaactgagacttcttaataatagtataatagtttatgaagatgtgttcattcgcacattaagtttagagagtattactacaattccttttcattatttatagagtggaagtgggaacagctttctaaacattttacattctacagcttaaagtgtacttttgtgtgattggagatttactttttaaagttatatagatgattattcttcattggtatattcctttttatgaacatgtagatttgtaaaataaactgtccaattagcatagttgcttaaagtgtggtactgagatgtgtgtgtttatttatataaatgcacatttgtaatattgcaaaggagttctttgttaaattaaatgttccttttcagtagataatatattcattttattcacaattagtaaatattatgaatacaatgaaaaactcttttctacctgtgttcattggtccctgaatacatacccacattttcatcctctttgtttttaaaataggatgtattatgtttattttgtgtttttcttatatcagtgttctcaggatatgatattcttactacattcaatttcattgtatatataagctataaattagtatcaagctccctactcatgattatgtagttttcaatagtttgctgctataaaacataactgctaagatgaaaatctttgattaattcttattgcatcaataagcatgaattggaaagataaattgtgggaaatgggtgcccatgtctgcacatgtttttttacacatattaccagatcactatttcccaaacatttatgatttaccctttgatttagcaacaaagaagattcattttctcgcagattcatctctattcctaaaaaccttttctagttgtcattatggtagaagagtgacctttcaatatactttcaatttgcatttctctttttgtgattacgaatatgcttctcacagatcaaagtttcctttgtcttcctgtgatctctattttcatatcatttgccccttttctcatgacttggtgctttcatattttgtagagctatttgttaggaagattatttccatgcacacactgtacgttgtattattttaccctttgtcttttgcttttgtaggcatgtgcagggaaatttatgcatttatgaatctctgtctttaagtcacatggattttcatgagaacaaatcttatgcactttgagggtatatattaattctcaaaagttttctttcagtatatcaatttattttttatcctgtgtgaaacccatcctagtatacggtttgtgatttaagatacaccttaaacacaatcccacaacacccagaggaagctctattctcagatgctctaacatgccaggattgtagaatcaaaggtgaggaggacacagcatctgttccaacaacaccagaagcaactgggactagtgggatccagggacacaggaacctcgcctgaccagtgactcaggttccttctgctctacaccagtttaccttgggcacaaactccagagccagtcccacaccacccttaggaagctccactccaggctctctaacatgccgaggatcacagaatcacaggataacaggatcccaggagtttggccataccaggatctcagggtcccagaggcagcttgattcccaggaactctgacacacccaggatctcaagatcacaagatcctggaatcacaagatcacagagacagctggactctgagcagttctgacacaaccaggatcacaggaaggacaggctccagtcagatataattagtccaggtagcactagagatggcagaaagcaagcacaagaatataagcaacagaaaccaaggttacttggcatcatcagaacccaattctcccaccatagcaagtcctggttccactattacaccagaaaagcaatactcagatcaaaaatcacttctcatgatggtgatagagaacattaagaaggatgtaaataaattccttaaacagatacaggagaacacaagtaaacaggtagaagactttaaagaggaaacacaaaaatcaagaattacaggaaaacacaatcaaacaggtgaaggaaattaacaaattcatccaagatctaaaaatggacatagaaacaatagaaaaaaatcacaaagggagataaccctggagttaggaaacctaggaaagagatcaggagtgatagatgcaagcatcaccaacaaaataaaagagatagaagagagaatctcagaggcagaagataccatggaaaacattgacacaacagtcaaagaaaatgcaaaatggaaaaagctcctagccaaaaacatccaggaaatccaggacttaataaaaagaccaaacctaaggataataggtatagaaaagagtgaagattcgcaacttaaagggccagtaaatatattcaataaaattatagaagaaaacttccctaacctaaaggcagagatgcccatgaatatacaaaaagcctacagaactccaaatagactggaaaaaaaaagaaattgctcctgtaaaataataatcaaaacacaaaatgtactaaacaaagaaagaatattaaaaacagtaagagaaaaagatcaagtaagatataaaggcagacctatcacaattacaccagacctcaccttagactatgaaagccaaaagatcctgagtagatctcatacagacactaagagaacacaaatgccagcccagaatattatacctagaaaactctcaattaccatagatggagaaaccaagatattccatgacaaaaaataatttacccaatatctttccacaaatccagccctacaaaggataatagatggaaaacacaaacaaaaggagagaaaacgaagaaaataatctttcgacaaacccaaaagatgatagccacacaaacataattacacctctaacaaacaaaaataacaggaagtaacaatcatttttccttaatacctcttaacgtcaatggactcaattccccaataaaaagacatagactaacagactggatacataaacaggacttagcattttgctgcatgcaagaaaaagcctcgaagatatgggcacaggggaaaaattcctgaatagaagagcaatggcttgttctgtaagatcgagaatcgataaatgggacctcataaaattacaaagcttctataaggcaaaagacactgtcaataagacaaaaaggccaccaacagattgggaaatgatctttacctatcctaaatcagataggggactaatatccaatatatataaagaacccaagaaggtggactccagaaaatcaaataaccctgttaaaaatggagctcagagctaaacaaagaattttcacctgaggaataccaaatggctgagaagcacctgaaaaaatgttcagcatccttaatcattagggaaatgcaaatcaaaacaaccctgagattccatctcaaaccagtcagaatggctaagataaaaaattcaggtgacagcagatgctggcaagtatgtagagaaagaggaacactcctccattgttggtgggactgcaagcttgtacaaccactctggaaatcagtctggtggttcctcagaaaattggacatagtacaaccagaggattccacaatacctctacttggcatatatccagaagatgttccaactggtaagaaggacacatgctccactatgttcatagcagccttatttataatagccagaagctggaaagaacccagatgcccctcaacagaggaatggatacagaaaatgtggtacatttacacaatggagtactactcagctattaaaaagaatgaatttatgaaattcttaggcaaatggatggacctggagggcatcatcctgagtgaggtaagccaatcacaaaaaaaactcacacaatatgtactcactgataaatggatattagccaagaaacttagaatacccaagatataagatacaatttgctaaacacatgaaactcaagaagaacaaagaccaaagtgtggacactttgccccttcttagaattgggaacaaaacacccatgggaggagttacagaggcaaagtttggagctgagccgaaaggatggaccatctagagactgccataatcggggatccatcccataatcagcctccaaacgctgacaccattgcatacactagcaagattttgctgaaaggaccctgatatagctgtctcttgtgagactatgccggggcctggcaaacacagaagtggatgctcacagtcagctattggatggaacacagggcccccaatggaggagctagagaaagtatccaaggagctaaagagatctgcaaccctgtaggtggaacaacattatgaactaaccagtaccccggagctcttgactctagctgcatatgtatcaaaagatggcctagtcggccatcagaatatcagtggaaagagaggctcattgatcctgcaaactttttatgcctcagtacaggggaacgccagttccaagaagtgggagtggttgggtgggagggtatgggggacttttgggatagcactggaaatgtaaatgaagaaaatacgtaattaaaaaattgattatgacctgggtgggtgattattcccctgagggggaagaaacgcacttcagtgataaggacagacactatctagagtaaaaggttggaaaacaatttttcaagcaaattgtcccaagcatcaagctggagtacccattctaatatcgaataaaatcaactttcatctaaaagttatcaaaaaggataaggaaggacatataatattggtcaaaggagaaatcttccaagatgaactctcaattctgaacatctatgctccaaatacaaggcacccacattcatgaaagaaactttactaaagctcaaagcacatgtcataccccacacaataatagtgggagacttcaacaccccactctcagcaatggacagatcatggaaacagaaactaaagagtgacacagtgaaactaacagaagttatgaaacaaatggatctaacagatatttatagaacatttcatcctgaagcaaaagaatataccttcttctcagcacctcatggtgccttctccaaaactgaccatataattggtcacaaaacaggcttcaacatatagaagaagattgaaataatcacatgcaccctatcagattaccatggactaaaggtggtcttaaattccaacaaaacaatggaaaacacacatacacatgaaagatgaacaatgttctactcaatgataacttgttcaaggaagaaataaagaaattaaagaatttttagaatttaatgaaaacgaagacacatcagacaaaaacttataggacacaatgaaagcagtggtaagaggaaaactcataggtctaagtgcctccaaaaagaaactggagagagctagcagcttgacagcacacctgaaagctctagaacagaagaagaagaagaagaagaagaagaagaagaagaagaagaagaggaggaggaggaggaggaggaggaggaggaggaggaggaggaggaggaggaggaagaaagtacacacaaaagagtagaaggcaggaaataatcaaactcagggctgaaatcaaccaagtagaaacaaatagtactatacaaagaatcaacaaaacaaagaactggttctttgagaaaatcaataagacagacaaacacttagccagactaaacagagggcacaaaaacagtatccaaattaataaaatcagaaatgaaaagggagacataagaacagaaaccttggaaattcaaaaaatcatcagatcatactacaaaagtttatactcaacaaaattgaaaaatctggctgaaatggacaattttctagacatatcctaggtgccaaatttaaaataggatcagataaatgatctaaactgtcccataacccataaagtaatagaagcagtcattaattgcctccaacctaaaaaaaacccaggaccagatgggtttagtggagaattctatcagaccattaaagaagaactaataccagtactcttcaaacaattccacaaaatagaaacagaaggaacactacccaatttgttttatgaagccacaatcacgcatttacctacactacacaaagaccaaaccaagaaagagaacttcagaccaatctcccttatgagcatagatgcaaaaatactcttgccaagcgaatccaagaacacatcaaaatgatcattcaccatgatcaattaggcttcatcccagagatgcagggatggttcaatatatggaaacccatcaatataatccatcacataaacaaactcataggaaaaaaaccacattatcatttcattagatgctgaaaaagcatttgacaaaactcaccatcccttcattaaaagtcttggaaagatcaggaattcagggcccctacctaaacatattaaaatcaatatacagcaaaccagtaccctacatcaaactaaatagagagaaacttgaagaaatcccattaaaatcagggactagacaagactgcccactctctccttatctattcaatacagtacttgaagttctagctagagcaattagacaacaaaaggaagtcaaggggataaaaattggaaaggaagaagtcaaaatatcactctttgcagatgatgtaatagtatatataagtgaccctaaaaattccaccagagaacccctaaacctgataaacagcttcagtgcagtagctggatataaaattaactcaaacaaatcaatggcctttctctacacaaaggataaacggactgagaaagaaattagggaaacaatacccttcacaatagtcacaaatattatagaataccttggtgtgactctaactaaggaagtgaaagatcagtatgataagaacttcaagtctctgaagaaagaaatcaaaagatctcagaagatggaaagatctcccatgatcatggattggcaggcaaatagagcaaaatggccatcttgctgaaagcaatctacagattcaatgcaatccccatcaaaattccatatcaattcttcatagagttagaaagagcaatttgcaaattcattcagaacaaacaaacaaacaaacaaacgaactcaggatagcaaaacctattctcaacaataaaagaacttctgggggaatcaccatgcctgacctcaagctgtactacagagcaattgtgataaaaactgcatagtattggttcagaaacaggcaggaagatcaatggaatagaattgaagacccagaaatgaacccacacacatatggtcacttgatccttgacaaaggagctaaaaccatccagtggaaaaaagacagcattttcaacaaatggtgctgttcaactggcggttatcatgtagacaaatgcgaattgatccattcttatctactcgtacaaagctcaagtctaagtggatcaaggaactccacataaaaccagagacactgaaacttatagaagagaaagtggtgaagagcctcaaacacatgggcacaggggaaaaattcctgaacagtacaccaatggcttatgctctaagatcaagaaacgacaaatgggacctcataaaattgcaaagcctctgtaaggcaaatgacactgtcaataggactaaatatggcaaccaacatattgagaaaagatctttaccaatcctacatctgatagagggctaatatccaatatatacaaagaattcaagaagttagactcccaagaatcaaataaccctattaaaatgcagtaaagagctaaacaaataattctcaatggagaaataatgaatggagagaaacacctaaagacatgtttagcaccctttgtcattaaggaaatccacatcaaaacaaccctgagattccacctcacaccagtcagaatggctaagatcaaaatctcaggtgacagcagatgctggcaaggatgaagagaaaaaggaatacaccattgctggtgggattgcaagctggtacaaccacttggtggttcctcagaaaattggacatagcagtacctgatgacccaggtataccattcctgggcatatccaacatgtaataaggacacatgctccactatgttcatagcagccttatttataaatagccagaagctggaaagaacccagatgtccttcaacagaggaatgtggtacgtttacacaatggagtactactcagctattaaaaaggatgaattcatgaaattcttaaagaaatgtatggaactagaaaatatcatcctgaatgaggtaactcagtcacaaaagaaaacacatggtatatactcactgataagtggatattagcccaaaatctctaaatactcaagatacaattcacagaccacattaggctcaaaaattaggaatactgaagtgtgggtgcttcagtccttcttagaaggagaacaaaatactcacaggagaaaaaatggagaaaaagtgtagagcacagactgaaggaaaagccatccagagactgtcctacctggggattcatcccatatacagttaccaaatccagacactattgtggatgccaaatagtgcatgctgacaggaacctgacagctgtttcctgagaggccctggcagaggtggatgctctcagccaatcattggactgagcacggagtcctcaatagaggagttggagaaaggactgagggtgtttcaggggtttgaaaccccataggaagaacaacaatatgaaccaaccagaccccccccccagagttcatcaatgaagccaaagccatcaaccaaggagtacacatggctccaactgcatatgtaacagaggacagccttgtcaggcatcaatgggaggagaggtccttggtcctatgaaggcttgatagatgccccagtgtagaggaatcgagagcagggtggtgggagtgggtgggtaggtgggtgaaggaacaccctcatagaagcagggggaaggatgggatagggaatttccgggagggggtaaaaattgggaacgtggataacatttgaaatgtaaataaagaaaatatccaataaaaatgccttgattttttctccactcatttacaatgaaatattcattatagagtagccaccctttatttgtagtttcatttcccatgatttcaatcatatgcatccaactactgtatggaaataagctgaaattcttaaaattaataattaatgttttccaaaactcattataatatgttgttatatttgttttatattaccctttgatatttttaaagtcttccagtgtttataaattttgttacatttatgtgtacatatgaaaatagaaatttgaatatagaaatttgctttctgtctacattttcatgtggtgactatgtgggatcttagaagctatccttggctaaagagtggcttctgttttctaagttcatttgagctttctttctgaaaatcttctagtattcactttatccaaatctaagtcccaaactattttaataactgaagccttgcttcacttttatgtctgactgatgtagggcccactatgttcttttttctttttacaagttttcccacagatattgctggggtgtttttgcctatataaactttggagctactgtctagtcttaaaaaaacccagtaacttctattttcattatataaaatttctatctaattttgtaatttactgtttaaattggattcctttttttaaggacatggaatttcttttttatacatatttaactacttctttgtgaagttcacaactgtttttaatcctttcctcttgtaaatcttgtgcatttcttgttaaatttactgcaaaatattttgttttgtcattattggttgagtattttcttctattaagtcttgtaaatggttgttacaataataaagctatcttttagtattcactttaatccaaatctaagtcccatttattttaataatgtgaagcaaggctatgaagacaaggctggcctcaaactaggggcatttttttcttctttaaccttttgacttttggcaatacaggtcctccataacttctaactttgtaattttctttcctgaagttcttctttaaccatgttgctggtctaactggtgcaatactcacacttttgtcttatttctgccttcagtgagaaggcataaaatatttattgaacaagagatcttctagttattttaactgggaatcagaatccattgaatcttctcacaaacaagtctgcttcagaaagagtatgtcattaaactttttaaaaggagacaattttaaagggacttacagactttgcattaacagtattcatgtccttgtcaaaatctgtggatatactactttacaccaaactgtattaggtcttttttattcaaaactttaaagaaaatacttaacaaaaaattcacggagataaaattgaaacttttcagcaatgcaggggtgactaaaagtgagtaggtagaatttgcaaggaacagagaacagaagctggaagggagagtttatgacttttaagttctataaaaagtgctttctgaaataaatggaaagataaaagcaaaagttcacaaacaacacgtacacctgcagtttgatgtgttatagaaactgtcaagattttgattttctccgtctctctctctttttcttccctcatgtacaaatttatcttcattttcttgtgtgtgtcttgtatatctttctgcatgcaacatttcttcttcatgtcaacagtctccccagtaaaatactggccgttcttggtattgttcatttaatttatcagtggtttgaatcttaatcataattcttgtttgggtgtatgaaattagcactaattttcagaaaagtttaccaaaaaattcaggctagctaatgaaaaattagttattagatgactgctttgaaggaaaaaaaggaactaaataatattgtgtttttcagggtgatgatggaattccagggccaccaggaccaaaaggaatcagagtaagcaatattcagtgtacgggaaatgctttgttgttgtcaacagataagaccaagtaaaatggtatgagacaacaagaaactaattatcattgctcacaaacatatatacacatgtatgtttatattacatcatatagatacaacatgctaagttcatttactcttgcttctatgcattcatgatttcaaggatgaccacttgttattggataatcaaatggggggggggtcatccctgggatgaccttaagaaagactccctctcaagcgtcattatacatttgtagttttgtgtcaaaaggtgcagctctctggaattttttcccattcatattaccacatttgttcatagtcataactcaagagtattgtccatctatgtggggaactcaaggcagcaggggttcgtagcaactggtcccatcactttctcaatggaaagccaggatcgacagacatacttgtgctcagctcacttactttatctagttcattatccctttctcagggaatgatcctgaccacaatgaaaatagttcttctcacatcaattaatataactaagataatccctataggcatatccagaaggctatttccctagtaattctagattctgtcaagttaacaactaaaatgaaccattagaacagctctttgtcagcctgacacatcaacacaacacttttatgccataactttccaagctttgtcctcataggttcatgacaattatatgatctaaaatgcattcagtccaacttttaaagtccccttcatactaagcctcttaactgcgagataccataaaattaaaaaaaaaaaagcaatggatgtacttcaacataatagtggcacagaataaatatccctctccaaaacagaagtgggacatagcaaaaaataatcacttcaacataaattaaaatccaaacagataaagatcaaatcctgcaactctaaggctagcatctagaggttgtaatgtggtcaactggtatccaaaacaccttgagcagtcccacaaacccttagttataccacctacaacacatacattattccctaggcttgcttttttccatgcccacagctttccttggcagctgtcccttattcctgacatctccactatcttggggtctcaactgcaacttagtatgaacctttacaagttcatactttggcctcttaggacgtttttgcagagatttcaaccataccataaatcctctgaccttagatttaaaaacaaacaaacaaacaaacaaaaccccaataaacaaaaaataaaactttacagaatgactcagtgacctgcttaaacttatctttcatgccccttaaacttgtacaatgtgaactacattgccaagttctgcttctagctcttgatggaggctctgataacttcaggataactttttgtttgtcccagtgcaatgtagatttctcttcaatgatcctgacatctttatcaaatatatatattctcagtaccaggctaaattctctcccttattgaaatgtcctctgccaaatacattaatccattactttaaatttaccttccatcaacatctcaggaagtgatcagaatgaagacaaattgctggccaaaatatcatatgaatgctctctagcacaattgttggcggagtcctagttcctcctgaaatctcagtgacctgcccccactggacatattcctcccaatgttcttattttccaagttcccagaagaagaaccattaagctctgcttattgtattctgagacttttctttctttttaaaagtttatttatatatttttttaaaatgtaggagtgctctgtctgtatatatacctgcatgccagaagaggacatctaatccctttatagatggttgtgagccaccatgtggttgctggggattcaactcaggacctctggaagagcagccagtgctcttaactactgagccatctcaccagccccaaggacttttctaacccaatgtttcatttcttccacattcctcctgaaaaccatttccaaaggcctaagacttgcacagtcaattttatcagaacaatgtcccaattcttggtaccaatttctgtattagttcttttgctattgctcagataaaattttctgttaaaggcaatttaagggagaagagatttatcctggcctacagttcaggggttaaagttgttcataataatgattaaagccaaggcagcaagagttttaagctttaagttttaaggtcacactactttcttttttttttttttttttttttttttttttttctttccattttttattaggtatttagcttatttacatttccaatgctataccaaaagtcccccccatacccacccacccccactcccctacccgcccactccccctttttggccctggcgttcccctgttctggggcatataaagtttgtgtgtccaatgggcctctctttccagtgatggccgactaggtcatcttttgatacatatgcagctagagtcaagagctccggggtactggttagttcataatgttgatccacctatagggttgcagatccctttagctccttgggtactttctctagctcctccattgggagccctgtgatccgtccattagctgactgtgggcatccacttctgtgtttgctaggccccggcatagtctcacaagagacagctacatctgggtcctttcgataaaatcttgctagtgtatgcaatggtgtcagcgtttggatgctgattatggggtggatccctggataaggcagtctctacatggtccaccctttaatctcagctccaaactttgtctctgtaactccttccaagggtgttttgttcccacttctaaggaggggcatagtgtctacacttcagtcttcatttttcttgagtttcatgtgtttaggaaattgtatcttatatcttgggtatcctaggttttgggctaatatccacttatcagtgagtacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctgggttctttccagcttctggctattataaataatgctgctatgaacatagtggagcatgtgtccttcttaccagttggggcatcttctggatatatgcccaagagaggtattgctggatcctccggtagtactatgtccaattttctgaggaaccgccagacggatttccagagtggttgtacaagcctgcaatcccaccaacaatggaggagtgttcctctttctccacatccacgccagcatctgctgtcacctgaatttttgatcttagacattctgactggtgtgaggtggaatcttagggttgttttgatttgcatttccctgatgattaaggatgttgaacattttttcaggtgcttctctgccattctgtattcctcaggtgagaattctttgttcagttctgagccccattttttaatggggttgtttgattttctgaagtccaccttcttgagttctttatatatgttggatattagtcccctatctgatttaggataggtaaagatcctttcccaatctgttggtggtctctttgtcttattgacggtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttctttgatccatttagatttgaccttagtacaaggagataagtatggatcgattcgcattcttctacatgataacaaccagttgtgccagcaccatttgttgaaaatgctgtctttcttccactggatggttttagctcccttgtcgaagatcaagtgaccataggtgtgtgggttcatttctgggtcttcaattctattccattggtctacttgtctgtctctataccagtaccatgcagtttttaccacaattgctctgtagtaaagctttaggtccggcatggtgattccaccagaggttcttttatccttgagaagagtttttgctatcctaggttttttgttattccagatgaatttgcaaattgctccttctaattcattgaagaattgagttggaattttgatggggattgcattgaatctgtagattgcttttggcaagatagccatttttacaatattgatcctgccaatccatgagcatgggagatctttccatcttctgagatcttctttaatttctttcttcagagacttgaagtttttatcatacagatctttcacttccttagttagagtcacgccgagatattttatattatttgtgactattgagaagggtgttgtttccctaatttctttctcagcctgtttattctttgtgtagagaaaggccattgacttgtttgagttaattttatatccagctacttcaccgaagctgtttatcaggtttaggagttctctggtggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccagaacttttatcatgaatgggtgttggatcttgtcaaatgctttttctgcatccaacgagatgatcatgtggtttttgtctttgagtttgtttatatagtggattacattgatggattttcgtatattaaaccatccctgcattcctggaataaaacctacttggtcaggatggatgattgctttaatgtgatcttggattcggttagcgagaattttattgaggatttttgcatcgatattcataagagaaattggtctgaagttctctatctttgttggatctttctgtggtttaggtatcagagtaatagtggcttcataaaatgagttgggtagagtactttctacttctatcttgtgaaaaagtttgtgcagaactggaattagatcttctttgaaggtctgatagaactctgcactaaacccgtctggtcctgggctttttttggctgggagactatttataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcagttctgattttgttaattaggattttgtctctgtgccctctagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgtttcttcatggaggcactcagagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccacgtgagtgttggctttctgttattttttttgttattgaagatcagccttagtgcatggtgatctgataggatacatgggacaatttcaatatttttgaatctgttgaggcctgttttgtggcctattatgtggtcaattttggagaaggtaccatgaggtgctgagaagaaggtatatcctttggttttaggataaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggtgcaatgtgtgctttgagctttactaaagtttctttaatgaatgtggctgcccttgtatttggcgcatagatattcagaattgagagttcctcttggaggattttacctttgatgagaacaaagtgcccctccttgtcttttttgatgactttgggttggaagtcaatcttatcagatattaggatggctactccagcttgtttcttcataccatttgcttggaaaattgttttccagccttttattctgaggtagtgtctatctttttctctgagatgtgtctcctgtaaacagcaaaatgttgggtcttgtttgtgtagccagtttgttagtctatgtctttttattggggagttgagaccattgatgttaagagatattaaggaaaagtaattgttgcttcctgttatttttgttgttaaagttggcattctgttcttgtggctgtcttcttttaggtttgttgagggattaccttcttgttttttctagggcattgttcccgttcttgtattggtttttttctgttattaccctttgaagggctggattcgtggagagataatgtgagaatttggttttgtcgtggaatactttggtttctccatctatggtaattgagagtttggcagggtatagtagcctgggctggaatttgtgttcttttagtgtctgtataacatctgtccaggctcttctggctttcatagtctctggtgaaaaatctggtgtaattctgataggcttgcctttgtatgttacttgacctttttcccttaccgcttttagtattctatctttatttagtgcatttgttgttctgattattatgtgtcgggaggaatttcttttctggtccagtctatttggagttctgtaggcttcttgtatgttcataggtatctctttctttatatttgggaagttttcttcaataattttgttgaagatgtttgctggccctttaagttgaaaatcttcattctcatccactcctattatccgtaggtttggtcttctcattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctccagtgttgcctcactttgagttttctttattgtttctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttttcgggtgtgttggggtgccctggactgggcgaagtgggagtactgggttctgatgatggtgagtggtcttggttcctgttagtaggattcctccgtttacctttcgccatctggtaatctctggagttagtagttatagttgactctgtttagagattgttcttctggtgattctgttaccgtctctcagcagacctgggagacagattctctcctctgagtttcagtgctcagagcactctctgctggcaagctctcttatagggaaggtgcgcagatatcttgtatttggacctcctcctggccgaagaagaaggcccaaaacaggacctttctcagacactgtgttgctttggcagttcccagaagctgtcagcttctgtggtgcagactctcacctgtgcagactaaaatcctaagttccagggagtcctggaaccaagatggtgaccgctgctcctgaggccgaggccgtctcccgagccaggcggacacctgtcctctggtccggatggtggccggttatctgcggcccgcccaggctgctgcctcagcggctctgtgcttctgcccgttccagaagctgtccggttctctggcacaccctctaacctgttcagactaatttcctaaattctgctgagtcccggaaccaagatggcgaccgctgctgctgaggctgaggtcgcctcccaagccaggcggacacctgtcctctggtccggatggtggccggttatctgcggcccgccccggctgctgcctcagcggctctgtgcttccgcccgtcccagaagctgtccggttctctggtgcaccctctaacctgttcagactaatttcctaggtcccgcggagtcccggaacccagatggcgaccgctgctgctgaggctgaggtcgcctcccaagccaggcggacacctgtcctctggtccggatggtggccggttgtctgcggcccgcccaggctgctgcctcagcggctctgtgcttctgcccgtcccagaagctgtcaggttctctggcgcaccctctaacctgttcagactaatttcctaagttctgctgagtcccggaaccaagatggcgactgctgctgctgaggctgaggccgcctcccaagccaggcggacacctgtcctctggtccggatggtggccggttatctgcggcccgcccaggctgctgcctcagcggctctgtgcttccgcccgtcccagaagctgtccggttctctggtgcaccctctaacctgttcagactaatttcctaggtcccgcggagtcccggaacccagatggcgaccgctgctgctgaggctgaggttgcctcccaagccaggcggacacctgtcctctggtccggatggtggccggttatctgcggcccgcccaggctgctgcctcagcggctctgtgcttccgcccgtcccagaagctgtccagttctctggtgcaccctctaacctgttcagactaatttcctaggtcccgcggagtcccggaacccagatggcgaccgctgctgctgaggctgaggtcgcctcccaagccaggcggacacctgtcctctggtccggatggtggccggttatctgcggcccgcccaggctgctgcctcagcggctctgtgcttccgcccgtcccagaagctgtccggttctctggtgcaccctctaacctgttcagactaatttcctaggtcccgcggagtcccggaacccagatggcgaccgctgctgctgaggctgaggtcgcctcccaagccaggcggacacctgtcctctggtccggatggtggccggttatctgcggcccgcccaggctgctgcctcagcggctctgtgcttccgcccgtcccagaagctgtccggttctctggtgcaccctctaacctgttcagactaatttcctaggtcccgcggagtcccggaacccagatggcgaccgctgctgctgaggctgaggtcgcctcccccacactactttcacaatcagatgcagagcagtatgaatacactcatactagtgcacagcttactttcatccattttattcagttcaagatccccaagattaaggaatggacctgtccacaattaagataattcttcccacaacaattgataattccccacaggcatgcccagagagccatctctcaggttgattctcgagtctgacaagttaactgctaataccaaccagtatctggttagtatatggctggttttagaattagaggatactgggttaccaatagtggtagttttcaaagataagttctatcttctgtgaaccccagtttcttcacatgccagaatatctcttttagctccaaacttctgtttatagagaaatgtctcttactttgactattagatgcatggatggctacataacatgcttatatgtggattcttatcacaactttcacatttttaaattatttgatatttaaatatttagattaaaaacttgcacaaactttaaaaacattatattggctatataatttttagcagcttgtagtatcccaacttggtggatcagtactgggtatggaattttgactacttctcaaaaaatgtaaacaaccaatccaaaatgaaaatccatctcagttgccttatgtggtgtttataactggagtggatatagtattgaacaaaaaagacaagaaagtcaaaatctttagttaagatttattttatgtatatgaatgcactgtcactgtctttagactcaccagaagagggcatcagatcccatcacagatggctctgagccatgatgtggttgctgggagttgaactgagagacctctggaagagcagagggtgctcttaacccttgagccaactctctagtccaaaatctttagtttaatctgacaggtataactatgatttttgtagtaaattcatatcatatgtaccattaaagatcttcataattacacaatatctcaaatagccataaatacctacctgtgataagcacagtggaaactaaaaagaacttgtcattctattaacagcttcttccggatatcttggagtgttcttatagaccctctttctgaagtacaactttagagatgcttgatacagtatggacttttaggtgtcagattacagactattgttgatatacaaagtttaaaagtagaaaataaaataagtttagacaaagagaggacacaacatccttgtgcttatttctaccctcaaaacaatagaacactttgccattttacttagtctccaaacaaccaccatttttgcaaatgttttaaagtcaatccctcacatctttcactttgcaaatgaaacttcagtatgtctccatgactattaaccactatactcttgtcttatattaacaatttaaagattacttttcatttactctacacttcctcgggccaccatttttagctggtattttaataaattaatgaacatctatcacttcttgaagtagtgatcaaggaacgttttggctttttttttttaaataaccaattcataaaatgtaatgtttcaatcaattgaagctattacgtttttgaggtaagttctcactttgtagacttggctagactcacgatcactggcagtgctgatattaaaggtatgcagcaccatacacattagttttttgaaagccattttgtaccacccttaatctgttaggagtcttttcaagtttgcttcttgcccattgtcacttttacagaagtcattgatcactgagacgtccttgcttgctgccatacaagtctttcagaagcatcctctgcttttttttttttttgttttccctccaagcattgatccaatagcgctgcaataacaaacctaaagcagaacactgtgttttctaatttgtagtgtcctttgggatgggtgcacagaagtgaattgttatgttacaggatatgttgtattgttttggtagatattccaaattcccatgttctcaccacaggcaagagaacgagtttccctatgtcctcaccaacagaaatagttgtcgagttctattttactgatcccaacaaggagatttaattgaaagatgcttggggttagttatattaatgtcctcagagagagatccatttgttgccctctcatctcctagtaaatttattattcacaaacctgaaagaattttatctgtaaagacaggcatttctatctatctatctatctatctatctatctatctatctatctatctatctatctatttatttatttattttagttattttctttatattcatttcaaatgctatcccgaaagttccctataccctccctctgccctgctcccctacccacccactcccacttcttggccctggcattcccctgtactggggcatataaagtttgcaagaccaaggggcctctcttcccagtgatggccgactaggccatcttctgctacatatgcagctagagacatgagctctgggggtactggttagttcatattgttgttccaacacccaacatacaatttgcaaaacacaagaaaatcaagaagagggaagaccaatgggtggatacttcattcctccttagattgggaacaaattacccatgtaaggagttacagagacaaagtttggagctaagacaaaaggatggactatccagagactaccccacccggggatccatcccatagtcagtcaccaaacccagacactattgcatatgccagaaagattttgctgaagggaccctggtatagctgtctcatatgaggctataccagtgcctggcaaatacagaagtggatgctcacagtcatctataagatggaacacagggcccccaatggtgaagctagagaaagcacccaaggagctgaaggggtctgcaaccctaaagacagacatttcattcactgctttgctttccgctgctaactgtaatgaagaaaatgtgcttacaaacaggagactctagttttctgtaaaaggaattttaaagacaactctgtgaaagagtgttactaattattaaaccaacagtgattggtaacaatgaggcacattttgtaatagctttgtcatttaatcaagcgatttctttattattatagggtcctcctggacttcctggatttccagggacaccaggtcttcctgtaagtatggtttttattcttttaaaatccccctaagaagtaatataagaaatattataagtgtgttatatgccttttcaaaggggatgccaggccatgatggggctccaggacctcaaggtatccctggatgcaatggaaccaaggtgaggttggttttttttttttttcaacttaattgtaaacagattgttgattaaaatctaaaaagagacagggtcattttgtgtctaagacaacattttcagtatattaaatttcagtaatttatttaaacctgtttaactagtgaggatactgaattgggttagggggtattttaaaagtctttgtgtaaagtattataaatattaaaaatggattaagacttgtgtgtttcacatactatagaagttgttatgggtaatacttggtaatatcttactaattttgatttttaaaatacgtgctatttaaaattttgaatacttcatgttttaagcttaaaaaaattgtatgttattgatgccgtggaggaagaaaccgatgtatgccaccgagcacacatggggttcagaggacagcttgtgggtatttagctctttctaccttgtggactatgggtatcaaattcagattgtctgcactttggcaacagacacctttatctactgaaccatctcagtgatttgattcatgctttattttttaacttccttaactgtcactgtgaaaaatacaattttttcatcaacaaaaatggtgcacttaacaatttaaaaaccccaaagctttagataatggtacttttcttgtttggagtcaacaatttaacattaagacatagcaatacataatgaggaaaatgttcttattataaaatgatattttatagcatttgatttttttatttcttgttttttcttttcttaagtaaatgcaccattactttatgtttatccttttagcattttatgttttgtgcataagattctacaaaactagatctatactatattttaaaattaatgtcatatcccagatttttacattagggtatacactttagttaacttcctgcaatacaaggaacatgttttctgagattttaaaaacatacataaattgaacatattacttttaaacccagtatttctcaggtctctgtaacccttgccaacaataatattttttttttcttaacacagagtcccactatgtagctctggctagcctcagactcacagaaattcaccgggcctctatctcccaagttctgggaactaaatgtgcaccatgtttgtcgcaacaattatatatatatattttgagacagggtttctctatatagctctggctgtcctggaactcactttgtagaccaggctggcctcgaactcagaaatccgcctgcctctgcctcctgagtgctgggattaaaggcatgcaccaccatgcccggcataatttttttaatgtttagattttttacatttttattagatatcttcttcatttacatttcaaatgctatccccaaagccccctataccctccccccctgccctgctccccaacccacccactcctgcttcctggccctggcattcccctgtactggggcatatgatctttgtaataccaaaggcctattgatgggagtctaggccatcctctgctacatattcaactagagacacagctctggggagtactggttagtgaaacatttacacaatggagtactactcagctattaaaaacaatgaattcatgaaattcttaggcaaatggatgcatctggaggatatcatcctgagtgaggtaacccaatcacaaaagaacacacatggtatgcactcactgataagtgtatattagcccagaaacttagaatatccaagatacaatttgcaaaacacatgaaacttcgctccttcttagaatggggaacaaaatttccatggaaagagttacagagacaaagtttggagctgagacagaaggaaagaccatccagagactgccataccctgggatccatcccatatacaaccaccaaacccagacactattgcaaatgccagaaagattttgctgacaggaccctgatatagctatctcttgtgagtctatgccaatgcctgacaaatacagaagtggatgctcacagtcatctatcggatggaacacagggcccctaacaaaggagctagagaaagtacccaagaagctaaaggggtctgcaaccctataatgtgtagatcattaaggcaaatatctggaattgagaaatttatttatgttcttcattctagctgagacagtctttgatggttggaccaataggaattttgtttgtataacacatttcataagaaagtgaactatggtgatggagtaatatacaattgatgaataaagagataggctgttaaaggctttgaaataaaaaaaaagaaagtgaactattttgttcctattctggtggcatagctatgttttactttgttccttttcttgtgtgtgtgtgtgtgtgtgtgtgtgtgtgtgtgtgtgtgtgtgtgtgtgtgtgtttggtatgtatgcatgcatgtgtgtttgctagcataccttttgcaacaagaaaactagtattcaaagttttaaataaagaaaccaaatgcacatgcagatatatttatggtgaaagagatatttttcacaaagtggtcttttcatatatctaacaattaatttatgttttagggcatcatttatggaataagttttatataaattaagtaattttatcgtacatggtgactggttagactttttttacccttctcactaggtatgtaaaatttgattcctaatgttgcatccacaatgtatggattcttttctaatgtcattggacctagtttattttttattaggtattttcttcatttatatttccagtgctatcccaaaagtcccccataccctccccctcgctcccctacacacccactcccacttcttggccctggcattcccctgcactgaggcatataaagtttgcatgaacaatgagcctctctttccactgatggctgagtaggccatcttttgatacatatgcagctagagtcaagagctccggggtactggttagttcataatgttgttccacctatagggttgcagatccctttagctccttgggtattttctctagctcttccattgggagccctgtgatctatccaatagctgactgtgagcatccacttctgtgtttgctaggccccggcataatctcacaagagacagctacatctgggtcctttcgataaaatcttgctagtgtatgcaatggtgtcagcgtttggaagctgattatgggatggatctccggatatggcagtctgtagattcattggacctactttgtccatctataaaaggtgattcagagaaggccattgcatagtgattcaaaagcacagtggggtagtaattttgcccctttaagcctctgacatgtttgtttctagaattgctatagcatacataggcatttggaaagaatttgaattaattttcttctatctcaattttaacttgttttcaaaccaaatgtctatgttcctactttgcaatagtgaatgaaaaagattgggtacctaagaaatctaatggcctgcaatttctaaaaccgttgttactgtattcttggtgctatcactagctttattccttgccatgttttacattttgaaaaaaaattgaaatagtttacaataagaggaaagtgaaatggtaagtttttaataagaatttgtacagtacctgatcaggaacttgcagcaaatcattaacaattaaatgtgatggttattggaaatctgtggtgtgatgggctcaaagtagatttttcaaaagaatatgacagtgagactgttttctccttagatttggttggggtagatgagtacgaataagagtgttcggcttggtaggttgaattgccacagacagttgattctgaagttattggaaaggggatgctaatgacattttggtgatctggtatgcatttgtcgtacaaattttcactgtttcttttttctctacactcttcctttttaactcccagggagaacgtggatttccaggcagtccgggctttcctggtttacaaggtcctccagtaagttctacacttcaggattaaaatgaattcaagaagtaacagaacagaaaaagtgtgaatacagagtttactcaaatggaacagcatcacatatttaaagtgtaaactagagaatttcaaagattaactggcaaaaagacttcctgcagattaaagccaaggattctgtgatggctagtataaattttacctataaaatcctctaatataaaatattctaaagtgaccctataaaagtttattcattttgttctcctttatgttatattcatatgtacatcatattttttgtttataacagtcaaatttgcacaaaatttccttctttcttttaataatagggacctcctgggatcccaggtatgaaggtaagcatcacatgctaagaagataagcagtgtgaataaaatatgtagaatgtctacaactgcagtagaatattactgtaagttcagtctccaaatggatacatatggagagtatattgtttaagcagtatactatgcaatcttatataatgtaattcttgaaaaagaagtgtgcattgtgctcaaatctctcttttctaacacattcaggctttatctgattgtattttgctagggctgactgctgaatatctctagatgattatctcttctttatccttggtttctgtaacactctagtctcctagcatttcttctgcatctgatagaccttcactctttagtacaagttcattctgttctgtccagcagccattaagacacaaacctgactcttcctgctcttctatgcctggtaatattaataatgttcaaggcatttattgattaggtagttactggccatctacattgaaatcttcaaattagattttttttctgagttcaagatttatgagttcaacaccctccttaaaaatctctgctcaaatatctccaagacgtatgtatgtgtatatatagtgtattcactatatatatatatacatatatatacacatatatatattcatataatacatgaacaaactatatatatatgaatataacatatatatagtttgtgttattatacactacataacttttaaattatatatacttattaattcttggaaacatgtacattcaccatattttgaattatgcctagccccaactcttccacgtctatctccactctcccacattccaagtcctctcttctctcatagcccattgagttcagtgtgtgctgtccatattctcatgggtttaagtccaaccactgaagcatgatcatcctgtcaagagccatacccttaaaggaaatggactctccttcacctagatgccatctgttgtcactaacttctctcatctagtggatggggtcttataaggcccacctccctcaatactgcaatgatgacctagttattcttgtgcaagcaactacaaccaccatgaattacattatgtccagaacacactatgttgccccagtccttcttaatgtcttgtacttataaattttctacacccctccctttccattaagtcccctaaatcttggaagaaggggtgtgatatgaatgtctccattatgactgagcataccacttaataaaatacccatgacagtcattctctatactttgatcagttatgcactctgcattaaccattgtcaagcacacaaagacatttctctcattggatctaaaggttaaactgataagatctaatgagtagagcaattggaatttagagggaaatttgatactatggtcctagatatacaccctggagccaatgagcttcctttcaatgtgttcttagtcagacttacactaacagtcaagaatttatcctgggaagtgtgccttaaaacaaatcacagggcagttggacacctctataacatcaatgccacttacccatgtgcatatcttgtcatgtgggtcattgttgtagcaacagccttattttaagacatttttcctttgatcactagtctcactggtctgaatttagctcatttgagaattttaattttctattattttttttatgacagactttcatgcatgctagataagcactctaccagtgagccagtgcagcttttagtcatttgtgggaaattatgcttattctttcggctgagagttacatactcttttcacattactctaatatgactgcctagttaactatttttattacttatttatcgctcactatgccattttgctttactttatagactgcaacagaacacactaccgtcttgtttacttgttatgttttatatttctccattatgtttttagcctcaggagaaaagaggctctacttctttattactaagtgtccagagcctaacacaatgctccacaaacactttatatctaatgcatatttctaattaatgaataactaaaagtgccacaaactcctaataaatctactgtacattggtataccatggatacttcttaattgacttttcaaaggtaaatttgttcatgaaattaccggtgtgctcagtctttcacttatttatgtactaaaatgaactctcagaatgtctttttaccttcttgctgtttctcatgtataataatgattttaacttacactgttggtttcttttagggggaaccaggcagtataatcatgtcaccactgccaggaccaaagggtaatcaaggatacccaggtcctcctggaatacaagtaagagtatggggaattttttctttattacatgattaaaacataggatcatatgagtcctgaccttctatactcactgttgctgttttagttatacaaattatcacctgaagttcttaaggtctcaatgcattccttctattttaaagtaaaagtttttacaaggcatatttgttttcttttatctatgtatccagtgtctgtgggtatttgtgtatgtggcaacagaagtttgcatcaaaaataatttctgacattcttcttctgctataggtagcagtagggttgaccataaatgttttttaacaaataaaattatcgatctctcttttaagatgttaaaattgccatttataacagtatcaattatgcatgatatctgagcagacactgaaggttgaaggaatgcaatttatgcatggtaaacatcaaatgtaatcttacaaaaagattgtgttagtttatagataatatacagagacagtaatgacttttgagtatttatagatgaggaagttcattatagtttatgaaaatcaatccctttatcaaaaatacaaatcaggaggttttactgtttgatcacaaagatacaattttggagatttttttcatttgttcattttttattctttacctgacattactagtcataatctcttaagttcattcaaatattctccttaatcatacatataatttttaatgaatatttaagataaagtataacagatcatatgcagaatatatgctgagataacacaaaatgaacacctaggaacactactaaacccaacagaaagttacaaataattttgaatcaatacaatgttacctggaagccacagccttcttgattgcctcaatatataactaggagcctgagcaaactgtttaaagttgctttattccctcaactgtatcagctttcctttacagtatgtgatagtcacgtaatctgctgcaatgcatctgttttccttggcttgttaaggttcattcgtattgttttgctatggttcattttttttcttttttcattatgtatttatcatgtttttgtctatcattgtagaacataatcttgctgaaagctgtaccccatctctcttattgagttaccttttaagctacttagcccttctatttgtacaatttttaagccctgatagtattgcagggttatagacttatgaaaataacttaacttgcatacatttatttctttatatgatgaggtaaagggttgagtttagggattttgtttttcatacttctttcctcattaaaattgataaaatatagtctttaaaatatattgtttactggtttcctttcttaataacatgagaaaatagaattaatgatttctctgtttttgaggattttttcctaggggggagggcgagagaggtgactaagcgatatctatcaccctgagaaccagtgagtttattagacttacttagaattgacaataagttactaagaggagtgcaagtgacctaaaagccacactgaaaagtctttacccaggatgtagcagggctttcctgaagccatgtagggagctctccctttctctaggcttcccagtccctgaccctagatcatccataacatcttgaggctttgtatgactaaggcctaaatataaaatcggctgggatggctctgtccatatcctccttttgttaaggaatgtaacatttaatctgtcccactgtgatcatgaagacagcacttgtttaacttagagcagaagccccacattctaacatacttttctttactccatttataacagggcccacctggtcccaagggtatatcagggccaagtggtcctccaggaccaccaggtttaatggtaagtttctgtaattgtatttttttctcctttgaattctgatccatggatataattactgactatattacttgaaagttaacttaatttcaatatccatgcctttaattttgttatttaacactggctctgatatggtaaagaatctaaacaagcaaagcccctatatattcatacaggtgaaaaaatacatacataaaaataaatacaagaaatgggagctggacatatagctaaggtagaatgcttgctgagcacacatgaggccctgttctgtccagtgcaggaaatataaagatgataaatactactgtaatacttagatttcattgtagtcaagattggagttagacctttgctgccatcctcttaaaaagacaacaaaattgtattcccatcaaagtaattttatatgcctttctgtgtcctatatgctatgtacttcagtgacaattttcatattttcattatgcttttatggataatgcacttttgtttgtgactattggttcttactcttcaataggggaaataatgtatgctacattccagacaagcctactgaaagtccttagaaagacttaaccactaccctcccccattagtttgatttaattgtaaacgtggtgcaatcagggaattctgggccatggaaccttttcataattctgttgttacagtattggtgttatctgggtctgttattaaaccctgaatttctttaacccttgtaaactaattaaccgattccctccacacttctgaatattccttcaattaacctgtatttaacagaggaaacaacgtcttagaaatgacactgaggtatgatatggaagtaaaaagagaatactgatattaaaagcactatacataggcaggcaagtgcctatttaatattttaaaactattgtccttatttgtaagaatttcatacatatacacaataaaatatgaccattttctctcctgttgctcacctctaactctccccacatgcctgtcaacatccccccccccccagcttcatgcttttaaaaaagttacccccaaagtctaattattgctgtccatttgaaaatgggagtgaggccatccatgggagcctgggaatcctaagagtcgccacatcctcagtagagggcgattgccccttcgctagcagctgtcaactgctgttagctcctcagtgagaagaggggactggaggtcatctatactatctatgctgagattttagctgacatgatcttgtgactttctaatgtaggtaaccccagtttttgtgacttcaagagtgcaatagtcatgtcatgtctagaaggcaactgtttacagcactacttctcatttccaagtctttctactttctcttctcccaagctttgggcaggagagttgatagatatgtccagtttagggctgaacacccagtctcttattctcagcactttgactagttatccatgtctcccattgactatgccctgttacaaaaaggagtgtttctaaccaaacttcaaaacaacccaagtccatgggtataaaaataaataactaaaaggcatgtagacaaacatgactgtttaataaaattgcaataatattctatcattgggtccaagacctcctgtgctatgggcttttgaccagggttgcaatatgaggtttgacattcctctagaatgtcaatcagaaaatgattagttatccaataacagtcaggccactattgtaccagtaggcaaaacttatctggtaggtaggtattgcagtatgcaggacccagcactggttgacacactcatgtgttttctctcccagcattcttcattttaccagctggcactgagaaatctggccacaagggagaaagtttccttgtgtgtttgcgattgacttctctgtatcctgcagctaaagtgggagggttcaacaattgggtcttatcatatagttatggagggtaaccaagaaaagcctacttaatttttcatgtcctgagacatgattagaaattcaaattgagcatgtgctttaaaaaatatcaacttcattgtttcccataattctgataaaaccatgttcactgaagttaagttctttggtttggggacttgcgctatctcccctctcatttatcgatcctagttttctactcctgccaattctcatcctgtcactgacttttctacatttgtctaggttgttttaatcaattgaactgtgtgcctctgatgaaaacacaattatgaggggaaaaataggattggcttggtacctcactttagtacacagctgctttatctctgagctatatccccagaattaaaaagagtttgaaggtccttttgggttgtcacattaaaaaaaaaacaaatagttttaaagaaacatcatactaaaatgtttttttcctccttcctgcgtcttctaagggacctcctggcccaccaggcccaccgggaccaaaggtaatgttctttctgttcacatcatttgtttcctgtgggttaggttttctgattgttattgagactttaaatggaaacttctctccccaggggaatatgggcttaaatttccagggacccaaaggtgaaaaagtgagtaatcaaaagttggtcatccagccttcatgcctctcctttcacatgcacctggactgtcttgttcctccccctgtttcttatgatggacatagtttacctataatattgttacttgtagtagattatgaaatatcactatatctttgttgtgtaaatagggcgaacaaggtcttcagggcccacctggtccacctgggcagatcagcgaacagaaaagaccaattgacatagaatttcagaaaggagatcaggtgagccctcagggaggggaagtggataaagactgtgctatagatatgttaattagcttgattggggtaatcatttcacaatatgtaggtatattgagatatcaccttgctcattcttaatatgctcatttttgtcaactctagctcctttaatctattttttaaaaaaatatgaaaaatttaaaactgaaagaccttgctcttataaaaggcactatatatagacatgtattattaattgagggtattctttcaataacaaggacttcggataattagatttttttaaaaaataaactagtcacgatgtcgttctgctgttaatactagatgaacctaaagttcacattcttgaacatgttttgtgattatctccaggatagggagaaaacatattctagtactaatgtgctttcatttttctccatacctgcatagggagttcctggtgatagagggcctcctggacctccaggaatacctggtcctcccgtaagtattccaagactctttagcatcatttaatgtgaactgatatctatagacaatacctcatgaaccaatgtgaatattgattttttgcagggtcctcctggtggtgtgaaaggtgaaaagggtgagccaggagaggcaggcaaaagagtaagtgttatgaccatcaatggtgtttataagaagcctaaatatgttcatgtgcgagatctctttctagttcctaatggcattgcctgaaaatgtcactacaggtataacctataataatacctgtcatgcaaaaagtctattcagccaaacatttgtggtgcactttgatctcagaactcaggaggcagaggcaggatgatatctatgatttcagggctggcttgatttatagaacagccagggttccatggagaaaccctgtctcaaaaagccaaaaaaaaaaaaataattaattacttaattaattttaaaagagcactttaaaaatctatttacatagttcaaggcagaagtaatggttgctatagtatttcctctcctattaccaaactaacaaagttttgttcacactccatcattgctttgcatcctacagggtaaaccaggcaaagatggagagactggccaaccaggaatcccagtgagtagcaatggtcctttcctttaacaaaaaacattggtagtatttgcactatttgtgggtggtaatagaaaagcagagggcacacagtatggagtttggaaatagtttagatgaatggaaattatcatcacctttctgaatatgaatttggaatgtctctagttttaaggcagatataatgaggtgtgctttaattattgtttagaatcttttctagttgctgtaaagacactaacaaaactatcttaaacatgaaagtgtttatttggctacagaatgatacagtccaccatggtagagaagacgtgcagtagtcaggaaaagcatgttggaagaaacagagactggattgtcacatcataatttcccctcttcctcttcctccttctccttgtcctcctcctcttcttctttaccatttcatatatgcacctctttcatactgaccactcttatctcttacctccctacctccacacccatctctctcatgttcatgtatattcatttagttttatagctcagaaagattaatccaaatccttggtaacactgagtttggagctatgtgttggagactgatggactcaagagagaaggtcctaactaaacacaggatggggctctataaggtcctccttcttccttgactgttgataaggcttgtcaggtatggtcccagtgctggttgaattaagaggacagcatttattagcccttccccctatccttgaactcttaacatacctcctgctccctcttccataatattccttagagggagtggtctaagtaaatgactgattcatggctgggcccacagctgtcacttatagtctgtatcttgggcagctgtgcatgtctgcattcaccattgctcattgttaggaggcgattgtctgattaatgctggagatccttgtgtctatgggtgtaaagagaggtacttagaaggtgtttgttcctgtctgctaagttaaccatcagcaacacactctctgcatgggcatacttcctcttcagacctaagctgttagctaggttcatactactaggtattgtgtgcccctcttcccacctgcctcatgctgagtgggtcttgaatccattctgagggtgttagcgttctgtctaaactctactccacagttacctggcaacagccaggtatgctccaccccacagttacctggcaacagccaggtagacgacccactataaaaggggctgcttgtcctctcccctctctcttgcctctctctcttgctatcttgcctctccctcttgctcccccctttccccattcccttcacctcctttccatgtggtcatggccagcctctacttccctactctctccctctttctgcctttctctgcctctactaccctcttaactccccctattcgctgaataaactctattctatactataccatcttgtggctggtccctcggtagggggcaggagggaagggatgccttggcatgggcctgctgagacattcccttcccccatacctcaccacaccccagtagaatatatcttatacctttttatctttttataaaacacatcagagagttaattggttacatcccaaggtgctatcacacaaatggaaatatcttgctttccaagtggtttctttatatattctctttgtctgtgttaagtgttttcccactcacatcctcacttctccaatcttgcctctccatccctgcctaaagctttgcatacatggtgtactcttttagtgtgggagctgggtagaacagcaatgaacatgtatgtgcacatagtaaggcacaaaatctcacatgcctcggagggatatagctgagtcatatgctagtttttagtgtttgaagaagactgatttccaaagttgatatactctgttacattcccaccaataatatagaagagttctccttctcctaacatctgcattagcatttgttgttactgatattcccagtgactgactgggttgtggtgaaatgctgacgtcattttaaactgaattcccttaatggctaaggtgtttccttgccatttgtccatttgaatgtttcttttctttttttttttattattattttcttttattttagatctatcatttatttgtttgcttgtttaattttctgtgtatagatgttttgcctgagtgcatcttgtgtgtgtgtgtgtgtgtgtgtgtgtgtgtgtgtgtgtgtgatgactaaggagtctagaaggttgtgactgctatgtgggttctaagaaatatcacagatcctctgcaagagcaacaagtgttcttaaccattgagtgacctctccagcccctacaggtttggatttgttgttgttcttttgttttgtttttttttccttttgagaactttctctttagttctgtagcccattttcaaattgggttgttttcttggtatgtagtgttttgaattctttgtgtatttttaaaattaatttacttatttattttatacttattcacattatattctactcactgcccacctctcagtcaacccctccaacagtccttcccccatgcccccctcctcttctcctctgaccaggtggggtaccctcggatatgcccccaccctggcacttaaagtatctgaaaggctaggtgcttcctttcccactgagaccagacaaggtagcctagctagaagaacatatcccatggacagacaacagcttttgggatagcccccactctagttgtttgggacccacatgaagaccatacagcacatctgctacatatatgcagggaggactaggtccagcccatgtatattttttggttggtggctcattctctgagagccccaagggtccaggttagttgactctgttggtcattctgtggaattcctatcccattaggagctgtaattcttctcctgctcttccataaaagttcccaagctccatccactctttggctgtgggtgtctgcatctatataagtcagttggtgggtggagcctctcagaggacagttatgctagattcttgtctgaaagcataataaaatatcattaatagtgccagggattggttcttgaccatgggatgggtctcaagttgggctggttattgtttggccattccctcagtctctgctccatccccagtctctgtatttcttgtagataggataagttttgggttgaaagttttgtgggtgagttggtgtccctatcactccagaggcagtctccccagacttcatattcccagtgctgtgagacacagctaaggaattcccccattgattcttgggtacctcacttatcccaggtctcagtctcttcctgaagatgctgcccacctcttccactcctctttgtgtattcccaacactagtcctcggtcagattatgtagagcaggcaaagattgcatcccattttatgggctgcctttcagttgaatgagtttcctttgctatttataagctttttaatttcatgaaatcccacgtggtgatttcttagttacttttcaatttctatgccaaaagaccatgaccgaggcaacttagaaaggaaaggcttatttggacttcaggttccagagggattgtggtctgtcatggcagagaagcagcaggcattgcagccgggacagcaagcaaaaagttcacttcttgaacagatagcaggaagcagagagaacaaactaggaatggtgtgagggtgtgaatcctcagagctttctcccagtgccatacttcctccagtaaggccacatctcctagacacccacaagcagcaccaggaactgggcaccaaatgttcaaatgccaaagcctatgggtggggaggggctttctcatttaaactaccatatcaggccttggtcttattttctgtgctttgggaatcgtattcagaatgtctttgcttatacctatatgttgaaggatatatatatatgctttcacatttgtagaatgttaaatcttatattggggtaactgatctatttgggatggattttgtacaatgggagaaaaaggaatctaatttccttcttctgaatgttcatatccaggtttaccagaaccacttgctgaaaatacttcccattttcaagtgttgtttctcagcatctttgtaggaaaccagataactgtattttcagggactgtatcttctcttctattgatagactactttagcttatgttctcattacttgtgttgaggacatgatttttggcatcttcctaactttgccatgtttactaatatcaccccatactctgttttaaagggtttgcctggtgatcctggttaccctggagaaccaggaagagatggtgaaaaggtaaaactttctacattgtgatgtgtctggttttattcttattaccataatctgtgctcctcttgatactggattataagtgaaattataattacttagtgtttgtattcctgccttcattacccattttttcccttttatgcactttcctttaaattttcttgcattgctctaaatcacagtgcagagaaaatgcatgggattgaatttgcattagaatgtcagtgcctttgctgtaagcatatatcaacaaatcttttaagaggaggtttgatctctattccagtgaggttctcttgaaaagtttagagctgtaaacttctaatttctcctctaaacattttccactttgtatgtaatcattgtttgtttatctgtgactaattcgttgtagttttcccattggatggacacagcctgattgaggtcatttatttagttacctttttaaaaagtgactctgaaagcctgtgtgaaacacagttaccctatttttagcatatcacaaaatatttagtcctccatgttctctgttctctaactgctttgtatcaaaaccaatctgaaaaaagattaaagcaaacttgagttatctagaagtcacatattttactgatgatttctctctaaactagatccaagttttagtttagactaaaagacataattggaataaagggagagatcaaatacttaaatgggattgtttctcagttagtaacttatgatgcacagtaactttcctagaacttgaagtgtgagagagaaatctattcttaagtcttggcccgaaaaataacaattgaatgttgttttcttcctttatgacaatgttgtcttcttcctttgtgacaaagcatgttgctgctaggaatctgtccagtgtattcagcttttaagaaagctagcaaggttaattcattttggtcaagattatataatcagtacatccaaggcaagatcaaaggtctttggcaggcttaagcaagtatctcattaacctatgttatactttccacttgatttctttatgaatgacgcatgagtctttatgaaactcaattgttacttgaggaaatctaaaccaccacgtcattcttactaattacatgttataacattgccttgaacagggtcaaaagggtgatattggcccacctggacctcccggacttgtaagtttttctcttacgaattcatttctcgaatttaacattgcgtcaacatttttgtacacaagctatacactccctaccagttcctcacagaacataaaaatctaagtcattatcaacttctactgccttagaagccattatagttttgtcttgtttaatcatccatgttaaccttaaagttgttatacggttctgcctctgtgttactttttcatagttaaggtccaaattacacattattgttttgcatgattgtcaactcgtttcttaagtaaccagtaggtggcgcaactgctgctttcaaagggttcagagaaaggattttgagggaaccagaaattggtggtttcccctgcagtgcttagggcaaacatggatttagtcctaataggtttgctcaacttgaaattgtctggttcacatttctctcctttccttagtgtgtactttctggggctctagataacaaatcagcaattgctataactgggaggaggtgatagtatagattttctatcatatttacattgattgtggaatttaagtcatgtatatttccaagtatatcaagaataaaaaagatcactgttgaggattaagtaatattttggattgaacttggctaattctctagacttaacactgcattgaatccacagtagtgaatgctgtaaaagttcttctatactcctgacatttcagttctccttaccctaatgagtctcagacagaaatacatagaaacctactaaacctaatgaggccatatgtataatagatattagataatttttatccactttcacttgtttccagttcaaaatcggttctccaaaaaataatctctttagaaaataagacaataaaatcaggagtagaaatggaacttttaagagtgtagcacacttttcctttcagatcattaccctcattttgtatcttaaaactttgaagtctcttcttgtttatgaatatttttatgtccattggacttaggtagagtgaaatatcatagttggctagcaagtattaatttgtatgctggatcaacttgaaattctttatttttgtgaaattctttagaacacaaataagctatgagaggatgtagaagataggggtattcctcaaagggatggggcattttcaaagaagagtgtgagctgcagatgtttggaagacatctgtaaagggcactggtgaaaatgtgcacattgtgtgaagtggttataaccagatagccttgagagatatgaagtcattgctaaaaataatagggaaagaaataagaaagagtgatactgaaggaagtggtttgaccaagtttagggttccaagtagtatcgcatacagaaagtaggcaagtaatgtccttaggagaaatgtttacatagaaaagttgatttgaggaaattagcttaatgtgtgagatgaggacagaaattgtggtggttttagaaagaattgcagggcttcaggtgactggaatattatgaataatatgagaagagacagcaaaacacacgtctagctttgtaagccttgggcttaatattgtagggattacatgtttcctaattggttgagggtcaaagtgatagaggtgattactatgtaacagccttaaggagactcagtgtgatggctttcaggatttcctatctaaggactgtgtgaaaataaagcattataaccacatgtagctgcttagttacacttcgaagaacaagctacttcttcactgaattcctgaactccttttccataaaaaggtaattcctgcacctggaactggtgtgactatgggagaaaaaggaaatatcgggttacctggtttgcctggagaaaagggagagcgaggatttcctggaatacaaggtccacctggctttcctggacctccaggtaaaagacatgatggttatatctctatgcttacatagccaatccatacatacaattatttgatgtgacaactttattaattctgtgaggtttcagaaatacatacaacatacttttattatattagaaccaattttacattttacaatgaatataaaatcttgaccactcttacttattatttccagtgaagtgaacaatttcttgctcctattctaattactatacaattattttgtttcttttttaatagatattttgtttatttacagttcaaatgttattccctttcctggtttccactctggaacccccatcccatcctccctcttcctgcctctatgagggtgctaccccacccacccacccactcatgtcttcttgcctttgcattcccctacacgggggcatcgagctatgtgagaacccagctatacaactcctgagcatatacccaaaagatgctccaacatataacaaggacacatgcttccaacatataacaaggacacatactccacactatgttcatagcagccttatttataatagccagaagctggaaagaatccagactccctcaacagaggaatagatacagaaaatgtggttcatttacacaatggaatactactcagctattaaagacaatgactttatgaaattcttaggcaaatggatggaactagagaatatcatcctgagtgaggtaacccatacatacaattttatcatattggtttgactgggcatgacagtggatgatgtgaatggttcaggcttcacaccttgtatgtttgtgtatgataaatgtctgtgtggggatgaactcacccatgtgagtaccggtggaggccataatttgacattgaaaagtctttctacacttttttttcctcattaagcaagtctactcttgctggtcagttagcccccacaatctgtctgtgtcaccagaatggaagttatattaccattattaccattccaggctcttaagtagtttctgtggatatgacctcaggtccttatgttttcctaaaaaccctttacacacttaccccattccaaatgaggactttctaaataaccaagtataccaaagctgtattgtgtttcacaacaaattcttcacatgtacttttaaaagcttacttaaattttgtaaaaatcacttttaccttctattaaaaatatattgtgccgggcagtggtggcacatgcctttaatcccagcacttgggaggcaaaggtaggcgaatttctgagttcgaggccagcctggtctacatagtgagttccaggacagccagggctacacagagaaaccctgtctcaaccccccccccaaaaaaaaagaaaaaaaatattgtaccaaacaggtccttgatcctgtacatgaatcatcacacttttcattttgtcagaggacaggatactgacctaataaattactaacatttcttcatttcctatataacagtactaaccagaactgtccacttagaatcccagaatcaatgaattagaaatctgcgaggtgatttcaccacacaataaaactttaagactcagtgctgacttttatagctttcccttaccgggagctcttgactctagctgcatatgtatcaaaagatggcctagtcggccatcactgcaaagagaggcccattggacttgcagactttatatgccccagtacaggggaacgccagggccaaaaagggggagtgggtgggtaggggattggggggtgggtataagggacccttgggatagcattgaaaatgtaaacgaggaaaatacctaataaaaaataaataaataaacaaaaaaagttggctgcaaattaaaatgcccttatatatcctgttcattaagttatcagattttatgtaaacttcacagtagtgtctgtttcagtatctggcacacacatgtattcaatggattatagttcgttttcatgcaaaagtgtgtaactaaggaacagctgtcatgaggaagaaagtgacacctcccaagaaagaagctagtaagtgtgagtttcattatggtctaagtatgtgctttttattccttatctcaaataagtgaggtaaatgtttgttatgtcttgataattaacgtgaggcatttttccagaatacagtaagagctcaggagttgaataatataaaggaaaattataatgcacaggggatcagggaataagttgtatttcccaaaactatcatgtgagagtcgaagtacaaaagaacggggtgaggagcagtatttgaaaacaagtaatggctgtgatcttccacttacttaaagtacatgtttgtgcaagtgcacacatgtgttctctctctctctctctctctctctctctctctctctctctctctctctctcccctttgtgaaaaatattaaactaaacaaaagaaaggaaaagttaaattaaacaagaaaaaagtaataacaaaattacaaagccacataactatgtgactcagactcgtggaaatttcagaatttaggaataaaattaaacaaacaaacaaaagcaaaatcaaccaaacaaacaaaaactcatgaaaacctacctaagtgggggtgtgtgcagggggaggcacattgcctttgaaacagtaagtttgtaggacataatggaacatattttcacagtaaaaaggacaaataactatgaattttggagcctatattctcctaaaccgccatcctggtatgaagatggaatagttaaaaggtttacctcctccagacatactggagagtaagggacaaattcaggataaagtaggggtgggaggtagggtaaaagaatcagggactaagaaagattgtaataactttgattaactcagttcataaaaatatgatttacataaaaacccaggactgtgtgtgtgaatattctttacatggtatgggcaaatacagagggaatgaggagttggccagtggtgcagttgttagtttttactattagtatgtgagaacataagcattatttactctaagcttttagagaaatacagatttaagggctttaggagtggttcagtggaacaaatgtttgctacacaaacatgaagacctaggtttgaatccctgacactgatataaaaatctagggacagtgtggtacatggcctcagagggaagagaggtggaggaaaagaaggagaaagaggaaaaatatagacttaaatacatagatcaacatgtataggtaccattattaagaagaatagaaataaaatgtacaatttatctccagttagaggaaaaaatagatcaatctatatagtagaaggtaaaattaaaacacagaaagataaacccagatgtatagaaaataaagtataagatgacacagaagatagtgaaaagtaaatcattaactccaacaaacataaagtgtgtatacttcgttccttcttagaattgggaacaaaatactcatggaaggagttacagagacaaagatcggagctaagactgaaggaaggaccatccagagactgccccacctggggatctatcccatatacaatcaccaaacccagacactattgcatattccagaaagattttgctgacatgaccctgatatagctatctcttgtgaagctatgcctgttcctggaaaatacagaagtggatgctcacagtcatcgattggatggaacacagggtccccaatgaaggaggtagagaatgtacccaaggagctaaaggggtctgcaaccctataggagtaacaacaatatgaactaaccagtaaccccagagctccttgggactaaaccaccaatcaaagaaaacacatggtgggactcatggctccagctgtatatgtagcagagaatggcgtagtcggtcaccaatgggagaagaggcccttggtcttgcaaagattctatgccagagtataggggaatgccagggccaggaattgggagtgggtgggttggggagcagggggagaggggagggtataggggattttcaaggaggaaactaggaaaggggatagcatttgaaatgtaaatgaagaaaatatctaacaaaaaaagaagttaaaaaaataaagaaaagataaatgatagatggtattaatgtaaaattgagataaaaaactgaaaaataaaataaaatactggtatagtatgcagaatatgtatatctgaagcagaaagaggaaacttgaaagtaggtgcaagaaatattaattaaatgatttatggaagaagaaagctatttaattctaatgtcaaatgaaagaaaattcaatgaaaaatgcattaatgactcagatattaataaatgatacagtgattaaagtcatgaacctttacacaactaatgaataaccttcagttatataataaaattgataagcttcagggggtcaattgacaggtccttaacacactgagtgtattaatatagcatataaataatttgaccaacattaataagctatatgttgaaagagagggaaactgttctaggaagcaaagaatatatattctttgtagatgtacatagaatataaaaatagactctttttttatttgaaaagaatctactgtgtgtatccttgtgtatgattctctatggctacagtaaaatagactggaaaaacatcaaatatccttataataatatttgtatggtgatgtagttaaaagtacttccagagataaagcaggcattatatgacaatgctaagccactaaatgctaagccacaataaaatgtgcttcatatcaaaactctttgactatagagcaaacagtacccccactctgtcaccagactacaaataccaaaattaagagagaaatatgaatgtagcccaggtaaaatgtacttgcattacacacacaaagaatgaggttgtatccctagaaacgataaagaagacaaaatgggctaaatttaactcacacacacaaacaaaaagaaacaagcacaaaatgtagaatggaacactttactaggatgaaaaaagtctgtaaagtgaaaactgaaacagatacagctcaacatggacactaaaatatgaaggtttaaactcacaaatggtaaaaactaaaattaataaagaaaaaaggatattgccataaatttttattgtaaggtattggaaaactataatatctacttatatatttaatattttagatgaaaaataaactctttaagcaagaaaacaaaattattaaagttgtgaataggaagtctaagtaagtcaattaacataggtaattttggaagattgaagatgtatatgaagaaatgttgatttacatgcacttttatagttttacggatgaattataccaaactgtaaaacacatccccatgttttgttttatttcaaggcataagtagaaaacctaataatactaatagcaaatcagccaaggaaaaacactgtaaataaaaattattcaatcttattcatgaacaaagtataataatgctaaattaaaattaccacttctctataaattatatatgatgttatcgctgtttaatttttcccaagatatcaaaaatgtttctatgttacattgctttaactgactacattaccaaaggatagaacaataaatgtatagaaattgatactagcaacaaacagtgaaatccactctttacagacctttgtaaaatatttgtgagtgggcctggagagatggttctgtggttggtagaactaactgctctgccagaggactcaaggttggttctcagcacctgcatggtggcttataactgctaactccagttccaaagaatctttttctctctttttacccttaaaggcaccagcacaaaaatggtgcacataaaatcatccagctttgcacacatacttatacatttaaaatatatagtcacagtgaataataaaaaattactaaaatatataccaagatacactttatgtaagagatcaataatttaaagtttattatattaagaactcatcctttaaattcctggccatcagatgccagattccaattggattttaaagagaaatttacaagtcattcttaaaattaattaagagtaaaactttaaatatagaaaataatttttaggggactggagaggtggctcagcagtgaagaacactgactgctcttctgaaggttctgagttcaagtcccagcaaccatatggtggctcacaaccatcataatgaaatccaatgccctcttctggggtgtctgaagacagctacagtataacatacatataataaataaataaatcttaaaaagaaaataatttttaaatgtataattatttcctgagtagttttgaaaaaaaacataaagtgtgtttatgtacaaaataggctgtgaggctgaaaaatgtccaggaatggagttacattttatttgatcatatttaagtacccattctctctttgccttttgacagtttcatatgtgtgtgtaatatactgtgattatattcagtctcatttacttttgtcatctcccttaatttacttttgagccccttcttcctaactagctctccccacccccagtgacaacactattaatgaaaagtaacaccactcatccatcaaccatcaacactccaaaggtcctcaggaaagaggagatccccgaagtactttcttttttcatgataaagtgctgaagggcccgtcttataaaaggatccatagctgctgtgtattccagatttgaaatggccatgtcatatctgaatggcagccttttgtggcacacctctatgttttttcatgcagccatagtttttgttaagctttctctctatccccataactactcccattcccctcccttaaaggaacgatatttctagggatagaacattatcatgtcaaattgagtgtattaatttattattaacttcaaaaattcataaaattgcttttgtttgttgatttttaagacagggtgtcaccatgtatggctatcatggaactcactagatcagactggtctcaaactcacagattcgccttcctttgtcacctgagtgctgggtttaaagttgtgcactaccaccaccgggctattactttgaataattgtgccttatactcaaagtgttacatcatttaaagaattcttccttgcaagtgttaattaccatagaaaaccttaagaccaaaaagaattgaacagggactaagttgggtaggaaggggtttaaaacatgagcagccagcaaatggggagaagaaagacaaaatagtgcacatcatctcttccatgcagaatctaatttagccttgtagaatgtgccatagaagcagaaagaagactgggtggataaatgagagtaaggaagggaaggacaagtgatggataaggtattgtggggtggatatgaacatatgtatatatggcataatgcaacccaatgttttgtttactaaaaatacagttttttttttaaaaatacaataaggaaatccaaccaatattatattaaaggcagattttatcattttatcttgtaattgtgtacaagataaggtcattttggtcactttatcatatactttttgtcatttaggaacagcagttgtgggtccccctggtcctcctggatatcctggtgaaaggggccagaaaggtgatgaaggtccccctggaatttgtattcctggatctcctggacttgatggacagcctggggctcctggccttccaggacctcctggcccccctggcccccagttgccatccagtaagccgtgcttttatcctgacatgcttggctgttgttctgctgtacgtcatttagaagtgaatctgactgaagtttgacatcgttatttatgttcctgatatctaagagattatactgttgtttttagtttgtggttttggtcattcgtcttcaaaccgtgttgattattaacaatatgttgccatattgcttattgagttgtatttttacagagaaataattgaaaataagtatttttctagcctttctgaggttttttttcctctagtcttctcaatgcttaacgataattaacttgctattttatctttaacctcaggagatgaaatctgtaaagcaggccctcctgggcctccaggacctccaggtgataaaggactccaaggagagcgaggagtaaaaggtttgatcccaaacatcttctcattctttaacatcattagtggaatgccctgcatctaacttctatcttaaaaaagctattcccatatcatctccttaaaaatagtgtatatttttgtaatgttggtttcatatctcagctctttttagcttacaacttctaataacttgactccagcacacctcccattgagacttactttagattagccatagcttaatggtatattttctttcctcttaattttccttaaattagcatgaccactcattgaaatcaactctattattaagcttgactcatttatttcctcacttccttttatttgtttggaactaaggtttagcatctttctctctctctctctctctctctctctctctcatttttttcaagactgggtttctctgtatagccctatctatcctggaactcattttgtagaccaaggtggcctcaaactcagaaatccacctgcctctgcctcccaagtgctgggactaaaggtgtgcgccacaactgcctggccttcttttctctttttatacttataggtaattatcactttaagattcttaacttgcttccttcttcattgacaaaataatagcaaacactctcaaggatctatggcaccacatactcagagataattacatttgtgcccaggcagtaccttcttaactaattatagttactgtttgttcttgaagcctggtagtctgggtggcctcctgtttccctaagagttttgattaaaaaattcttacctagtatttccaggaaagttaattaccatagtataaaccttgttcttcacgggaagcaaaacaaaccgatgaaaaatatagaagctctatttgaataaaaatgctggataagtcatctagcagacagacatgacagatgaaaatgtaaccatcttatctaatgtacaatatattactacatagaggactgtggtaataagttagtagtatcgtgcagctgccttgtaagagtatatttttgtcttgatgaaattggttggggctggaaatcaacatataagtggctaataatattaacgacaaagggatcaatagtggtcactagagttgaaaaataacaatggttttctattggcattagtcttgctttaattttacatggaaattctaatgtacatgattatttacttttgttttgttttataagagtttcttacatttctacctatttatggtagactgaagttagtgttaagtggtagtgttgagtttgggattatattaaggtttgattgggtcttttgtggcattagtttttttgtttgtttgtttgtttgttttaggagtgatgctagcatttgcctattctacagcagtatcagtagaaaggaattcagacctgtgatacactatttgaattattgaaggtgttaatggtggcttttgatagagttaattagagttgtattattaacaaattatgaggtagggttttttgttgaatttgataatattagaaattgaataattcccttcctgtcggcaccggcatcgggtcaccttgggcgcagagtcagcggacacccccaaggtccctagaggactctccacgtgatcttaggaccactagtgagtggaacacaacttctgttccaatccaatcacgcgggacctgagacagcattagggaagcagaaaaccagcctgaccagggtcacaagtcccttccggttggcgccagtacctggtaacattgtgctcagagttggcagaccccccacggtccctagaggactcttcacgtgatcttcggaccactgaccagaaagctccacactcctcaaaggagacaccacttccaggaactgtaacacgaccaggatctttgacagcaggatcccaggataaaaggagcttggtcacaccagtatttcagggtctcagaggaacttgactgccaagaactctgacataaccagaatctcaggttcacaggagcccacaagcaaaggatcacagagaaaactggactctgaggagtcctgaattaactgggattatagggaggagaggctccaataagatatattgaggacatcaaatacttgagataatcagatgggaggaggcaagcataagaacagaagcaatagaaaccaaggttacttggcatcatcagaaccaaactctcccaccatagcaagtcctggatacaccatcacaccagaaaagcaagacatggatctaaagtcacttcttatgatgatgatagagggagttaagaaggaaatacaggaaaacacaggtaaacagctagaaacctttcaagaggaaacacaaaaatgccttagagagttaaaggaaaactaaaacaaacagaagatggaattgaacaaaaccatccaggatctaaaaatggaaaaagaaacaataaagaaaacccaaagggaaacaactctggagatagaaaccctaggaaagaaatcaggaaccatagatatgagcatcagcaacagaatacaagagatggaagagagaatctcaggtgcaaaagattccatagggaatagggacacaacaataaaagaaaatcaaaatgcaaaaagatcctaaatcaaaacatccaggaaatccaggacacaatgagaagaccaaacctatggataataggagtagatgagaatgaagattttcaacttaaagggccagcaaatattttcaacaaaattatagaggaaaactatccatacctaaaaaaagagatgcccatgaacatacaagaagcctacagaactccaaatagactgggccagaaaagaaatccctcccgacacataatactcagaacaaatgcactaaataaagacaaaatattaaaagtagcaaggggaaaaggtcaaataacatataaaggcaggcctattggaattactccagacttctcaccagaaactatgaaagccagaagatccagaagagatgttatatagaccctaagagaacacaaatgccagcccaggctactatacccaacaaaactctcaattaccatagatggagaaaccaaagaattccgtgataaaaccaaattcacacaatatatttccacaaatccagcccttcaaagaataataaagggaaaacaccaacacaaggacagaaactataccctagaaaaagcaagaaagaaatccttcaacaaacctaaaagaagacagccacaagaacggaatgccaactctaacaacaaaaataataggaagcaacaattacttttccttaatatctcttaatatcaatggactcaattccccaataaaaagacatagactaacagactggctacacaaacagaacccaacattctgctgcttacaggaaacccatctcagagaaaaagacagaaactccctcaaagtgaaaggctggaaaacaattttccaagcaaacggtctgaagaaacaagctggagtagccattctttttttttaagagttatgaatttattagtattttatttttttaattttttaaaatattttttattacgtattttcctcaattacatttccaatgctatcccaaaagtcccccataccctcgcccccaactcccctacccacccattcccactttttggccctggcgttcccctgtactggggaatataaagtttgcatgcccaatgggcctctgtttccagtgatggccaactaggccatcttttgatacatatgcagctagagtcaagagctccggggtactgcttagttcataatgttgttccacctaaagggttgcagatctctttagctccttggatactttctctagctcctccattgggggagctgtgctccatccaatagctgactgtgagcatccacttatgtgtttgctaggccctggcctagtatcacaagagacagctatatcagggtcctttcagcaaacacttgctagtgtatgcaatggtgtcagcgtttggaggctaattatgggagtagccattctaatatcaaataaaatcaacttccaacccaaagttatcaaaaaagacaaggaggtggcacttcatactaatcaaaggtaaaatcttccaagaggaactctcaattctgaatatctatgctctaaatgcaagggcagccacactcattaaagaaactttagtaaagatcaaagtacacattgcacctcacacaataatagtgggagacttcaacacatcactttcatcaatggacagatcatggaaacagaaactaaacagggccagattgaaactaacagaagttatgaaacaaatggatttaacagatatctgcagaaagttttatcctaaaacaaaaggatatacctacttctcagcacctcatggtaccgtctctaaaattgaccatataattggtcacaaaacaggcctcaacagatacaaaaatattgaaattgtcccatgcatcctatcagatcaccatggactaaggctgctcttcaataacaacataaattatagaaagccagcaataatgtggaaactgatcaatactctcctcaatgataactttgtcaagggaggtataaggaaagaaattaaagactttttagagtttaatgaaaatgaagccacaacatatacaaatttatgggaaacaatgatagcatttctaagaggaaaactcatagctctgagtgcctccaaaaagaaactagagagatcacacactagcagcttgacaacaaaactaaaagctctagaactaaaggaagcaaattcacccaagaggagtagatggcaggaaataatcaaactcaggggcaaaatcaacgaagtagaaacagtagaaacaagaagaactattcaaagaatcaaccaaatgaggagctttttctttgagaaaatcaacaagatagataaacccttagccagacacactagagggcacagggacagcatcctaattaacaaaatcagaaatgaaaaaggagacataacaacagatcctgaagaaatccaaaacaccatcagatccttctacaaaaggctgtattcaacaaaactggaaaacatggatgaaatgaaccaatttctagacagataccaggtaccaaagttaaatcatgatcagagtaatgacctaaacagtcctatatccactaacgaaatagaagcagtcatcaatagtctcccaaccaaaaaaagcccaggaccagatgggtttagtgcagagttctatcagaccttcaaagaagatctaattccagttcttctcaaactattccacaaaatagaaacagaaggtactctacccaatgcattctatgaagtcacaattactctgatatctaaaccacagaattacccaaaaaagatagaggacttcagaccaatttcccttatgaatatcgatgcaaaaatcctcaataaagttcttgctaaccgaatccaagaacacatcaaaacaatcatccatcctgtccaagtaggtttcattccagacatgcagggatggtttaatatatggaaatccatcaacgtaatccactgtatatacaaactcaaagacaaaaaccacattgtcatctcgttaagtgctgagaaagcatttgacaaaatccaacacccattcatgataaaagacatggaaagatcaggaattcaaggcccacccctaaacatgataaaagcaatctacagcaaaccagtagccagcatcaaggtaaatggtgagaatctggaagtaatcccactaaaatcagggactagacaaggctgccactttctccctacctatacaatatagtacttgaagttctagtcagaacaacttgacaacaaaaggacatcatggggatacagattggaaaggaagaagtcaaaatatcagtatttgcagatgatatgatagtatatataagtgacctcaaaaattctaccagagaactcctaaacctgataaacagcttcagtgcagcagctggatataaaattaactcaaacaagtcaatggcctttctctacacaaaggataaacaggctgagaaagaaattagggaaacaacacccttcacaatagtcacaaataatataaaataccttggtgtgactgtaactaaggaagtgaaagatctgtatgataagaccttcaagtctctgaagaaagaaatcaaagaacaactcagaagatggaaagatctcccacgttcatggattggcaggatcaatatagtaaattttgctaccttgccaaaagcaatctaaagattcaatgcaatccccatcaaaattccaactcaattcttcaaggaattagaaagggcaatttgcaaattcatctggaataacaaaaaaaaaaatctaggatagccaaaaaaaaaaaaaaacaaaaacaaaaacaaaacacacacacacaaacaaaaaacaaaaaacctcttctcaatgataaaagaacctctggtggaatcaccatgcctgacctaaagcattactaaagaacaattgtgataaaaactgcatggtactggcataacaacactcaagtagaccaatggaatagaactgaagacccaaaaatgaacccacacacctatggtcacttgatctttgacaagggagctaaaaccatacagtgggaaaaagacagcattttcaacaaatggtgctggcacaactggcggttatcatgtagaaggatgcgaattgatccattcctatctccttgtactaaagtcaaatctaagtggatcaaggaacttcacataaaaccagagacactgaaacttatagaggagaaagtggggaaaagcctcgaaggtatgggcataggggaaaaattcctgaatagaacagcaatggcttgtgctgtaagatcaagaatcgacaaatgggacctcataaaattgcaaagcttctgtaaggcaaaagacaataagacaaaaaggccaccaatagattgagaaaggatctttaccaatcctaaatcagatagggaataatatccaatatatataaagaactcaagaaagtggactccagtaaatcaaataaccccattaaatatagggcttagagctaaacaaagaattcttgcctgaggaatatcaaatggctgagaagcacctgaaaaaatgttcagcatccttaatcataagggaaatgcaaatcaaaacaaccttgagattccacctcacaccagtcagaatggctaagatcaaaaattcaggtgacagcagatgctggcaaggatgtggagaaagaggaacactcctccactgctggtggaattgcaagcttgtacaaccactctggaaatcagtctggcggttcctcagaaaactggacatagtactaccagagtttctagtgatacctctcctgggcatatatctagaaggtgttccaactggtaagaaggacacaggctccactatgttcatagcagccttattcataatagccagaagctggaaagaacccatatgtccctcaacagagaaattgatacagacaatgtacatttacacaatggagtactactcagctattaaaaagaatgaatctatgaaattcctacgcaaatggatggacctggaaggtatcatcctaagtgaggtaacccaatcacaaaagaacgtacatgatatgtactcactgataagtggatattagcccagaatcttagaatacccaagatacaagttggaaaacacatgaaactcaagaagaaggaagaccaaagtgtggtcactttgccccttcttagaactgggaacaaaacacccatggaaggagttacagagaaaaagtttggagctgagatgaaaggatggaccatctagagactgctgcacccagggatctatcccataatcagcctccaaatgcagacaccattgcttaggccagcaagattttgctgaaaggaccctgataatgctgtctcttgtgatggtatgctggtgcctggcaaaccagaagtggatgcttacagtcagctattggatggaacacaggtcccccaatggaggagctagagaaagtacccaaggatctaaagggaactgcaaccctataggtggaacatcaatatgaactaaccagtacccccctggagctcgtgtctctagttgtatatgtagcagaagatggcctagttggccatcactggaaagagaggccccttggtcttgcaaactttatatgccccagtacaggggaacaccagggccaaaaagtgggaatgggtgggtaggggagttgggggtgagggtatgggggacttttgggatagcattggaaatgtaaatgaaataaatacccaataaaaaataatgagagttgttttcttaaaattaattaatgcaaagaatccagactatcgaaaatgttgaagaggaggattcatgtgtggtatatagtagttgggagagggaaaagaatatgatgaaaatatactgcatgagccaggcatggtggcacatgcctttgatcccagcacttggaggcaggcagatttctgagttcgaggccaccctggtctacagagggagttctaggacagccagtgctatacagagaaaatctggcttgaaaaactaaacaagaagaaaactgtatgaaaaattaaataagtaaataatatgaatagcttaccaagtaagggtagatgatatagctagatttgtaagattgccacaaattcttctagggtgatgaaggtagagtagggtaggatagtttgtaaatctttaagcaaaatatatagtgaattcccttgtagtattaaagaccaaataaccagtggcatatgcctaacatatgaatgtgcaagtcattattttaagtctgcttgtgggaaaatggagtctgttataatgatggctcttctgttaaatacccacctgcttttcatataaatcacagtgaaagctacatgttaatgtggcttgtatgtttcaccataagtcattcatttcactttaaatctataatttggccctacttccttattccatttcagcagactgatctatgggccattcattgcctatatgtagcatatatatgctatacttcttatgcaaatgccatgcctttcattttgtttatgtagacatcttgtcaatgagatctatcctgacctaaccctatttaaaatctttctcccacctaagcctccgcagcacacactcagtcacacctaagtccattttccctgtacaaatgtattttaatatacaattaaaagcttactggatttaacactatattaaactatttaaagtgtaatttaataatttgtcatctttactgtttattatttttattggtaggaagttagcttcacaaaagcatggaattttgtctattttctatattggcatgtcacaaatgcttaaagttgttctttatatatactaggcactcagtatttgtctaaaatttaattttagacaggcttctctaatcacagtggtgggtaggaatgctattattccctacagctgacttctttagaatcccatcaaaagaaagtttaagtaatccttccaataatatttgtttttttgccaggtgacaaaggtgatacttgcttcaactgtattggaactggcatttcagggcctccaggccaacctggtttaccaggtctcccaggtcctccaggtaaaatatcctccatatagtcaatcttttaaaatactttggttcttttgagcatgctaattgttttatgatgttactttgccatttttagctagtcacttatgtctagaaatttttgagtatgaaatgcctctcttatgaaataaattgcacttgtgtatgtaactggaagttaccaacattctctatcacagtatttggcattattcaaagaattacattttctcaaaagtgaaatgacatttagagtcagaattttgttctagaaaactagggagaatattcatactttctggaccatgagtatggtttccagatgcagagtcataggaatatatttcatattgtcattaaggaacaaggtttctattaaacttctggcaaccaactgccaatattccttgtacatatatggcttccctcctaattttgaatcatttctcagaatcacaaccattctactccattagctctttacatatgctaatattgcatattcttgagtttatatataaaatgtgtgtccaggctgatgatagactccagactgattaccagtctagtacatgtatcaatgacacaaagtcataagaagttaggaaacaccttaagcaagcttcatagctgccactaggagctagtaacatagctgtaaataatgcagttagtgcaaagattcgcctgtataactgatgcttcagtaacttttttcctgtaatgtttggtactaaacatctctgaaaacaaatcttaaggaatgaccaaccaaagaaagagctaggaaagatataggaagattgtataactgagggtgggtagggaagtggggggaagggtatgggggacttttgggatagcattctaaatgtaattgaggaaaatacgtaataataaaaaatattaaaaataaagaaaataaagataagcaggctcctttcctgtcttctcccagtggcagtaggatggggataagaactcatgcccaacctcacagtttctagtggctgcaaactttgcaaattaatactctggagttagaaaagacctggggatgcagtgctttaagtgctgttatatattaatttataagaaactttggtttcttcctcttgagaacacaaaagaggaaagagtctgagttaaatgtggtagagctctctgtttaaaattgaagtttgtgatgtgctgatttctagatgcgtgtgattggggtgggggcgcttacggctcagtgctcacctgacctatgtgtgtcttaggatctcttggaatccctggagagaagggggacaaaggacaagctgggataactggtccgaaaggattgccagtaagctttgattattttattatgagccacaaagtactgaaagatgcatgtgtcctttgatttttcacttatgaacagatacatataaatttagtttaaattataatttattttattctttctctctctatgctttgctatccctttttattagatattttcttcttttacatttcaaatgctatcccgaaagtcccctataccctcccccacactgctcccctacccacccactcccacttcttggccctggcattcccctatactctggcatagagtctttgcaagaccaagagcctctcctcccatcgatgatcgactaggtcatcctatgctacatatacagctggagccatgagtcccaccatgtgttttctttgatggtttagtcccagggagctctggggttactggttagttcatattgttgttactcctatatcgctgcagaccccttcagctccttgggtacattctctagctccttcactggggaccctgtgttccatccaattgatgactgtgagcatccacttctgtatttgccaggcactagcatagcctcacaagagacagctatatcagggttatgtcagcaaaatcttgctggcatgtacaatagtgtctccgtttggtggctgattatgggttggatccctgggtggggtagtctctgggtggtccatcctttcatctcagctccaaactttgtctctgtaactccttccatgggtattttgttccccattctaaggagggatgaaatatccacactttggtcttcgttcttcttgagtttcatgtgttttgcaaattgtatcttgggtattctaagtttctgggctaatatccacttatcagtgagtgcatatcatgtgtgttcttttgtgattgggttacttctctaaggatgatatcctccagatccatccatttgcctaagaatttcataaattcattgtttttaatagctgagtagtattccattgtgtaaatgtaccacattttctgtattcattcctcagttgagggatgctttgctatccttaattcatatgctactttgtatggtaaatattattgtataggttaatggagcaaactggaggggaaaatgttagaaaatattctaacttactttttttttcttctcccacttttttcttcaaactcagggcatacctggacctccaggtgctccaggctttccagggtctaagggtgaccctggggatgtcctcactcttccaggaatgaaaggtgacaaaggagagttgggtttccctggagctccagggcttcctggtctacctggtagtcctggaaaggatggtttgccaggactccctggccccaaaggagagcctgtgagttggattaatatacttgcttttatgtcaaattgtcatttagtaatgtttcatacaggatgaagttctatgtcaatggtaaaacttgtactgggtttgtgtgaagtacctaaattcaattttcagtactctctaaccctcctaaagcaattggtaagttaaaataaaataggagcctattacatagatgaatactaatgcctaaaataatacgattttacagtgaaatggtacattgatactagagtttccttactgttttccttcagttctataaactccttattaactcagtatagtattgattattactaactatgattagatggagaggaagttaaaatgcttaggagtcagagagggattcattattctaaacatctgtgggaattttttaagcatgaaaaaacccaatttgttatatatatgtgtgtgtgtgtgtgtgtgtgtgtgtgtgtgtgtgcgtacagccagattaagatactacagagccaaacactgagcgtaaatgaacagtctctttttatattcaacatccagtagaggatatttgaatgagaaatatattttaatagtataaatagacaataaccatctcatggtacggtgtgagatttttgagagcagagactttgatttactcatcttctcagcttataccactcactggaagatagcgttctgagatatttgttgaaggaggtaattagtgagtaagtaatcatagattcgataaaagaacgtaacccagttttagcataactttaaaaggcatacttatggctgagtcatgcccctgattgtatccatttagactaatctacatgacgttgttacaccaatgctttctgtcttaaacatttccattttcagggtggaattacttttaagggtgaaagaggtcctcctgggagcccaggtttaccaggtctcccaggaaatatgggacctacaggcccagttggttttgggcctccaggccccataggcgaaaaaggcatacaaggtgtggcaggaaatccaggccagccgggattaccaggtatgtttacctttgttgtcttttctattttaaaagtagacagacacatagacagatagacagacagatagatataaaaagtttaaaaaattcctgggaaatgtgtttctctagccatctatatgcttataggaagggaatagattgtttttgtttaaagtgagatttcttgttaacttagtctaagtttgtagtgttttttgtatttcgttcttgaatatatgttagtgtagttgtatccatgtaactgggaaggatatgcacataactattttattaatatttttgaaatgatattataattataaatttttctgccttacctttatccctctaactcctcccatctcacatgtaaccccttgctctctttccaagttaaatccctttacttcaaatattcttttacatatgtgtgtgttcctacatgtacattcctaaacacagcacacacacacatacacactcctaaatacataaaaacaacctgcttggtctgtatagcattacctttatgtatatgttttgagtgtcaaaaacatgcaccataattttggagacagggtccctcactgaacccggagttcattgatattgctaggctggctagccagtactatccaagataccctcaggatatgggttatgtggtgctatagctacagttttattcatattcagcaggcactttgctgatggagctaccatcccatcccaatttatgttctgatgctcaagggaaggagaagataggtgttccagatgaatgaggagatgtgggggggggaagagggagagatttttttcctatgttttttgttgttgttgtactatccacatcctcttctgttggatgataatggtccatattgtgcaaaggcagaccctccttccttaaagcactgatttaaattcctatgtcttctggaatcatgggccataggcataaagcagagataattattttatcagctatctaaatatcctttaatctagtcaccctgacatctaaagttagttatcaaacatcctcaatcatggaagtacctaaaattcattctttctttctttctttctttctttctttctttctttctttctttctttctttctttctttctttccttcttccttccttccttccttccttccttcctttctttctttctttctttctttctttctttccttcttccttccttccttccttccttcctttcttccttcctctctctctctcttttcctttctttctttctttttttttgaaattttatctttctctttgctatcttcctagaatatgcaaaatgggattgtaattattagtcaagtaaatgattctcacttggagtgttccatttgttttcaggtcctaaaggagatccaggccagaccataacccagccaggaaagcctggtttgccaggtagtccaggcagagatggtgaagtgggtcttccaggtatgcaaagaatttattttatttcaaaacaacttcatcactgaaattctttcttttggatgttccccattcttacagtgctttttttttttgtaggtgatcctggacttccaggccaaccaggcctgccaggaatacctggtagcaaaggagaaccaggtatccctgggattgggcctcctggaccacctggtcctaaaggtatgtaggatgaggtatggggcagtgtagattacctgattagtaagatactattctttcataatatagaacaaagtagatttaacttattttggtatatgccatttaaaatctgtaaatgaaaaagtcacattgggcctgcagagatggctcagtgactaagagcactgcctgctcttccagaagacaagagtttacttagcatctccatggcagctcctaaccactcttaactctctaagtataatggactcaatgctgtactctgttttgtttttttttaaggacactaggcacatacctggttcatgtacatacatgcagacaaaacacatttgcacataaaattgaaatgataaaaataaacattaaagaagaaaagtcattatatgcaccttaattttggagacaggatctctcactgaacctggagttcattttctaaaacagtctagtgatgaaactatctacatttgagggatgcaaaatgattcatatgctaaagaacatcatgggaattatgacatttgtgttcatcattgtattcttagagccttgaagagttcctggaagtgtaacaagaagtacatagatatgtattgaattaatagattctattaatcagaacagattcactatacacatatgcaatattttatcccaaataaaatacacccttgatttattgatatttttagtttttttctacagttgtgctttactcctcccagaatgtattcttatgaataacagggcagcacctttgggtgatgacagttccttaggtctcccttatttttttttaataaatgacagatttgatttcatgtgtgaatgcttatataacacatacagttgcatctagctcatctgtagaagtacatgttcggcattctgtcacattatgtcacaatgtaagcagaagggcaggtctgtatttatgtatggcattgattcactatatttaattctgatgtgttatatacttcaaaagagcatagtttcttctacagccatctaattaccccgtagaactgaaaggataagctgattgagagactctcagatgaatattagacttaattctaagtggtcatatacaatgttcctggacttttaacgtgtcagtgtataaagcatgtgtttagggagatgagaatgtgactacctatcttcaaatttattctttctatgggttaaaacaatggcttgctattttacaggttttccaggaattccgggacctccaggagctcctggggcccctggaagaatgggtccagatgggcctcctgggccaccaggcttcccaggaccaaaggtctgaaacaatttcttaaaggatatatttatttttattttttatgtgtatcagtgatttgtctgcatgtgtatatatgtgtagcacatgggtgcctggtgtggtgacggtggaggccaggagtggggctcagatgccctagagctgaagtcgcagacagttgttaactaccatgtgggtgctgggaatcgaacctgggttctctacaagagcactcaacttctgagccatctccagccccagtctagaacattttaaactagccctttttcacaaagacagtcttctctactgtccttcgatccagttcctattcgtcttagacattgtcccaagtctttattatattgataatacttagctatattttcatttaaaaataaccaatcccaaaccatctttaatagaacttaacacccagatccaaagtctctgacattgttttagactgctaggtttttggattacgtgaaagaatccaatgatcagcttggcctatgtttatgtagacaaacagtaacccatttcatacttttacatgtgtgatgattggtaagattgtgttggatatatcaagcccttcctgtattgtttcctctgttccaattccattaaatatacataaaccaaatcactgctatttggtaatactaataaataactccctttatatttttccactgtaacttatttaaccttaaacacttttcagtcagccttcagcaaactgctaaagcatgtaattatacctactcttcctgaattccgtgcttaaatgatctaatctcagtggatttcatccttattacttgttttcctcatggaaaaacagctgacagactctcataaaaaaaaaatgcatctcttttggcttgtttttatttcatgatgaacattttcaaataaacacaaaagcccaagaaatgatctaatgaactttgacagatgtgtcagtcaggtacaaaactgctaagattatagtaacacttccttgatcttttcctgtttttcaggaagggggtggtctcacttaacccaaatctcaagattacatcatttcacttacaaatgctttgccattcatatgtaactaaatgaaaattgtatgcagaaaccacaatgacattatactacttaagtcatgttaaaactaattctttgcattatctgatcctcagtcctcttcacattccctcacttgtgtagagtgtggtttaatcccttgttttcagttaacttttgtactttgaaaacaatccaactcatttaatttgctctcactaaaccctatttctgtcccttccagatattctctctaacacacccatcattttttaaatttgactatcctcttcttaatatggaagaaaaaatattactttgtattcgatgctttaaattctctgtagtaaatggtaagcgtcaggaaagtcacgggacttttccttgtgttttgtcatgtgtatgcttaagggagagccaggatttgggttacctgggccacctgggccaccaggattcccaggtttcaaaggaacacctggtccaaaaggtgatcgtggtttcccaggaccttcaggtcctccaggacgcactggcttggatgggctacctggaccaaaaggtatggaggctcttgctacttctcaatttgttttaaactttcattgatgttgaaacctttggaaaaggttatgggtaataagcaagctcactggaaagcccatgatgcctgtctgccactgttttaattttgtttatattccactagtttgtttgtttttttcatttgtcaaaacagaggatataattgcctcttgtcttttgatttacttgctttgtgtacttttttaatttaataattactccatgtaatttaaatttgaaagaattcactgacttagtattgaattacatgtgtatactatcagttactacttgtaggaatggatttttgccaaccttttcttaacaccaataataccacacatgttatttagatgtgtgcaggtacaatagcagattagagtagcaaaacttaatattctcagtaaaaggtaagaacgtctatgggtagtatgaaatgtctctctgtctgagctattttatactcctaccaacaatgaatgaagcacttgtttcatccaaccccttcccaactgtagttaaaacaaaaacaaaaacaaaaacaaaacaaaacaaaaagacaaacaaaaaaattcctgactttttctagcctggtagaagtcactttatcagtatactttaaaaacatttccaagctaggtgtggtggcacatgcctttaatcccagcactccggaggcagaggcaggcagatttctgagttcgaggccagcctggtctacaacgtgagttccaggacagccagggctatacagagaaaccctgtctcgaaaaaccaaaaaaaaaaaaaaaaacaaaaaacaaaaaaaactaaaaacaacaacaacaaaatttccattgcaaagttttcaaatgcacagaaagattacaaagaattatacattgaatggctatctgcctgctgcttagaccctatatatgatattttgtctcattcaaaaggatttttaaataaaatactgtagatgcaatagctagagatggagctctccaattgaaaacttgcctagtatatgaaaggacctggattcattcctcaatgccagaaatggaaatgttatatgtaatataaggtagaaaaggcaataccatgactgctatatgcacccatcactgatgttctatggtgaatgttttttttttcattttttattaggtatttagctcatttacatttccaatgctataccaaaagtcccccatacccacccacccccactcccctacccacccactccccctttttggccctggcgttcccctgtactggggcatataaagtttgcaagtccaatgggcctctctttcaagtgatggcctactaggccatcttatggtgaatgttttatgcatactttctcatttatctgtccatttatatatctctttatataatcatcaatttccttttgatgaatatcaaaaaagttgcaaaagtggtaatcttttccctaatactcttacaatcccaaagctgcctatgtgttttatttctatataaaatccacagatgtattgacaaacaaaatctaatatgatatattatgatatattccagggcttgggatgcagctcattggaaatgcattttcttgccatgctcaaagtcctggtacacacacacacacacacacacacacacacacacacacacacacgtccttattccagtttccaattagtgtgcaataaccataccaatatcattatgaagcttttgtctgtcctttaatccttgtatgtggaatcatgcaatatgcatgtttttagaaaaatatcctcattagtacttatttctagtaaattcttgaagatgccattgttaggatccctgggctgtgtcaagttgctgagtattatgagagaagctgttagaagagatctctgagtcttttgatggatatatgctttgagtatgcttgtacatatagctaagactagaattgtgctcataagtgtgttcacttgtttagacctttctccaacatatattgacactttaaaattcacactgatataacatttttagttattcatgattctccccaatattaacattttacttgctttgtggttgtgtcataattacaaatttaatttaatttctctgatgacataggatggccagatttttatccgctcttgtggattatttagacattcaaatatttgccagtttaaattgatggattgtgttgtgtcttaagttgaaggtgttcctagtacaccctgaatacttgtgtttttttagagcaaactcaggagtattttattcctgtgttggttacctatttgtatttctagagtatttcgatatagagttttgattttattgttttatttatgttacccattatcataattttgtgtcttctctaagaaataattacctgctaggcactatcaagacattctgacccatagtgtcattaatctctaatactttgtatttatatcatttattaaaaataaaagtcgaacagtagattatttggacatttctatcacatcaaatactatgtatagatgggctattttctgttcactcatttgattcactatcctttaactagtatcacattgtttacatggatatatatacatatgtatatatatatgacccaaaaaatacttttcttgttaaaaattttaaactatattatgtactttgcctttcttctcaacatagttcaaatgtatgtgtccctactctgagtgaattaactatgtatcattttagagccttattttccctgcttacagttgatatcccaatttctctactactttaaccttcttaaacttgatatctttttttttgttgttgttcttttttgggttttggtttttggtttttttcaagacagggtttctctgtatagccctgactgtcctggaactcactttgtagaccaggctggcctcaaactcagaaattcacctgcctctgcctcccaagtgctgggattaaaggcatacaccaccactacccagtgatgtctttaaatatataaaggaataggcttaaaataactagcttggctgatttgatttcactgtttaatttgcaaagaatagaattctcaggataaatattttggagaattgtctaaattaaatttatattcacaaatcgtattgagttgattttcattaaatatatatatatatataattataaggaaactataaactattattaataacatgacattttaaaattgtttttaaaaattcctacatattagtgagaaggctgggtgttgtcaattatccccatttataaatatgaatcatttcaatgagaatttaagtaataattcagaagcatttcatgtaactgatttaaaaccttagtatttaccaaatacacattaatgcaggttaaaatgccactgatattataagactggaaacctgtacaggaataagtttatagaatttcagcaattcttttttttaatattttttattacgtattttcctcaattacatttctaatgctatcccaaagtcccccataccctcccccccacttccctacccactcactcccactttttggccctggcgttcccctgtactggggcatataaagtttgcgtgtccaatgggcctctctttccagtgatggctgactaggccatcttttgatacatatgcagttagagtcaagagctccggggtactggttagttcataatgttgttccacctatagggttgcagatccctttagctccttgggtactttctctagctcctccattgggagtcctgtgatccatccaatagctgactgtgagcaaaatttcagatagaaaattgtgatgctataatgtccatcattaggtggtttttacttccaatcctcatctaattagtacatacagttgacattatgttgatgggtacaaaaataattctaggagacatctctgggaatttgtataaaacattctaaaaagcagtaatataatctctacacagcttcttccctggaagaatactgttgattgttcacttcccaatggttatgagggtagaattcctctaatatcaaaaccaggcagaaaaacaaacaaatagacaaaaaatacaatgaaaaatatctaagttataggccaaaatctctgaagaacaaataggtaagaatttttccaaacattagcacatcaaatgttacaatatataaaaagaaactctagcatgactttaatgaccatcaaggtcttcagaatacaagctgctttgacatctgagaagtattcagcataatttgctatttcaacagtccaaacaattacatctatgcacctgaaatactgttcaaattatttgatataattcaacatccatttctgaaaaaaatacttttagaaaattatgaattaaagaaaacctgttagccagcctatagactcatcatatggtgggttgaggcagatggatttcaggctactcagaagggcagtgaaaagccctgtttcagaaaagcaaaaaagccttgtcatcaatattgaaattccaaagctcctttttataatctactcttttattgtaagtcttatatcatttattaaaagcttaatcaagtatggttgatggtgaaatactgaatactttcctccaaaaaataggctacaacaaagagttgtttgccagaaaatttatcattatactagaaatatttagccattgttgtaagttaagacaaataaattaaaagcatagagattgaaaaggaagaaattatctattcatacatgatttgactttgcatttagaaaatcatcttacataaaacctttggaacagaaagttaattttacaatataagtattagggccactatacaaaacaaagtgaaggtttaccaattagaattagataaaaaataatatttaaaatagtaccaagtatcataatgttctgacatatgtatagttctaacaataagtgtagtatttatattttaaagaagtacaaaatataaatgtcataagccaaatataactaaataaagtgatatattatgccaatgtactggcaggcccaatttccttaagacagcagttctgtccaaatagactaattgtacccttaaggaaaacacagcagaaatttgtaattggtcaaacacttatgtggaaaagtgaataccttatagtagccaaattaaatgaagaaagtcctatgttagagagttcaaagtatttgatttgaagacttaaaacaatcttaaagtgactgatatatcttgtaatatatgacatactgacacatgggtctaaaaatagaattgtctttgattttttgtgtgtgcagagctggagataaaatccaagcactcttgtattctaagcatatgctgaggtaaattctatcttcacaaaaatgtttctcataaattgaaagtacaatagaaaaagaaacttctaacaaatagtacaaaaactattattgtataggtgaccatgaaacaagcaaacaaaacaagtgaacctccaaattttccaaattttaactccaaacagattgtagacccacacataaagcttcaaaccctcacgcttctagaatgcaagcactgcaagtttttctggtaaaagtcaaagggaatcttttagatttagcagaggacattttttgttttacaagttctccttttggatatgtcatctgcttctctcatcaatgcaacaaaataactgacaaaagaaacttagagaagaatttctttcccttcagagttctagggcacagagcatcaagaaggagatggcttgagagcaagagcttaaggcagctcttcctatcacatccatagttaggaagcaaagaaagatgaacatttgtacttggttcattttctcctagtcacaagcagggaccagagcccactgaatagtgtcagccacttttagggtggatcatctcaccacagtctaatctaaataattccctacaggcctgtttagaggcttggctctaaatcctgttaggttgataatcaatattaagtaccatgtgattcaaaaataaaactaattctcagctcatagatagtgtaaacactggtgtatagtcaaattcagtttttttttaagtgaaagcatagaacaaaaatctttatgatcatatcctagacaaagaattgtttgctaggacacaaaagctcataaaaatggaaaactgctaatttggacttcactaaaataaaatattttcattttatgtgtctaacaaattatttgtaagcataatatatacaaatcctcaaaactcaacagtcagaaaccatttaccaaagttaaaagtagagttgaaaaatgttggcaacaatttaaatatatttatattttgccccacaaatcattcaaatgtcaagcaaatgcatgtaagattccatacagtcttctgcaaaatataggtttaagcaacaatgaaatagatagatagatagatagatagataatagatagatagatacatacatacatacatacatacatgcatgcatacatagatacatagataaactataagaattagctttcttctcaagaagaaaaattgccaagtatgtagactaatagagaactctacacagctagttagaatcccaaacagtgcagtcacttcaatctccagcacaggaccaaagagcttctgtccactttgaaaatgttgtgccagtgtattagaaagtaaaacagtcttgctctctgaaacagcaaactcacttctaggtatttattaaagaaaactctgaagctttgcataaaaatctgtaagtctatgttcataggagctttattcataatcaacaagaattgtaaaaagcccaaatgtccatcaaacaacaaggactaacacagtgtagagtatttatacaatgaaatattcaatatgtgctgttgggaatcaagtccaggacttcatgcatgctaaacatacgttctcactgctgacataaatcgtagcccaacatgtatctttcaaaaatttacacagtcaatttcagtaggaaaataaatcttttcaacaaacagtgctaaatatgattggatatatgtatacacaaccacacataaatgaatctcaaatgtatcacatttagtggggaaaaagacatactcaagaagctacatactgcatggttacatttgtgacattctggaaatagaaaacctataagaaataaagtagcagagtagtcacaagattattggcatatggagaaggagcaacaactgatcgctggtccttttgaggattggtgaaatgattttaaatctggatttaatggcagttttacaaccgtacagatttctcaaaatgcatccaagtgtgtgatgaaagaacaggtttcaaaaaatacaatgtttgtattagttttttagaaattcatacatactctgtagttttctgactcttgcctataatgccctcaagatctatccttcacctctctgcgcctcccaattttacatcatcttaaaaagtaacccactaggtccaatgtgtatatctcacactcatgtctattagaacaggaacaacataccacaggccacacccttaaagaaaactgactttaccttccctagaagccatcaactaccaatacctcctctactagaaatggaggtacatgagacacacacacacacacacacacacaccacacacacacacacacacacacacacacacacacacatacacatacacacacacacacacacacacacacatacacatacacacacacacacacacacacacacacacacacacaccccttaagcaggacaattgattgatttgatcgtgtgcaggcaactacagctactattgagtatctaagtgcagttgtcgggtcatatctagaagacaccgattttctctggattttcctaacttctggctcttacattcactcccactcctgttcctcaatgatccctaagcaaatcttaatagatgtgataagtttgaaaagtgtgagtgataggaaattcagagagtaaagtatcaactgtcaaaatattgtaggcaagagcatattttcagctagaacctcaagttaataaaaagaaagatgttgctgtctatctgcttaaagctgaagtgattaaaaaatatttttataaccaaagagttatccagtatgaagtagactacaatcttgttgctgttttgagaagttaagacaagcactgacattgacttctggccttgtgttaaataagacttcaactatgaatgggatttcagctttgggtacttgtccttttcttcctggataaactagtcttattgcatccttttctaccttgtttggttgatgccccagggaggcctgctcttttctgaaggcaaagagaagagcagtgggtctgggtgaaagggaaggtactggaggagtggagggaggcaaaaactgctgtttgggatatattgtatgagagaagaataacagaaaaggaaaaaatatggttatatttaacatgtaaactgtgcttttttaaaaaggtgatgttggaccaaatggacaacctggcccagtagggcctccagggctgccaggaattggtcttcagggaccaccaggaccaccagggactccagggccaataggccaacctggtaagattacagtaaatgtgcctgctataagacttgcagtgtatatgattgtcttccagtaatgtgattaaagtggtaatccgtgtgtgtatatatatattttttatccaattgtaaactatagatcacatcataagagctaatttattacttgatgtttcccccttctgttcacctaaaaatccatttagtctagtaatgaaatttgataattgtacttaccattaccatataatcattgaacatacagagttttaaaaacagaactcaaactatttgtgcttattatttcagaccaaagaataaagtggatctctctttttttttctcctgtactgggaataactgtaattgagcatgcgctaagctgctctttcttcagttagatacttgaaacggtcttgtaacatgtagctcatggttttgcctccatggataaagaatcacatggctgttgtatatctgtatgagagtctgtagtaagtgtggattctgagtgaattcacattatctatttactccggtacagtaagggacattctcagccctgaatttcgttattttgaatattgtaatagttcataaaatgaaaacaaacatggaacattattttttaattcgtatgaacataacagaaagttgaacacaattcagatgcacatatattgaacacatgtattttctgaccttaaatgacaccagatatgttgttggtaattgccttaagagtttctaaactatggttaacaatataaaacacccataaaggctatttttatttgttcaccattttaaaactcaatttgaaggcacgttgtacttttttaaagccccctggcaagcattacataagaaaaacataagcaaacttgcagtcatgtttcgaacaaggttgctatagttgcctcatcattcatgaaaaaaagagcaaacaaaacaaaaacaaaaacaagctttttccaccatcttggctcctgtggaggcctgctgggaacaggacttctaacagcaagtatgtctagaaggctgtggtgcaaggccatttttgttggttccaagcaaggtctctggaactaaagagagcacacggctcttaagattgcaggcgtttatgcccaagatgaaacagagttctacttaggcaagacatgtgcttgtgtgtatgactcaaaaaacaaaacaaaacaaacaacaacaacaaaaaccaatacagcgactcctggaggcaaaccaaacaaacccagagtgatctggaaaaaagtacctgggctcacagaaacagtagaatggttcttgccaaattccaaagcaaccttcctgcagaggccattgtctacattgtggacattgtctacaaagtaaggagaaggcatcaaaaaagcccaagccaccctcattggtccacttaaatcttcagcaacaggcgctggagagtatcggaatccatctctatatgtgtttggttgatcttttttcattaagaaatctacacagaatcagtttgatgctgtatccatcccggatttaaacttatggagagtaaataagtaaaaatagattggtgctcttgtaaaaaaaaaacaaaaacaaaaacaaaaacaaaaaccactctgcccaacctgcatagaagtggaatcttgaagaaaaatgtatttttagttttgattattactgacttaaactgttatttcacaaacaacagtgtaatgattttatcacttcttttgcattttgttgtttcttttagtttgcaaaagtacatgacgctgtcgaagcattttgaattcttacatgagagctgcatggaaatttaaaacactgttaacaagcatctgaattaaaatataaaattgtaatatttatttaaaactatagctaataccttgcaattttttgtcaagacatctactattctatttctctactgcttttttccaactcccagtagcataaacactgcacaatatcaggacagtgctagttaataacttttaattcaccttcatgtatttgcttgtaaatattttctttgccatagacttttatatcaattgtattcagcagttaacaaaaaatataaaaattattcaatggactctcaatatatacattcattttaatataaatgttattatcatcaccaaaggaaaatattaatttaacactttttaactatattgactcttacatagaaggtcgatcagcaagaacactattatagtatcttgctagacctgcattataatgcatgacagaaacttccagtttacataatatacttgttttctgttgcatcaaaaatgcaataccaaataataacattaaatataaaacttaatttaaaataaaacttaaaatgagataatacaacagaaaacttaatacaaaatagtaagaactgattgtataattattaaaacgacatgttaagacaaagcctaaatcaaaccaaaacaaattgacttatttgataatcattcagaagggtcaacattatatgcacaaataattggtaatgtaatggaacagtgaaaatccacctgtggtcagcgggccaatgaatggcaaagcataagatgttaacaatggcaaagcataagatgttaacaatctacgatgagaaaaacattgagagtgtgcattcaaaaattttacaaatttgacaatttaaagctatgctcctatttattgaataatataaccagaaaactgagctttttttttttttcaaggtttggttaaggatatttgtacttaattaaaaagttagtcaaaaattaactggaattttttaaaaattgtgttttaaccaaaacaatttgagcaaaacctctcttccagaaatatgacttaaaatgttaaagtttggttttcattaatcattttcacatgcacgatggctaaagtttctgtaatgcactctcctaagtatatcatctgcagatcacgtcacttctttgatagaaaaataaccagatgtgtaatgtggagactgcatcaatacttacaatgttaatatgttgttaactaggcttacatgggattccaggagagaagggggacccaggacctcctgggtttgatgttccaggactccctggagagagaggtagtccagggctccctggagcccctggtcttataggacctccaggatcacctggtgtccctggaaaagcaggtgtccctggatttccaggtaatgtttaataatctgtctgactgtgaatcaatgaaactaatatttatatgactgacaaaacattttcatactaaattttatgactttacactatctattaaggaagactgttaaatgtatgagtattgaaaactccgttggtgtttgtgctatactttttttatactgtgtgatagtaccagtaatatattactatataataaaggatccaaagtatgatggttgaaagtaacttttcaaacattttgcttaagattctgtgggtcagaaatcaaagggtgcctttaacagattattttctataattcatatgactccaataagaatgattagagttgcagaatctaactctatggtgactcttttctgacacttgggtattctttagctcatgtgacatctaatcattcataatgccccattctcatctttttttcatccttccattgcaagtggcttcccaaagtaagaatttcctgagacaaaaatgaggtcctgaagagatattttagtggttacaagaactggctgctctttcagagaactggggttggattcccagtgctgacaaggcagctcccaactccctgtaattccaggtccagggatcaagtgccctcttctagtctctggggggtactacaagcacgtgaggcacagcacagacatattcagccaaaatacccatacacataaaatgaaaataaaaacgtgcttttggagggagggagggagggagggagggagagagggacagaaggaaagtggcgagatggaaggagggaggaaggaaaggaaggagtcatggagggaggtagggagagaggtaagggggagagggatagggggaggggagggggagggggagagggagaaagttagtttcagggcaccctggttggtgaattcttaatatgtagtgctatcttctgtggagaacagttaccacagtgagtatctgtgcgttttgttcaggcgtgagtgctaagcttccagtaagaaaggggaaaatctcactgtgccttcctttcattcctaaatagctttccaaaggatatctttaaaagtctatcttatctttccaaagtccaaacccaggaaatttagtaactgatattttccaaaggtgtcaaaggcgaaatgggtatgatgggacctccaggcccacctggacctttgggaattcctggcaggagtggtgctcctggtcttaaaggtaagaactgcagtttactgacagatatgtctaacaaagaaaattaaaccctgggttctgtcaatacagtttctggtttttctattttaaaattgacagtgcttagtattttgtttctttgggatgtgttaattgaaagtgtcttcttttatattttttatgaaactgttaaagaataaaatgtattaataaatttaaaagataaaatatttaagaatatattatcattattattttagacattaataataataaaatgcctacagtttgttgactttacttttgaaaaaaatcacataaacattctttttaaaaattattttatttatttacatttcactttttgtcccccttccagtcctccctctcatggttcctcatcccattcctcctccccctttcccccaagagagtgctcccctcaccaggcatcatccttctctggggtctcaagtctttggtggattaagtgcattttctctcactgcagccagaacaggccagtgtatgctcctggttggtggttcagactctaccagctccctgagatctgtgttagttgagactgctggtcttcctgtggggttgcacttcccttcagcttcttcagtccttccccaaattcaaccacaggggtcctggacttcagtccaatggttgggtgtcagtatctgcttctgtctcagtcagctactggtagggcctctcagggaacagccatgctagacttttatcttcagtctcttctccattttgaacctgcagttctttttagacagcaacagttctgagtcaggaatattgactgtgagttagtaacccaattcccccacatgaggcccatgttcatagcagccttatttgtgatagccagaagctggtaatgtcttcttttcagtttgatgatatacttaatttgtatacctgaaacattgtaaatgcttaggccataatttcagaattgaacttcaggttttccttattgtgagtctgtaaacacattccagaaaggagataaattattacctgtgtttattaacatatatgcactcaagtaatttattgacagacattaggttagatacatgttttgaggcttagtttacctaagttatgagacatgtgataattttacatgcattgattatggatgaagaaatttggtgtgctttgttgactttaggtgatgatggcatgcaaggtcagccaggtctccctggccctgcaggagaaaagggcggtaagggagagcctggccttccaggtcctcctggaccaatgcatccagatttcctgggatcgaaaggagaaaagggtgagcccggcttaccaggtaagtgggtggatatattcacaaatatttttgcatatcttaggtttaatattttttaggttattttgttagttgtcctacaggcgaacaaatcatatggatactagcaaatgctctttcacacacagttcctgaagtttgattttacacatattatttattcatgtatatatgtatttatgtatggtgtgtgtgtgtgtgtgtgtgtgtgtgtgtgtgtgtgtacatgtagaagtcaaagaacaactttcagaagttagttttctccatccacattgtgaattccaggggttgaattcattggactttttataaagcacctttacctactgggccatcttcccttgctcctgacattttatttttaagtaccagagaagtaacttggagttactatgtttaacaagtcaattacatatgtgacattttggtagtgaatattttcatttcatttgtgttgtttcattgattacctttctgcttgaatattttctttgtcatatacctgtcatgagctatggggtttttaaagcagatttggggagctagggagttggctaagtgaattgcttgctatgcaagcatgaaactggagattggatccaccaaacccatataaaggcagcacaggcacctacctataatcagaacacttttgaggcagacatgggtgagcaaactctgggagatttttgagttcagtgagagacttgtcctcaaaaaacaaaaggctgagcaatctatgaagacatccaagttcaactttgggcctctgtgtgacctaagaaagacacatgggccaacaaacctatgagcatgtatatatacacatacatagatgcatatctaagtacatacattcataaataatatagacttaaataactaccttcaggcttccagaagtaccacagaagcatagaaagagaaaattatatatagccacaataatttgaggacagcaaatttggtatttaggaattgtggtggttctttttaattttattcacctagaaaccaaatgatgatgaatagtattatgctctatacaacaagttttaaattataaaaatattggtttcttatcctagaaatataatgtggtttatcaaaaaccacacacacacacacacacacacacacacacataaacacacacatatatatatggcacctatagaaaagaaacatactttttgaaaaagcacttgcaactttttgtgttctattattgctgtcagttgtaaatgtgtgtgtgtgtgcacatctctaaataaatgttatgggtttctcattgggcatgatttaatgaaatttttccttaaaattactttgtatgttaaagtttttctaaaagtaccaaaagaggtaaaatttaggataacaaaaatgaaatgtctttcttagttatctcttcttttaaaaaccagatctgattgactgattgattgatttggtgattaattgattgatacatatatatatatatatatatgctacagtacccatttgaattgcagaggacaaattatacttctcctactccactatgtgggctacaaagtttggactcagggcttcaggtttggtggcatgttcccttatcaagtgagcagttttatcagctcctggggttattgttattatctttcatcttttaaccaggctttgcaaattataggacagtaaaatatacttgacttgtactgtagagttaataatgataaaagacattgagacaggaacaaagagaaagttgactttatttggctgatctgaatttcttggtgggaaacagtaaacaaatgaagaaactaatagtttatactacatcaaattatcaccaatttggccagtgttattgttgatacaggtgagtagggccaggcattgaatattattttgttgctcttgtttgaagtgctgggggtcaaatctgatgattggatagttcttaccccatcattctccaggccatcttaagaattcatgatccatatctctatcaagtgagaggcaaacctccttagaagtgggaacaaaacacctttggaaggagttacagagacaaagtttggagctgagacgaaaggatggaccttgtagagactgccatatccagggatccaccccataatcagcatccaaacgctgacaccatcgcatacactagcaagattttatcgaaaggacccagatgtagctgtctcttgtgagactatgccggggcctagcaaacacagaagtggatgctcacagtcagctaatggatggatcacagggctcccaatggaggagctagagaaagtacccaaggagctaaagggatctgcaaccctataggtggaacaacattatgaactaaccagtaccccggagctcttgactctaactgcatatgtatcaaaagatggcctagtcagccatcactggaaagagaggcccattggacacgcaaactttatatgccccagtacaggggaacgccagggccaaaaagggggagtgggtgggtaggggagtgggggtgggtgggtatgggggacttttggtatagcattggaaatgtaaatgagctaaatacctaataaaaaatggaaaaaaaaagtgagaggcaaagatgctgcaactaccactgccaattctaagaaagtttactaaattatccccagaacgtggcagacaacctggggagcatccttgccctcccaagtgctatgtcagggatcatttttatccataacattttatcatccctagacatcatcttgaagttgatgttcataggatctttttggtagtcatttcattttcatttgtcctgggaacttcatcttcttgatttgggaaatcaattggactgtcagaaaaagaccttgtcacagaacatagaattagggaaatagttaaagtgcagcagccttccaacacacacatacacatatggacacacatacatgcactcatacatacacacataaacacacactcacacatgcaccaagagagacagagacagagagatagacacacagagaggacagcagtttctccattttacttatatgcagttcaacagttaagcagctttctggcaaaatcatgtaatttattagtaagaatcagcctaacttgatttttatgcttgtctttggaaggtattcctggactttcaggaccaaaaggctaccagggattacctggagacccagggcaacctggactgagtggacaaccaggatcaccaggactcccaggtatgtaaaatacatcactgtggtacttagatgattgacaaagatcctgaggaagtatttatgtcattttacagtttagtgatgatttagatctgttcatgctaagtgcagctaggcttgacaaaattgttggcatgtgctccaagttttaacagataagatatataggatgttttattttgcttattcagattcatattttgctcacaacataatatatttagaactctgattcatgtaaggtgctatattttattacaaactctccaacatagaaagaaatacaattatcaggtagaagcctgaataattcacctgttccagttgttttgattctttgttaatatcagacaagtccataattctgcgatgtaaaacagattattgctattttaatttttaaaaattttaaggatgaacatttcacagccctccttgtagtctgttacagcccaaattctcttacaatgaacagggtttttttttaaatcctcatttttatcttaattctcataaaactttcagctgttttattttagttcatccccaaggaagtaaaaagccctgaaggccaactatgtgccatcttattcacataccacatcttgaaggagtcagaaagatggactcgctcctgatttcttcccaacatcttttgcattctccatctaaagctggaagtcactgtgaaagaaaaagaaaaacacatttatggtagcagtggtaaatgattaagtgacatcacacagctcaactcaagcacctgtgatgttaaaagtagaatcctcaaacacatccaggtcaatctagcatcttttcatcaacccaggagataggtctctctctctctctctctctctctctctctctctctctctctctctctctctctctctctctcctatcatagtgaggctctgtcatgacacaaacctactgctgaagttttattaaacattcttatattggatttatcagtgagaacagaaagtgggtagttatgtgcaacaaacagaacaccaaatgcatggaattagtttatgagaagaaccaagatgctcaataaaattgcctttatttttatgaggttgaatttaaagatctgtatttgcataattatattgcagtataatactaaacagacttctgagggacacattgctcattttgtactaagttatgtctgtagcctataacgcaatgcaattaatttttccaatgcaatgcatggtcccactactctgctttaattttatcaacattacttttctaggtcccaagggtaatcctggtctccctggtccaccaggacttacaggacctcctggaccaaaaggaaacattggtgacatgggttttcctggtgagtgatgaaaaagttaaagtcatttagtgctattaatagtcactattccccccctcccttgagacagggtctcatgtagcacagactatcattgaacttgctacatagctagtcctcctgtatctacccacaaactactgggattataagtgcttgacactataccatgtttataatgtacaaaagattgaacctacagctttattcatacaatgcaagcactctgccaattaacctatgacccaacctcctttttatcccctacctctttttacaatattttatttttattaattaatcttttatactccatattgtattcccctcaatccaccctccaactgttccatatctcatacctccttcccactcccctgtctccatgaggatgtccccaaccctcaccccacctgacctctaaactccatggggcctccagtcttttgatgattaggtgtatcatctctgaatgaacacagacctggaagtcctctcctgtatgtgtgctgggggcctcatatcagctggtgtatgctgtctgtttggtggtccagtgtttcagagatctgggagggagtgtccagattaattgagacagctggtcctcctacagggttgacctcagcagcttctgtccactttgggccttctttccctcaggttcctttccattttcatccctgttattctttcagacaggaacaattatgaatcagagatgtgactgtgggatggcaaccccatccctcacttgatagcctgtcttcctgctggaggtgggctctataatttccctctccctactgtccagtgtttcatctaaggtatctcgcctaccaggtctctggtatattctgtagccccgcccccccacaacctcctctttcctgaggttgcctgtttccattctttctgctggccctcagggctttagtcctttccctcacccaataccagatcaggttcacctccactcactttccctcccaggcccctccctccctccccacttgtgatgtgattgctttcttctccctcccaagtatgactgagacatcctcacttgggcatttcagcttgttgatctttttgagttctgtagactgtaccttgggtattctgtacttttttttttttttgctaatatccatttattagtgagtacataccatgcatgtccttttgagtctgaattacctcactcaggataatagtttctagttccatccatttgccagcaaaattcaggatgtcatggttcttaatagctgagtagtactccattgtgtaaatgaacgacattttctgtatccattcttctgttgtgggatatctaggttgtttccagcttccggctatcacaaacaaggccgctatgaatatagtggaacacgtgctgctgtggcatggcccccacctctttttatcagaaaagatgttaagtataaggtctgggtatgtagctaagtgatagtatatatgagccctgagcattgatagaatcatagtaagacactctctcaaataaccaatatatatatatatatcattacaaacagatatttaaagtaatgaagaacagaattttaagacattagaaagttagaattcacaagcacatgtgttctctagctttttttctttcatcaaaatttcttagaaataggttgttatgtaagcctgtgtgtgagggtcattatatatactcagtttgtggaattttttccaaagatagttctgctaggtcacattcatcttaggtttgacatgagtaaagcctatattatcaaataatatacaatgcatattttcaacaggccctcaaggtgtagatgggccccctggacctcctggatttcctggacaacctggctctcctgggttacctggccagaaaggaagtaaaggagagcctggggtttcaggcattggacttccaggtcttcctggcccaaaggtaatcctagtctgatcatgtgtctgagaagtttcagtttgtctttaactgtgctcatctctaattcttcactaaacaaaccacagaatgacaaggcatgttctgagcaaaggatgtattccttcccttttctcaataaataatcttttattgagtaatcaacaataatattgccgggcggtggtggtgcatgcctttaatcccagcacttgggaggcagaggcaggtagatttctgagttcgaggccagcctggtctacagagtgagttccaggacagccagagatacacagagaaaccctgtctcaaaaacaaaacaaaacaaacaaacaaaaaatacagtgctgggttttttctatgttcatcacctttcacatacatgctttaaactttctgtagtactatttggcctggccaagcagccttgcagtatgatttaacagtttcccctattgacttaatattcccttgattggacgagctaaatacatagaaaacttgaagcactcattttatactctctcatccttagttgttaagctgtcagtgttattcagcatgttcaaaacttcacttaagcaagatgagtaaagtctagcaatctctggtgcaatacagtaaatatggctaacagtattactcatcttaaaatgttcagattaattatatgtgctatgtagattaagtttggttggtttggtttggttttgctgttttcgatatgactttcactttgtagttgagactgtcctagaatttactatgtagcccaggctggtcttgaattctatatcctactacaccttagctttcccactactgggattataggcatacatcactatacccagctcttttaagcactgttattaaaaaatgtgtgcatgcacacaaacacactctcacatactcatttatgcacacacgcacacacacacacacacacacacacacacacacacacaagaaggagtgagaaagagaatattggcagtaactctgtttagattatatcatgattacatgcttgtatccagaaagtacgtatgcatttactatgtacaaatttttgcacgtaaagttaaatcatctttatcaattgactttcattggattttgatttacattttgcatctataagagaataataaataaataaataaacataatgttttgatttgtgtatacattggggagatagtttcccttaattttatttttattgtttgataatttcatgttgcatttttaatcaaataagcttccctgtttcttcctattatctcctaccaatttcttgttatttaaaaaaaatagtgagtttatttgtgcatgggtgatgtgccatatacttgatgggtaacttgatgggtaacctctcaggggctgcattattgaagaaagctggttcttcctctcccagcctccatgaattgccactagcaccattgcatggggtaggaagtcatgtccacacctcccatgctcatatgctccatgctgagattattgtctggctctattttgcacaagtcttgcacatgctgtcacaactgctgaagatcatgtgggtaactatcctgctgtgtccagaaaatagtgttaaatccctggttattttaaactatgttttagaaacatggagacttattcattatgttcactatgcagtgctatgtaacatgtaaatttatttcatctatctggcactaaatgcatacttggtgcccaaaccctctgccagcctcttgcatttattttccataatctgtggtaaccagcattctacacgtagcttatctttctctaattgatttcaatgaacgtaacataccctggctccatccctgttgtcatagtgacatgctgttttagagcttacttgtagtttagtgtgcagcatttcttttattcacttgtctgttggtggacacacattccagttattttcaatagagctgtggtaagcacgggagtgaaggtagtttattttctttgtgtacatagctaaaagcaggcctgctggatagtatagaagctctgcttgacaaatttttgttacctttcttggtctaaggtagaactaggacttatagtgtagtagtagtcatcagctatgtgtgtgtggctagagcaataaaaatgtatcactggatatggactataacttccaactgagggctaccactcagaaggatataggttttctcctatccaatgaaaaaatttccatttattgtttttggttttcctacttccattgcctcttcaattttaagatttcaggcaaaaagacagattagctttcccatttgctttgatattacttataaaatagggcaaactatagctatattttaaggacatagattgtagcatgaaagagaagatgctaatattgctaaggtatagtaaaggctgactttggtcaacctacttagtttgccagtttgaattttagcaagagaaaagatacgaaatggaattcctagtctgctcaaactatatgtgaaacaccataggatagggaccttacaaaaatcatagcaaagctgagtgtagaataaatgcaaaaaatttcagcttcactgtatcctagccttactaaaagcacaaattgattttaattttgtttttgttttcctatggagatgcacgagtttcctggtctgatcttttgattttcgggatcctcttctccttattccttaaaacttatctttttctgaaacacatagtctccccagtaaatattagataaagcttaagctagtaaatttaattcatttcagaaatctttataaagtgtttaaaatttacttgccaggagggtggtaaattgtttgaagagacacaggtaatacactttagagactggtatcacttgtagaatttggcatactttacttatcataaatagaagtgggttgggtaccttccaggtagtttgtccctaactgaatattagaatttctttctatgttttattttagtatataaatttaattcattcataaatacttaaggccctggaaggatgaagctttatgacagagcacttaggttatctgcataaatgtctaatgtgaaaccaatttcagccaagttgttagtagatacccattttgtatccccaaaatgtgctatatttataaaggttcagaaaaaatatatatatatacatgcttagcccaacatttttaaactgttaagaaaaaagtaaggaaatgggtcactaattaaaaaactattaccataatatagaaatacaaatgtttcaaatggcaaattttatttactcaagcaagtataagaaggagacattctgtagatggtattgaacactaatgtgctgttaaagaggctatgatcctcatgagcagagcagtgagtgctgaggtaggcgtttagaattatggtgcattgttttcatcagtatttaggaaaacttttaaaactgttaaagttcgtaggttcttctaagactgtattgaaagaaatataatgtaaatactcattgaggaaacatagcaacatgtacattgcctgttgccacaaagattttttttatgtgtagtattgttttcttttttattagatattttctttatttgcatttcaaatgttatcccctttcctagtttcctctccaaaaatcccctatccctcccccccccccactccccaacctacccactcctgcttcctggccctggcattcccctaaactagggtatacaaccttcacagaaccaaaggcctctcctcccactgatgaccgatcgactaggtcatcctctgctacatatgcagctagagacacgagttcaaccatgtgtactctttggttggtagtttagttccaagggagctctaggggtactggttagttcatgttgatgttccttctatgggactgcaaacccttcagctccttgggtactttttttagctccttcgttggggaacctgtgctcagtccaatggacagctgtgaacatccacttctgtatttgtcaggcactggcagagcctctcaggagacagctatatcagactcctgttagcaagctcttgttggcatccacaatagtgtctgggtttggtgggtttttatgggatggatccccaggtgggtcagtctctagatggtcatttcttcagtctctactccacgctttgtctctgtaaccccttctatgggtattttgttccaccttctaagaaggatcaaaatatccacaattttgtcttccttcttcttgagtttcatgtgttttgcaaattgtatcttgggtgttctgagcttctggcctaatatccacttatcagtgagggcatatactacgagttcttttgtgattgggttaccacacttaggatgacaggagcctaataaagctgtctcctgagaggcactgtcagtgcctgacaaatacagaagtggatgctcacagccatccatggaacggagcacagggtccccaataaaggagctagagaaagtacccaaggagctgaatgggtttgcagccccataggaggaacagcaatatgaactaaccaataaccccagagctccctgggactaaaccaccaatcaaagaaaacacatggtgggactcatggctccagctgcatatgtagcagaggatgacctagtcggtcatcagtgggaggagaggcccttggtcctgtgaaggttctatacccaaatataggggaatgccagggccaggaagcaggagtgggtaggttggggagcagggggagggggaggggataggctatttttggagggaaaactagaaaaggggataatattcaaaatgtaaatagagaaaatatctaataaaaatatattgaaatgttcaatagcataattagttatcagggaaataaaaattaagagcacaacctggtactactatgttgagccacattcatagctatttttggctacatgccacccatgatccacatagattgcttgtcaagaatgatttcatgaaagatgacgattattagatatccactgaagaattggtggattgttcatggtaagataaaacccagccttttcactagaaccaagtgtagctactggcttaagcagtgcaacgcattaaagaatattttcatgaacactacaagttctaaagtcaaaattcaaactctactgcttgctaacagtatcactagaacattcagatggcaatgctttttcctaataggattggtaaggattagtgagagtgacatagccacaaagcacaggaatagcatgagctctggtatctgatagacttcgggccaaacgttaattctgctacttactgaagacttcaggctcttgacttctctgagatttggccttctcattttttccatggaaatgacaaatgtatctcacccaactgcagtttgtatcaagcccttaatagaatttccagcatacaataaaagccttataaataatattccattgttatgcaatcaacgtcacgaagagattttagttttgtctttattcatgttttcagggtgaacctggtctgcctggatatccaggaaacccaggtatcaaagggtcggtgggagagactggtcttcctggattaccaggaaaccctggagcaaaaggtcaaccgggcctgcctggattcccaggtaggtgttcctttcccctttcctttcttttcccctctaattagtattggaagcaatctcttatttggcagacttgcatcatgtaccggctagcagcataacctcaaggtagaatgttaatgcttctttgcccacatgcctttctgtacagaatgagaaggagagaatgagtattcttgcctcagcagtacaatatcttgtgggcagagacactagtttggtggggcctttactattttttttcaggtgataatgtactctgtcgagctcttgcctgctgctgatagaacattgtccacaggcacacagctggcggctgttggtagaacaattccagtgttcattcagatgacaaggactgagtcattcaagcaaagagacttagcactgtagtgcagtagacagcctgacctagattgctgtatctgttgtttcatgcttccatgtaatttttactttggcttttgaatttcacagtggcacagataggtctttggttctctctctctctctctctctctctcagtctctctctctgggtctctctgtctctctctgtctctctctgtctctttctccctctctctgtctctctctctagtaaactgctgtttctttctctttttctcctttttattcttttttcttagatattttgtttatttacatttcaaatgttaccccctttccctgtttccactctggaaaccccctattccatcctccctccccctgcttctatgagggtgctcacccatccactcctgccttctcaccctggcattcccctacactggggcactgagcattcacaggattaaaggcgtctcctcccattgttgtctgacaagggcatcctctgctacatatgcagctggagccatgggtccctccatatgtactctttggttggtagcttagtccctgggagctctgggggatctggttggttgttattgctgttcttcctatggagttgcaaactccttcaactccttcagtcctttctctaactccttcattggagaccccatgctcagtccaatggatggctgagagcatcaacatctgtatttgtcagattctggcagagcctcctaggagacaactatatcaggctcctgtgagcaagcaaatcacttaatggcatccacattagtgtctgggtttggtgtttgtatatgggatagagccatgctccaacatataataaggacacatgctccacactatgttcatagctgccttatttataatagccagaagctggaaagaacccagatgtccctcaacagaggaatggatacagaaaatgtggtacatttacacaatggagtactacacagctattaaagacagtgaattcatgaaattcttaggcaaatgcatggaactagaaaatatcatcgtaagtgatgtaactcagtcacaaaaaaacacacatggtatgcacttactgataagtggatattagcctaaaagcctggaatactcaagatataattcacagaccacatgaagctcaagaagagggaagaccaaaatgtgggtgttttggtccttcttaaaagggggaacaaactacccgtgggagcaaatacaaatatgtagaggtccatacaaagtatggagcagagaattaaagaaagaccatccagagactgccccactcggttatttttctcctaaccttttaatggaagtataacatatacagagaaaagtacacaaatattcctgtctataaataagtttatgcctgttatttgctaactctaaaatgggtcttttagaggccatgcggttttttcaagatgtttacattttttatgaactctcaaaatgtaatgctttctatcaaatattaaagacttgctgttttacaaaccataaataaaaagtgctaatatatcaaataattgcttaaaactgagccaccaatactgtatatgactgatacatttatcaggagatgtgaattcagtgatccaaggtagaaagactatatatatgcttcaactccttttgtgtttattttccccccctgaaggttgtaaattatctcattttcaaaatacactgatctttcttttagtacattgtactgtggcttggaatctgttcaatgcatctactccaaattctcatcaagaaactgttgacaccagaagcatcatgcatacatagaagccacacttcttaagcctcctcaagtagtaccactaactggggatcatgcactaagactcccaagccttcaggggagattcatattcaaatcagtactctagttattcattgggctttactaattgtagaaaattaactcatacataactcattcagtttttttctcttctgttggtttttaacccctttatactcttttagtgactgtcctagacatttcaatactctttatgttctcatacaatagcaacattataccatttcatataaaatataaagtaaatgtaaacagtgtaattctattctttatgaaagtctttctgactgtctccatgcatttcatttttatgtacatgatgaatcttacaattaattgctattatcattttatattgctggtgtcaggacacaagaccttatgcttgctaggcacgtgctctacaactgacttgcgtctctagctttatatgtgttttaagctctatctagagtttattgaaccctcaagaatttattataggaaggggaatacatttttccacgtacctatctattttccatttgaattgttctacattttttttacagcacagttacacttgctattattccctagagcctgatctactttcactgtcatttattatgaagtgcctactggtgtcaaaagatctcatatttacctaaacatgtctttatttcaccatcggtgtaagaaaaatttagccctgtgggtattgggcctttagagtttgaattgtgggtcttttgcatgctaaggcagcactgtccactgaaccacattcctagcagcaagtctatctttgacatttgttccctcactgagtatttttccactatcttttatctaaatattgtcctaataataaatccatattttaaaataattatttcctgtatattatacactgaggttttttctggatgcattttctgtagcatttttaaaggtgtgtgtgtgtgtgtgtgtgtgtgtgtgtgtgtgtgtgtatgtgtgtaggatatgagatcatccatgaagatacacaggatatggcatcagatctctagttataggtagttgtaaggttgggagtctctgtacttaatgggcataataggaactaaattctggtccttggaagaatgttgtgctaagttaaatactgagctctctctccagctagtaccattgatttgttccattctcctgtgacgagctgtcattatatttatttatttatttatttattatttactgatattcctgcatctataaaattgttactttagaagaattttaggaagatccatctatttcctcttcatctagttatttcagatttttcccatttatagtaataataggttattcaatattgtctcatttgttttggaggttttggcttgcttgcttccttccttccttccttccttccttccttccttccttccttcctttctttctttctttctttctttctttctttctttctttctttcattctttcgtgtttgtctgtgtgtctgtgtgtatctgtgtgtgtctgtgtgtgtctgtgtacgtacatgcagatatcaagggaaaaccagaggtcatttgttctgttccttcaccatgtggggtttgaggctcaaacttgggttatcaggcttgacggcaacctttttactcagtgaactatctcatcaactttggccatatttcctttcaagtttttggttttgtttagattttactttcacagctgttaattatcttcatgtttactgattcggttttttctggtttgttctttatgctgttgctatatataagaaaaatagcgggtttttttccttttaagagttacctcacacacacacacacacacacacacacacacacacacacacacacacacaaagagttaccttatttcaccagaaattgaccatttttcactcgtgtgcattttaatctgaagatttttttcttattaatttctggtgctggcaatgaactcagtgtaacacatgtacatacattttctcctgagttttataaccaattcctatgactgtaggttcttggccacattggtaaatcaattttaaagaagttttctacttattttaacattctaataattcaggagtctcattctgctgtttgctcttctatactgtttaagattgatattccttcatatgaggtatcacttgttgtgccttgtctagacttttatatttctgtgataaaatgtcatgagcaagacaacttttttaaaacaattttttattagatatttccttcacttacatttcaaatgctatcccaaaagtcccctataccctccctccgccctgcaccccaacccacccactcctgtttcctggccttggcattcccctgtactggggcatataatctttgcaagaccaaggacaacttttaatagtgtctgagagttgaagagggttacagttcataaccatcatagttgagaacatggtagcaggcaagcatcagtagctgagagctcacctcttgagacagttatgatgcacagagagctaacttggatggatgtggagttttaaatctcaaagccccccactcccagtgacacatctcctacaacaaggccacattagaagtaatcattcaaaaatacttccatcaactagaggttatgttcattcgaaccaccacatgcactgaatgttataaacggtacacatagggattccagattctgtcaaatttctttataaaaacgttgactattctatcaggtcatccattttttgaaaatcaacttgatcttacattgattgaatttaggctttattacaatggagaatttccattgcccttacccttaactgtacctcctagacctggtatatgagctttccttttaatctgtggattttctggagttatttccgttgaaattttttaggtaatgttttcattcattaaagtatattgtcagtaaaacttcttagctgtctttcattagaagatttttattgttccttaattcaattttatcaattatttctaagatgccttcccccatgaacatttgcagttccttgttaaatcaaagactaatcgtggtactgatgtgggatgactttgcaaattgacaactctcaaactaattcattttaatatataaaaatattttctgtatgtctcacatagtaataatgtaaggtctttagatttattttttcatgtatgtgatttttttgcctgcatatatttatatgaactaaatatgttacttgtacctgtttaagttaggcaaggtcatcagatactctgaaactggagttatgggtggctgtgagccaacttgtgaaggcaagaaatccaacccagctcctctacaagagcaacaactgctctcaactgctaagtcatctctctaaccctcaaataaactgtttaaaagcagaacatttccccaaactcatagcaaaagtcaaatcagagagagtcaaaatgtaagagattaaacataagacagcatctcccttactcagatgaaaacgctccacaggatagaaatgtgaaaagtctgaaaacgggaatgactttcgacaaaaagcctccaaagaaataggaacttcttgaagttatataatcacaagacaccaaatatggctgataatttgagtaggcttgaactttatcctttttcaaagtttcaaactaagaacctaaccacacagctaccttagtttgtttaaatgaatcactaaacagaagacgtgcctgagctgcgcctgtactagtgcctattgagatggagtaatgattgatgacactgttgtggtataatctcttgcaaaacaatagaaaatgaatacactgctcttctagctatacttcaatttcttctccactccaaatacgtctagtgttcactttcatatggttatatatctttctgtaagaaaatttaaacacctaaacaaatgaaaacaattatatctatacatattataatacagatagcatattcatggaataaatttttttaatttgagttgtcgaaagaatggcccatcaattcaaagtaattccagttcataagtcaaacaattaaaaaaaataggaactagagagttctctcagggattaagagcagtgattactcttgcagcagacccaggtcaatacttagcacctcatattggctcataaccatctgttactccagttccaggccatttgacaaccttttctgaatttctagggcaagagacactcatatggtaatatatatataaaacattcacatacataaaataagtcaaaaaagagaaagaaaaaatttaaaaactaatgctaaaatggaaagggtgttgaatatgccaaatagtattgaaaaagaaaaaaaccttcattgaaaaagctttgttggtaggcttgcactccatgatctccaggtgtgtagtaattaaggtggtattatacttacataaagattagtaagtaagagagcatagaaaaagacccatgttatacaataaagtgacctgaataaagtttctttacaaaatggaaaataaaggctatacaatgaaggttgcttggtgttttggctgtgactgatccttaaatggctgaactatctctctggccatcactgaagctttcttaaaatacaaaacacaacaacttcaaaagaaaataattgaaagatttcatttaagcaaaatttaaaactctgattatcaaagcaagttattataaaaataaataggaaaagtaaagtttaaaatcaattgacatatgggacagattggtatctgacaaatataaataacttctataactcagtaagaagaaatacaattcaatttttagaaatgagaaaaattttgaactgatatttcacaaaagaatatatgctgatggctggtcagtacatgagaaggtgaccaatgccattaaccatggaagtaaacacattaaaatcacatgactaacactgtggctgttttttttcctagttttttttttaattaatcattccattcatttacatctcaaatgatatcccacttcccggttatccctccacaaatccccatcccttctgccctctccccccttccttttgactctatgagggtgctccctcacccacccactcaccctacccgcctcagtgctccatcatccacctacgctgggacatcaaacctccacaggaccaaggacctccactcccattgatgtcacacaggccatccatcctctgctacatatgtatctggagccatggattcctccatgtgtactccttggttggtggtttattccctgggagctctgggtggtccagccagctgacagtgtccttcctatgggattgcaattctactctgctcctccagtctttcctccagctcccccactggggtccctgagctcagtctgatggttggccgcaagcatccgcatctacattggtcaggtgctggccgagccttccaaggaactgttgaatttttcgaagcaacagttttatatgttgatattacaacatatattgtgcatagatctggaacaactggctgttttaaatctaaaataacttctatattttaataaaacataaaacaaatcttagtctgacctagaaattccattcttggccatttactcaagataaaggcatatattttcacaaaaataaaagaagtcatgcaaaatgtccatagccactttattcattatacctaaaaaaacctggcaacaaaatcatgtccaacaacggatactgaatttaaaaccaagtattaaatctaatactaaaaattttattaccagtacagtatcactgaaattatttttatatttatggatacataatgatatctactcccgtcaaattaatttgaaattatctagcaatcatcaacatgttttggattcacttttggtccttattatttcaatgctaattctctaaatttaagcttcatttataactcataaaggaatgtactttttttaattattttttttgagtgttcagaagcattttatttattttttttaattaggtattttcctcatttacattttcaatgctatcccaaaagtcccccatacccacccccccaatcccctacccacccactccccctttttggccctggcgttcccctgtactggggcatataaagtttttttaattcttaaactgaggtttttttattctaggaacaccaggacttcctggaccaaaaggtatgaatggtcctcctggtaaccctggctttcccggagaacctggtcctgtaggtaagtaagaaagacagcattgctgttctgtaagactaaagcttttcatagtcaaatctgctcctgctgtgaagaagaaacagggtgctcattcacttatcacttcatatcggacatgaactgaataaatttcattttaaaattatcaaaatttatctctagcaggtattgttgtcccagctcacattttctagggagagtaattctctctatgaaggtcacgttgtagcaatatctttgtttattgacttttaaaataattcccgtcttggcccttacctgaaaagcacctcatccctccttaacacctttcctctcgattatcgtgaagttagactaaaatgagttattgttatttttgctcatcattaccttgctttactctttgttctataagatttcataatttagaggagcatttcagaaggatttgttactttggggtttgaaattttggtttgtttttaattatggggggtaggtattgtgcatggaggtgacatgtgccagtctgcgggaactggaattacaggggtttatgaacgacctgatgcagacgctgggaacagaactcagatccggtggaagaactgcaagtgttcttgacaactgagccatctccagcccacgttgttactgttaggattatttggtgctttaataggaagactggagaaggatgtggaaggaagctgaaaggatcagtgtaacctgtagtgttgttctttaggtgccggagggcgtcctggaccaccaggacctcctggtgaaaaaggcaagccaggtcaagatggcattcctgggccagcaggacaaaagggagaaccaggtactatagtttttgtatgtttgtttgtttcatttttttgaattttctaattacctcacggccttctttacagctacaataaaactctgtcttccttacaatcttctaaggtcccacacagttcccccttcctaattaacttcttccttggcatcctgaaaataacagctcatttttgttgaacaagttgcttttgtctgaagaaaaaagttatttatattgtccacttccttttacaagtactgacctaggcattttcaagtgtttcgttcattgtccaacctgtactttacttatgcattttcatccaagtgtacaaagtatctccaagggtcatcacatgtacagtgtgtgtgcatgtgtgcgtgcgttgcttcttttcaaaatgactgcagattgactaaaggttatcagtcttgctggaaagcacatttactcactgagccatccttccagctatgtagcttcctttctagaataactgacaaatatcaagtagattgtgacaacataaagaattatcctataccagtctcgaaaagagtttgttttcttatatgcaccatgagctttccagagccagaagaaggtgtcagatcccctggaaatggagttatagaagtctttgaagtatcatgtgggattagggagctaaacttacttcctctgcaagagcagctgagctgaaactctggtccctatagttttcttatgttgaaactattctatgttagaagtcaatcttctggggaagagcattaacttagtggtaatgcgtgtttctagaatgtgcaagccctaggtctgtccaagaaaagaagagttggggaggacagaagaaaaatggatggagtaagcacagggttaagaagagaggggactaaaaaagttaatctttagcatgtttgatataatatataacacttattagaaggaacctcaacaatcagctattttttttatcttaacaggtcaaccaggctttggaatcccaggacctcctggactcccaggactttctggtaaactttaaccaaacaagttaaaataaaaatattcttcagtccatttatttttctacctctaccatttactattataaaatacatctgaaatttttagaaaacagctcaacctatttttagggtacttcttattcctagcaaatagcctatgttactaagaaagtcatccttacagagacttcaataaatagcctttcattcaaatcataaatactgaggacatgacgcagaaaagaggcgaaaattgcaggaaatttagaagctttcatttgtccagaaaaccactcttctcttctgccagagtagtatcataggaacatatgaggcacttctgtagaaacacatgccaagagtaagaatttttcttgaaaactcatctaagagctacacataatgacatacacctgaggctgaagcaggtagattatgaattctgtgccaacctgggcctgggctatccaaagttctcaggtgagaggaggccattatgtgtgaatacatatctatcttccctctttagtatgtgatcttaaaataagtcctaaactctctctctcttttttttttttttgttttttttttttgtttttttttttgtttttgtttttttgagacagggtttctctgtgtagccctggctgtcctggaactcactttgtaaaccaggcaggccttgaactcagaaatccgcctgcctctgcctcccaagtgctgggattaaaggcatgtgccaccatgcccggctaagtcctaaactcttaacacaaatctgaataactacagatatgcatgttgataccttgaaatgatcattagcagttctatagaagttttctcaaactaaaaatctatctcctaaaatttccagtatgcttttcatgaaagtttaatataccactgtcttacggtttgtaagtattagtatttcataataaaatgtcaagagcagtttgtctagattatgattatgaacttttaatatcatggtctgaatataatagcagccattgaatctcattagtcttaaaattagatccaaagctgtgatagttgtcttcatccatcttgaaccaattcttgaagatatttttatacattttatatctggtctatcttttttcctcataacttccggtcatgttataattgccctctgttctaatatgaaggatgccggcattagtttttcattgctaataattgcttctgatgacagatacatgtgtttaataaagagaaaagattttgcatgtgtttgaagcaaatttaccctagtgaatttcattagcttatcatgtagctttaggcttataggtgagcttatgattcagcattcagtatgactgcatgtatccctaattacacttttacttctacaggacaaaagggtgatggaggatcacctggacttccaggaaatcctggccttccaggttcaaagggtgagccaggctttcagggattccctggtatgccaggtcccccaggtcctcctggttctcctggtcaagctttggaaggtcccaaaggaaaccctgggcctcaaggccctcctgggagaccaggtatgatcgtgtgtggtatgaaaaatgccctgtttaccagttcagttagttgattttgctggcaggttattcagtcttcaagattttagaatttgtcatgtgagaacttcttttaagaaaatagctaggttcatacctagcttgttgcaatatatacattcatttcaataatgcatgtattatttacctaaagttcatcttgaatggaaaaaagagaaaatggtaaggttttgttagtattgttattaaagataacctggcatcaaaatgcaacctgcaccttttttaatgtctgcttcttagcatgtcatcacagaaatcattctagtgatcaccaagtacatgcttgtgttccatatcagaagctgttgctatggttccgtcacatgatcagcaaatgtcaccaggcacaataaaaacttaatctctaggaactaggcaatcacatttatcttcagcagcacagcatggtcaaattgactcataatctcttcatacctcatgtctgtccctctctttcctgtgctcactctttagtagatcaattttgcatccaagggccagattctcatttttgtgtctctgctgcgtcattccattctattaattgggaaatgctcattctaaccccaggttaatgttgctgagctcaatagctcaatcactgttgatagcctattaaaacatttgaggtacttactattcattttgggcgggtaactgaaaattttgcctttattattttttaaagaagagaaatttgagatagaaagaaacaaaacaattgtcttttcattgctcaaatattcttaattcatttctaaagtatatcataaaactaaaagttatatttatattgcaagaattgaacttgattttactaatatgtgccctaaaacatgaattaagcagtataatgtactgaattcgggacatcattttcaaagtcagctgtaatgtgatctgacttgattgtttctgaagagagttgctttttcctttgtttaccactgaagaaagacagaggaaatattctcagccacattaactgtcttgcatgcaatataaagaactgaagccagtgtcttgctttgtttgcctgtcataattcaaataaaccaaactattatccccttatattctaattagcgctgcacttatttgtaactaggagtggagctctcagttgaacatttctgtaataatagtaatagaaaagcagtagccacaaacatgattttgcaatcactgtttctaaagactaatcaaccttctccaaagaagaatgcacatctaatgaatgtttgatttcttgatttgtttataaactacagatctaaaataaagtgttaaatcaatttctcttagaattaaatgttccaaatttgagctcataacaatgaacatcataatatgatttttttgaactttcaaactttattacgtgtagttttccttttaacattaatgcttaatagagatagtttggtttatataagatgcatgaatatgaactttcagagagttctattattaaattcaactttaacttgagagtatttagtataatgctatagtttcttgatgtttctaacagttttgatattttcctttttgttaatgatgacattgggctttggtgaacttccatccctacccaggtcctccaggttagctccttaactccaaagtagtaattgcatgaaatttgaaactttatcaatgtatttatgtacttatatacgtgtatatacacatatgtgcctgcttatatatgtatgtgtgtaatgccttcaaggttctaaatatattttaagagcatatgccaattcagttttgaaatggtggcctgggcctaagttgtcagaatattgtagcgccaagtatttcccttggaatggttccaaattatccaatcatggagatggactaaattaaatacttcaaaattcatacttctgtgtcatttttaattgagattttatagtactcaattttgtcaaagtatgcttttcctttgttagaaagtattttattgcattataaacttttaatgcaataaaattaaactcattcagaaaagcatctttaataataataataataataataataatgtaggtaatgaaatccttgatttgatacacacacacacacacacacacacacacacacacacaaacacacctctataaggttttcaaacagcttcatattttggcttgtcacatattttcaaaggtttacacattttttaacttctgagcatatttgtgtgtatatatatgggctgcaggtgcccactaatatcagaggcataagactcacctggagttctttgtatatattgaataatagccctctatcagatttaggattggtaaatatcttttcccaatctcttggttgcctttttgtcatattgacagagtcctttgctttacagtgtcctttgtcctttgcagttttatgaggtcccacttgttgattcttgatctttcagcacaaaccattgctgttctgttcaggaatctttcccttgtgcccatattttcaaggctcttccccactttctcctctataagtttcagtggctctggttttatgtggagatccttgatccacttgaacttgagctttgtacatggagataagaatggatcaactttcattcttctacatgctgaccgccattgaaccaggaacatttgttgaaaatgctgtctgttttccactggatggctttagctcctttgtcaaagatcaagtgaccatatgtgtgtgggttcatttctgcgtcttcgattctattccattgatctacctgcccttgactataccaataccatgaagtttttatcacaattgttccgcagtacagcttgaggtaagggatggatctggagaatatcattttgagtgatgtaacccaatcacaaaagaacacacatgatatacactcactgataagtggatattagcccagaaacttaaaatacccaagatacaatttgcaaaacacatgaaactcaagaaggaagaccaaaatgtggatattttgactctttttagtaggtggaacaaaatacccatggaaggagttacagagacaaagttcggaacagaggctgaagaaataaccatccagagacagctccacctggggatccatcccatatacaatcaccaaacccagacactgttgaggatgccaacaagtgtttgctaacaggagcctgatatagctgtctcctgagaggctctgccagtgcctggcaaatacagaagtggatgctcacagtcatccattggactgagctcagggtccacaatgaaggagctagagaaagtacccaaggagctgaaagcatttacagccccataggaggaacaacaatatgaactaaccagtacccccagagctctcttggactaaaccaccaaccaaagaatacacatgatgggactcatggctccaactgtatatgaggcagaggataacctagttggtcatcaatgggagcagaggcccttgggtctgtgaaggccctttaccccagtgtagggggatgacagggccaggaagtgagagtggtgggttgttgcacaggtggaggggggaggggataggtggttttaggaggggaaaccaggaaagggataagatatgaaatgataaagaaaatatctaataaaaaaataagactcacctggagctgaagtcacaaacagttgtgagctgtctaaaatgggtactgagaactgaacttgggccctttgcaagagcaatgtctacttttaaccactgagacatctatccaggtcctttgacacataatttttaaattgctttgctgtgaagaactaataagcataaaggaaaatataacttaatgtaaccagcacagattaaaggctcacaatcacatatatggtcatcacacgtagcaagaaattatgccaaagaaaaattatcaagagttacttcacagggttggaaaaaaaaagatctgttgcttctagttttcttttttctttttttttaaatgtgtacccaatctggtataaaaagttaaccatggacatctcaatatatttattattttcaagataaatagtccttttctcttttgtagaaaggaagtaaaataggtcaaaatataatcctgagatatgacttttgaaaatggggagggtttttttttaattggatttttttatatacatttcaaatgttataccttttcccggtcccctctccccctaaatcccctatcccacccccctccctctgcttctatgaacccacccacccacttctgcctccctgtactggggcatagagctttcacaggaccaagggcctctcttcctattgatttcggacaaggccatcctctgctacatatgcagttggagccatgtgtccctccatgtataatctttggttggtggtttagttcctgggagctctggggggtctggttggttgatattgttgttcctcctgtggggctacaaaccccttcagctccttcagtcctttaagtcctccattggggaccctgtgctcagtccaatggtcagctgcaagcatcttctgtatttgtcaggctctggcagagcctatattcaccacagtttgtagagggagggagatatgattctctatgtcaattgattccttgatttatttctaccataccaacccatgcacacgtacattcatacatgcatacacatatgtgcaaaatgttttatgtgtaagatctattgattaggaaaattttaaagatgcaagctctgaagacaaattttatcatgacaactgtaatagagaagaccccattataacaaagaaaaggaactaaactcagctccaaataaaacagaaacaaagacttccagggacataaggagagagttattgactgaaacttactaagaagtactagaaagcaagaggagtcttacacttacttcatatgattctcactgaaggcaggccaaggatttagacatcagagtgaggaatgaggaacttgatcagatgttaactactggagatttagagtttgaaaggtactaaactgatttggttggatttttcctgtaactgggcttcaaatgctaaaaaaaaaaaaaaaaaaaaaaaaaaaaaaaaaagaggaagggggataatgtggatgttaggtgagatgtagcaagaagtctcagggattctggtttaaggtttagtcagagaaagaattatttttcacacaggaaaactaagacccaaaattattgagaatgtggacttcccagtactcttctactagtagcaccctataattcttgcacaaactgttgatgtttatgatatggtttcttgataaattcatggagcaaaactgcttttatcatgttaggaaccttatagttagctagatcttagatctagttatctcctcctcttcctcctcctctttttcctcctcttcctcctcttcctactcctcccttcctcctcctcctactcttctttctcctcttcctttcttctcctcctaccccttctccttcttctccttcttctgttatctcacatctccgtcaatccctaataacatcatcttacattcttcctaagcggatgctcttgagtatattaagacagtgaaaatgatttaactatcaacaggataaagacaagattggggtaactttgaagcaattttcactgttattctgtctaacttgcctagaattcttctgccctgatcactgctagactggaatgcaagctaggattttttttcctgctatactagaatatatttgaagaagaaagagaaaagtatctccaatacttttttttttggtttttcgagacagggtttctctgtgtagccctggctgtcctggaactcactttgtagaccaggctggcctcgaactcagaaatctgcctgtctctgcctcctgagtgctgggattaaaggcgtgtgccaccacgcccggctttccccaatactttttaaaccaatttaacaacttcccctttgttaaacatgataaaaattgtaattattgaaagctagcctctgtgatggttacaataggagaagaaagcaactttgagtggaaattagaattaaaatataacagctgattctataacctacctaccttcagtttctttttcagttaaatttaagtacatgatttgaaaaatagtaaattgaggcctcacacataaaaattgacttggcatatagctcattaatatgtagccctttagaaattaaactcttagaaattttgctatgatatggtccaaagtttcctgtgctgatgaatcattaaaatacctcatatcaataaaatatctttctgaatattattattgagtcattctaaagctaatattcatataacgtatcttcactttgaactatgctaaaagcaattctaagctagttaattgagtgtccagactataagtctttggctaatttgttgtatgtggtttggagactatttacataaactgaaatatattattctaagtttccaattctcaaatgctcctaaatttttggttttaatcatcattgtgttcttttagcatcttacacatagcagacagtagttctatatttcgaaacttgactttgatccttatgtaaacatgcaaggaaggacagtatagataacactattacattcagagagattgaattacccacagtcatatagttacaaagaagcaaggtcaagaggaagttccaaggtcttttaactcgtggtactcaatggtcttgcactatttattctctttaaaattcaatgtttataaatcatagcaagaactctaagaaaagagaaattgtgtttagagttgatactaaccaaagaatgttctacttgtagactttaatattgttacataatttttcttctttaaatggttaatagtctgataatacatgcattgaataatactttaaaaaaaagttgttgtaatacttaaaatggcttggggtaggttgctgcatgccacaatatttttaaagtacccctttactaatagtcttcatatcattggaaaattggaatatttatttttaaattcaatggctgtttatgcttagtacttaaaacaaatactaatagaagatggcctcctgatttattatgaaaaattaaaatatgactttataaaaggtatttgaatagggcaaacaaaagcaaaagtcataatggttgtgccatagtttaagttttctctgagtttcaggtcagcttcctaattatatttttgcctgtgaggtttgaaaagttaactgttcctatcatattggttcactccgaacatcaaaatacatttttacttcatgtttgtatcaaagcatggcagaggtttaaatacttgttcacagttactttgttaaagaaaatgaaggcttttggtgaaatggtactatcttgccaactttaatgttttgaattgctaatatttagaaatatccagtagtcacgttaacatagtctcttaaatagatcttccctcccattaatggccaacagcttattatctagaataagcactattttaaacatatttagttctctatatttctggatgggtctgtttgcctattgattgtgctgtaggtataagaaatgcttacaaagagaattactgttcaacttgctctataatgtgaaccacttctaactcatcatctgattttgtactgtgtgatgtctgatcctgctgatatcgatcttttggctttggtgaactctgatcttcccaggttttcaaggttagactcttcgctggtcacttttctcctttattaaatgctttatatatgtgataagagagatgcactttattattataattcataagttattgaaaatgatgttatcctcaaatactaccctattgggttttgacatttttgacttattgatatttgatataatatcagttttttgtggtctgattgtttgtaatagatacttttatatataaatacctggtaaaactgaaatagccatacaaacgcctttacattataaactgcattaagatatttaattaagcaaacatctggataatttctaatctctgcatatagatttttttttgaaatttttacacacaattgccttaagctgtgcgatcaatgctgttttcaataatagagaaagaatgctattagatacagttaaaataaaactctgtttttactagaatcctaatttaatttttttgagacagtcaaaatatcatgtctgagatgacataaaattcccagtattttctttttagttgataatagaaactccaaatggagaataatgacatgcaaaggttcaatttccctatcttatatcttccctcatcattgtcattgggttggttcaaagactattcagttttagcttaacagcctaaattgctaccagacttctagcctaaattgtacaaattactgagtttatttagaaaatcttattctagtgtatttgagctaagcagctgtggtttatgtttttccaagtacaaagtaactccaaacctttcattacaattgcaaaaggatttttttgtgattgtgatatctgtttgacaagctaaggtgattgtatgatttaagttgtcaaaattaattgctgtattatcacgaacttgctctttgtcataaccagataattaccacattgtgaaaccacttaaaaattctttaaacattaaaaatatcataagatacattttatgtttaattttattactaataattaatagtaagcataactatcaaaacaccaacatttcatggttgttagtatttggtaggcactgtccagtgccaaagccacctggttgcttaagggaactgatatctttatttagaatgatatgttaaaaatgtagtacaaaattttaaaaaacccatggaaatattttgaaatgaattttatatatactatactgaaacaataaatatatggcatttaaaagatatcccatgtgccaaacatatcaataaaatgaacttaaagttagtgtgcttaactattttaaaactattttaactgctcgataagccggtgctcagatgttagatgtttgcctaacatacataaagccatatgcgtgactcacacaatacaaaaattgcacagtggtaaaaggtaaataaacatatcttcttataaataaagcagttgaagttttttgttttacggaaatccatctaacctaggacttagtcaaatgctatgctcatccctaagtaatttaatgtttatctcagtaagaggaatggcttgaattcctgattgctctacaacagtcattccctaagtgttggtcatgtggccagcagcactaagtactaggggacatatggagccaatacttcaggatgtgacccaggaaactgttttgatatctccctttccacaggagcatactgtaatttgagactaatgctatcctatgtctcatttcaatttgagtcaaacacgcgtacatggattacagaagcaaacatcatatccagagttgttttagatctgagtttactatgtttattagaaaataaaatacaaaggtctggggagatgttgctgagttggtagactatttggctgatatgcatgaatccccgggatggcataagctagatgttgtggtacatccctgtaatcctagcacttgggtcttagggcaggcagaccataagttcaaggtcatttttggtgcaataatgagttcaacaataacctgagatacaggaggcactgttccagaaacgaatgtaaacctaaggggtctaaaaatcagcattaatgacaaaaatgtctacatttactcagtcttcaccacaaagtaacaaaagatgactgatattttaaaaacctggaatactatactaatatgtggtcatttgttgtgcattaccaaggtccaccaggtacagaaggtcctcgtggaccccctggaaatggaggtatcaaaggagagaggggaaatccaggcccacctgggcagccaggcttacctggtttgaaaggagatcaaggaccaccaggactcccggtaagaagtgagactagatatttgatggtagaatagtgtgggtgacagttttcaaaatgggaattctgagcagcagaattttattaacactcaccacatagctcactggtgaagtaaaaagaaaatagaaggcaaggctcctagtcttcccatgaaattgtctttactgttttatactaaaagagttttggtgagagcaaacctatgaaaagaaaacttacatatacacatcagtacattgtattttagatgaatacacccataggaaagtaattatggcaagtaggaatagtttagactttggaattagagtcagggtcaggtttcagttgcactatttttctcagtttatgcttctctcttctataaccacagtgcagttatcaactttgcaaaatttaagagaaatcaactattttaatttctactctttctgttctgattttatcaattggtatagtaatgtaaattttagcactacactctgtaacaaggtatccagaccaaattgtgtgttccatttaactgctatgtctctttattctataatatggaatcgttccttagccttttttctttcatgattttaatacttaaaaagtgtagcctattctcactttaaaaatgtagcagaagatggccttatctggcatcactgggagggaaaccccttggtcctttggagatttgataacccagtgtaggagaatggtaggctgctgacagaggagtggatgtggggtgggggggggagagggaagaggggatgggggcttgtagatggggaactgagaagggggataacatttgatatgtaaaaaaataaccagtaaaataatagaataagccttcttttgtctaatttgtcattttaattaaattcaggttgtacatcattagctagaatattccaagagcaatgaaaatactgtccttatcaaaatttatccataaatttagcatctattaatgagttttgaatggataatttctactgggttaatggcaaaatggtgactttgtaaacttggcattatatccacatgtaccatttagttctactgtaggcaagagatgtcccttctattctacgcagtcacatatttattatggacatgggttcatgtttttttttccagtcatttataaaatttgaagctgtcattgcttattttgatattctcattgttccagatttgatagccatatcgagctggatccgatgacattgtgacatgcttctaaaactgctttttctttgacactttcttatattttgacataaaaatacattctcacattaggcctttttcagtcctattaaaagcttcacagctctacagttagtgtagtacagtagcctcttcaatcatcttgacattatatgttcttccttttagattcttaagctattttctctctcttcctccccccttcgttctcattttttgttgctttctatattatcagtggctctcatcaacctaattatcatcccaagattatatttgccaagtctttcagactttatcatttctccatctaccactccagatctagagtacaaagaaagtgctttttaataaccattacttactaaatactctatatcatcaaatttctaaacatgtaacaagaactttgtcatttgatccttcccaccactccataaagtaggcatacttttttctccatgatgcagaagagaaactatgggtaaaaggttaaatattttaaagtcacaggtatttggaaggctctatgccccagtgtaggggaatcccagggccaggaagcaggagggggtgggttggtgagcaggggagaggggatagggggtttttggaggggaaaccagggaaggggataacatttgaaatgtaaataaagaatatatctttttaaaaaatcacaggtaataagcagagtgagaatttggatccttccagtttaactggaaaaacagctctctaagccactgtgcaataactgaatctttattctactctgtcctagttatgattctgataccaatgacttttatttatttagggtaaccctggccggccaggtcttaatggaatgaaaggagatcctggtctccctggtgttccaggattcccaggtatttgaaagagtggtttaaggttttctttatatttttaagtatttttatttattctttgaacattccatatattcaatatattgttatcgaatgtacctctactaccttcctcaagatcagtgcaattgtctctctcccaacttcatgttctctttattactcctccttctcctctactatactatacactatataatatactactatacttctatagtagtagtagtaatagtagtagtagtagtggtagtagtagtggtagtagtggtagtagtagtagtagtagttgttgttgttgttgttataatactaaacaataccctaagtccaactagtggtgaccctattaagttcctttggaaaaaactggtttttgctttgctttgctttgctttgctttgctttgctttgctctgctttgttttgtttgtcttattttcctacataaggctgtcttgttgcatatttatgccattttattttatatatcatctttccaggaatgaaaggacccattggagtaccaggctccactggccctgatggggaaccaggtcttactgggcccccaggtaagaatttttcttctcctaaggctgtttatgcctgatactttgaaacatgaaagactttttgaagtatccgtttgtctttccaaattatcaacataattttcttaccagcatcatttcctaatttcttaaactctttatttagttctattatattgatagccaccttattaagtttaagttagaagtacctagccccattcaacaggaggaaagctagccagccagaatggagctttcagatcaggcctagctcgattcctatgaattccttaactcaagtctgtggtatcttcagtaatagggccttaccatcaagttttgggtaaccacgagcctgtaatatttggggatgacctatggtaactcactacccagtaactgcaaaagaagtaactcattacctgcactggacttttcatttgttagcctgtggtatctactagaggtattgctattctgataatgagttaccacattttaacttgtatatatgtgtatatgtgtatatggatgtgtatatgtgtgcatgtgtgtgcgtgtgtgaatttctgcaatagtaggtttccatatgatgtgttcaaaggtatttaatgttactatccatcctaattgcccctcctctacactgccttcctttccccaccccaatttaacccttacagtttttagtccagttttctatctctcctcctctgaaatttcctctctctggtcctttattactttcctgacttttatggatattccaaatgaaacaatcatctgatggcttaaagctaacttccacagattagagaaaacatggcatttatttttctggtatgggttacctattcagaatgattgtttctaggaccattcatttatgtgcacatttcatgctctttttcttaatatttgaataatataaatatactatattttaaataccctttcatcagttgatcaaaatctctagtctgttttcttttcctggctattgtaatgagaacagcaataaacatcaatgaggagatatctcttttgggattactcaagagtaatacaactggatcacatgtagatctgtttctagctttctgaatcacctccactaattttcaaattggctgcacaaggatgtactcctaccagcagcaaacaagtgttcctttttttccaacacctatgccagcatttgtcattttttttgtttttgtttgtttgtgtatgttatatgtatatatatatatatataaataaataaaatatagacattctgattgggtaagataaagtctcaaagtattttaatttgcatttccctgatatctaaatatgttaaacatttttaaatgattttgcatcctgtgtttagtgtatgtatgtttagcattgctatgtcctggtggaattttttcctttaattagtgtaaaatttccctctttatcttctgattagttttggctttacatttgtttcatcagatattagagtagctacactatgcttgtttttgatccattttcttagaatatctttttccatccttttaccctaaaatgctatctatcattggtcattaggtatgtttctcagcagcaacaacaaaaaagagacagatcatgttttctgatccagtctgttaatctgtgtcactttattggagagctgagaacattaaaagtaattgttgaacaacatgcactgatttctgatattttgttgtcttgtgatgttttattaggcttcttttcatccaatattctgaaaattttaaatctgttcgttgtgcgtgaggatctttacccttctctactgacctaagtattactggaagtactctctgtaaagctagcttatggatcttaaatgctttaaatatatatttatcctataacgttttcctttgtcctattatgactgataatttgggtggatatagtagcctgggatggtgttttgggcttttaacaacttgaataacatcattccaattcattctacctttcatagtttccactgaaaaatcaactgttattgtgactttcttttaccattgaaagatttaatatcctttctttattctgtccatttttaaaattttgtatggggaatttatttcctggcccagactatggtgctttgtatacctcttagaccttgatttctttccttatattagggacattttattctatgattctggcgaaaatattttctgtaccttttatgtgagctttttctccctctatacctattcttcctagatttggtcttttatagtggcccaaagttcctgtatcttccattattggaattttttaaatttgacattttctttgactgagtgatccaattcttctacctattcttttagacataatatttttctcttccacttggtctaatctaatggtaaggctttcatctaatttttggtttgcatttctgaatatttcatttcaagattttttattttgacatttttgtcagaagttctatttctttattaaatactattttttatatcttgaattgttttgattatttaatcctgtttttgagtgcttcattctagaattcattcttacctcttcaagttccttgataattctcatttttactattttgaaataccttgttacatatcttgagtcacttttctcagggaacattatgacaggagtattaatattttgtgaagactttttgtttagattattcatgtttgtgtatctgtgatgggatcttgaaataggttgttgtcttttctttgttgaatggatatttgaagctctgattcctagaacccaaagttatcatgcaacagaccagatgaataggacttcctgtttagtctttgtgcactttagtgttgatgtcatgtggtgtttcagaagtagtctcagctaaagcacaagctaagcgaattttctaagcacccaaataagccttctgtaaagttaggaaatcctacagcagatcttcaggagtgttgagggaaggttctcaggactgatcctcaagcagtagatgctagtagaattgataatgcaagcctaggatacctacctgaaggagaggagcagggtaggggaatgggaaacagggaatgagggtgcgtataatgctaattcttggagagtgacagtctttatttagggcatggaaaagggtggacttggtaactagcatctttgattctgcattgacaagcggccagtggtacatggcagctatagatggagttggcagctataatctaggcttttttttttttttttgagaggaggggagcaagggttttcagcatagaaggatggagttagctggatgagtctggcgtttctatccagatgagggattactgaaggtgggtcaaaaggctggaatgggctggttttaattttcttaatgaaatgattacaatttccatgaatacacttctgtttaatgtggtagcagttaagtacattcacttgttttttttcaatttatttatttatttatttatgtcatgcaaatgcatcttctgatcttaggacaatttggcatctgtttctccagacatttcctcttcaccatctttacttttatgtgttttgcttcttaggtcctcctgggttgcctggtccttcaggacagagtattgtaatcaaaggagatcctggacctccagggattcctggacaacctggattaaaaggtctaccaggacttccaggccctcaaggcctaccaggtacctttgtaggtcattttttatggcccatctatttgagaacattcccttgattcactttttacatgcaaatagtttgtctctcataagaatcccagcaaggaaaagaagaaggggctaccacagaccccacttctctttttcttaaaaatgttaaaataatttaggcccaactggatttcttttaactcctttgggcaagctaatttaaatggcttggtggtatgaaaatctatttctttccttgtaggtccaattggccctccaggagatccaggacgcaatggactcccaggctttgatggtgcaggagggcgcaaaggagacccagggctgccaggacagccaggtaaaatgactaaaacagtgatgttggtcatggtatttatgcgttcaaggcctttggatatggggctctacttggagctgacaactaattacctatggagagagcatgaatagctgtcaaatccagagctggggaaaaataggaaggtacatccaaagaaatatgctataccacgacaagcataaatattttacattttcttttatataatgcattagaaatccaagacattcttccccatattcaagataatcacttttcaactattttgttttattttattttattttagtaaggttagacctagggttttagtgtgggggacaggcaactattgagatgcttcctctgctccattcaatgaatttcagtctgtatattcaaattcattaactaccttagaacattttttcatctttcttcattttgtgatattatagaagataatttccccaatagaatgtagtacatatagatgaaaagtttaaatgatcaccatagaactttgaagattgtagtaaaatcttatgcagagaaaatatattgatatacagatttttaaagtcagtcattaccgtattctttttataatattaacttttgtttctgctaaatgtatttcgtcctgttggttttttttttaactcagtctgttatgatataaccatagttggcccagtctttacagtgtagcctgcgctggcccccaaatcatgacaatcctcttttttcagcctcctaagtactgagaatcagtttcttagatttctatcacaagacaacgtaatcacaaaatgaatttgcttaaacttatttttaaaaaccactaatatgattgctaaaataaaagccaggcagtaatggcacatacctttagtcccagcacttgagaggcagaggcaggcagatctcttgagttcaaagccatcctagtctacagagtgaatttcaggacaaccagtgttatggaaagaatctctgtcttgaaaaaaaaaacaaaaaataaaagattaaaaacataataaattgttaatatgttagtaactatataatatagttatacaaacataaagaatatgtattagaaaaagaggatctttggtgacaaaacagtatagtgatacatatggaccttcttagagacaacactgccaattcagtaacctcgtgtttccagagaatgaacaaattagtgacatctttatcacaggcattggtatgaagtgttctaaaagcaaaaattaccacatacacaatagttaaagccctgggtacaaggagaaccacgtggcacattaaaataatgccttttggatgctggagagatagttcagtggttaagagcactgattgctcctccagaggtactgagttcaattcccaggaaccacatggtggctcacaaccatctgtaatggaatctgatgtcttcttctggtgtgtctgaagatagctacagtgtactcatagacagacaataaatcttttttaaatgatgcattttgaaggcttttaaagaatatgttatgtattttctaagcaagtatcatttagaacaattctccggatgtattaaagaaaaaccttttcaacactgaagctattgaacaaagcagctggtgacattaggtcataagattcaaattcctttagtatatagcaagaaaatagataacatgctggtttcccacaggcaaatcttcttcttacctaaaattctgttcaaaaattttagtgcttaatgtcttcagcctattccaggaggaaagaaatgcatttaaatctctttgagggcaaagaaaataactcatttgtctctctacccattatatctgacaatgcttttatagacaccacataaatattgaacaagttaaccaatcactattctttattaatagccacaatagtggcccagagcttgcttaatcttgtaagccaatgatttcgtacaaataggtgcccgtggattggatggtcccccaggaccagatggattgcaaggacctccaggaccccctggaaccacctctgttgcccatggattcctcatcacacgtcacagtcaaacaacagaagcaccacaatgcccacggggaacagttcatatctatgaaggcttttctctcctgtatgtacaaggaaataaaagagcccatggtcaagacttgggtaagaaaaatgacatctaacttctttccatgccttttgtatttatttcaaaaatcttcttaggttctagagtaaccttggacaaaataaaaatgtacaactctattctatggggactataaattgaagagcatatcagagccaaataacttcagtcactataaattttaaatgaataattttaacttcaaattaaaaacattaaaagcattgcagctagtacgaggtatcttttttcttggtttaaagcaagatgacttcaaagacatgtttccttttccttagtctattagtaataaagcagttgtccagggcaccctatagtatagcagctgcttgattatgcactgtttgtaatttatggatggcagattcttattatgcatccccacatgtcttctctatatttagtcaatggcatgaggctgcactgatgattatcaagacctctcgatccccatgatttctcttcttttcttttcttttcttttcttttcttttcttttcttttctcttctcttctcttctcttctcttctcttctcttctcttctctcctctcctctcctctcctctcctcccctcccctcccctcccctccccttcccttcccttcccttcccttaccttgccttcccttcttcccttcccttcccttcccttcccttcccttcccttcccttcccttcccttcccttcccttcccttcccttccctttcgtttctttcctatccttccttttccttcccttcccttcccttcccttcccttcccttcccttcccttcccttcccttcccttcccttccctttcgtttctttcctttccttccctttccttcccttcccttcccttcccttcccttccctttccttcttcccttcccttcccttcccttcccttcccttcccttccccttccccttccccttccccttcttccccttccccttcttccccttcttccccttccccttcttccccttcttccccttcttccccttccccttcccccttccccttccccttcccttcccttcccttcccttcccttcccttcccttcccttcccttcccttcccttcccttccctttcttttcttttcttttcttttcttttctttttttccagtttcagcattggttgataagggctaatcattttatctgtggctgtttatattaaaatctaccctccacttcacatccatgaaaacatttaggaagatagtctaggctctcaccttctgggatatctatggttagaagcctcctaacatcttattggctatgaaagtagttctgagcagcagaacttcggaagtgtctgctgcttattctttttgtttgtttgtttgtttgtttttgtttttgttttttcttttttttccattttttattaggtatttagctcatttacatttccaatgctataccaaaagtcccccatacccacccacccccactcccctacccacccacttcccctttttggccctggcattcccctgtactggggcatataaagtttgcgtgtccaatgggcctctctttccagtgatggccgactaggccatcttttgatacatatgcagctcgagtcaagagctccggggtactggttagttcataatgttgttccacctatagggttgcagatccctttagctccttgggtactttctctagctcctccattgggagccctgtgatccatccattagctgactgtgagcatccacttctgtgtttgctaggccccggcatagtctcataagagacagctacatctgggtccttttgataaaaatcttgctagtatatgcaatggtgtcagtgtttggatgctgattatggggtggatccctggatatggcagtctctacatggtccatcctttcatctcagctccaaactttgtctttgtaactccttccatgggtgttttgttcccaattctaaggaggggcatagtgtccacacttcagtcttcattcttcttgagtttcatgtgtttagcaaattttatcttatatcttgggtatcctaggtttggggctaatatccacttatcagtgagtacatattgtgtgagttcctttgtgaatgtgttacctcactcaggatgatgccctccaggtccatccatttggctaggaatttcataaattcattctttttaacagttcgagacagggtttctctgtgtagcacccacatgacagctcacaaccctctataatcccagttccaggggatctagtgccccattctgacctcagtagatactgcatgcacgcagtgcatgcatgcaggcagaatatcattacatgtaaaatagcaaataaaaacaatttaaatatgaaatctaacataacagatactacaaaacattaatttttttatcactgtgacatttttgttttgttttgttttgagacagggtttctctgtgtagccctggttgtcctggaactcactctgtagaccaggctggcctcgaactcagaaatccgcctgcctctcaagtgctgggattaaaggcatgtgctaccacgcctggctcactgtgacatcttaatatataatacagatcgaaaatggaatccattcagtattattttataactttccaaaatgtatgtttttggtcaattagagtttgttctcaaacttggtaactataaactattcctatcttgatactctttaggcctggaacagaaaaagtctataaaaaaatagctgaaaatatccaagagtagtatttattgacaggactttgctgaggcttgagttatgttaatgaataaacaaagaatgtaaacaacgatagctttgatgttaaatattatctgatggaatactttctggtataaattggtagaaggactacattatgtttttctaatttttgtgattatattacaattgcatagttctgccttcccttttccccttctaaatttgtctttgtcacacacacacaaacaagcatacacacacatgtatagtgtgtgaatataattaatataatatatatttataaatgtaacatgttcattccatataatgtaccatatatacatgttttcagggctgacctttcggtattagataaccaattggtgtgatcttccctggaggagacaagctgaattttggaatttctgtctgagagggagaaaagaaatattgaaaaacagtaatatgttaagaccttgttatttgggatatgggaagagcgtgatatcatggtttaatttttttgacactgtaatagtgattccatactcttataggtacccaaaaagcacagacttgtttaaacatcatagtcttatcattatgggactttctcttatgcacattttccattgttttatgagaccaggtgtatttacagctgtgtactaaattggagaacagattggcccttggtcctgacaaggctggatgccccagtgtaggggaatgccaggacagggaagcaggagtgggtgggttggtgagcagggggaaggggcataaaataggggggttttggaggagaaactaggaaaggggataaaatttgaaatgtaaataaagaaaataatctgataaaaatgaaaccaaacaaacaaaaaagttactgtatcatatacataaaactatcaaaccctttgtctaacttgatttcgcaagaacaacaaagatagaggacaatttcccaaaaatttataaacaaagaaactggataataggttaaatcagttaataaaagccacacaagtaatagatagatttaggacttgaacacaaaccatggcaattcttttttcccattactttatttatttactcactttacatcctgattgaagctccccctctcctctcatatagccctttccccatacttccctctacttcacctctgagaagggagaggtccccctgagtaccaacctaccctggaacctcaagtcactgcagaactaggtacatcctcttccaccaaggccagataagacagcccacttaggggagtagaatccacaggcatgcaacagacttaggataatcccctgctccagttgttggtggacctgcatgaagaccaagatgcacatctgctacatatgagcaggggactgtgtttagcccttatgtgttctttggttggtcattaggtctctgggatccctcaagggtccatgttagttgactctctttttcttcttgtggagtccctatcccatttgggttcctcaattcttcccccaactcttccacaagactctgtgctctgtccagtgtttatcgatgggtctctgcatttgtttctgctgggtggagcttctcagagggcaattctgctaggctcctgtctatcagtctaggctgacagatataaacatagctggaactccaaggtagttgaaggaggaaagcagggctataatgtgtccctactgatcctctgaggacagcttggcacatcccttccccccccccaaaaaaaaagatgtcaggattgcattcttttgtctgtcaaacacagggcacctgtgtatccaggccagaagtgacaatatagctgtcaacagtgtcttcacatgttgtatcattatgacaaggctttaaccaacaaagagtcatcacagtctcatagtgtgtccctgtgaactgtagtccctgtgaacccaatatctgtgcagtcacagaagtgtttcctctatgcatagatagacctctatggagatatgtctaactggcacatacatcaaggttgtcttcacagtggtctccaaggaacctctttccataatggcactgtgttccaggatggaatcaatggctactcctgttcctgtgtgcctggataccacagtggcaattctgaatctgtccacttttaagttgctcaatgctgccattccctttcatgtgatcttgaatcaattacttttctttcagccaattttgtatgctgggttacttttttcaactaaatcaatgactttcaagctgataacctttgcaaagatccctaggcctttccagaatctatcacatactaattccaaatgattgagggtaggtggtcagtgctagagattaaaccgggtatctcaagcatgctaggaaaaccttgtacaactaaaccataatacagatctataatttccaaatgtttctgattcttaccagtcctcattttgagaaaaatgtagcccttcagacacagaagaatatactcattttgttgttggtggtggttttttggtttttttgagacagggtttctctgtgtagccctgtatgtcctggaactcactttgtagaccaggctggccttgaactcagaaatctgcttgcctcagcctcccaagtgctgggattaaaggtgtgcgccactactgcccagctaatactcaattttcaaatcctcatttcctgtgtttactttctcctacagttgatctgtatttgaggtggttaccttttctacacactcattgagcatccatcgtcttttattttatggaagaattcatattcaaaagaactgtttaaactcattaagacatagttttggaggatctggagaaatggctcaataattaacaatgtgtactgctctagcacaagatccaaatttggttcctagcatacacaggctgaactcctcacaagtacctgtaattccaacttcagggtatctaacttcctcttctagtgtctgagagtattacactcacatgtacaaacccacatacacacacacacacacacacacacacacacttcattaaaaataaaatctttaaaatgaaaagaaaatatatttgggtggcactagaaatatagctcagtaacagagttcttaagtagcaactcctaggcctggttttaaacactacaaaaaaaatcaaaacaaaattagaaaaaaatatttctaacaaaaaaatgaatgtactcttcgtttagtaatttaaaaggtgtattatatcacttgtgagcgagtaattgtagtaacgacaggtcaaagcaaaaagtttaacatataaaggtatttaaatttttatttcaaaaaagaaaaaaatagcctatttaggctgttttaccactgtgaaaaatgcctgagaaaaacagtttaacaaaatatagggtttattttgtcccatagtgtcatagattacattccatggtcagatggattcattgtttcctggccttgattaggcaaaacatcgtgatagaagggtatgaaagaatggatatattcatttcctggttatcagaaggtagagaattgaaggcctatactggtaggctttcttctttagctttctctttttaatccttcttcatccccaacctgttggatggtatcctccttattcaggatgggctttccttttttttttttaggacattttctttatttacatttcaaatattacccccatttctcgtttcccctacaaaaacctcctaccccataacccctccccctgctcaccaacccactcactcctgcttccctgtcctggcattcccctacactgggacattgagccttcacaggaccaagggcctctcctcccactgatgtccaacaaagccatcctttgctacatatgcaactggagccatgggtccctccatgtgtactctttggttggtggtttagtccttgggagctctggagggtctggttgattgatacttttgttcctccgatggagttgaaaacctcttcagctccttcagtcctttctctagctcctccatggggaaggggaaccttgtgctcagtccaatggttggctgagagcatcaatcactgtatttgtcaggcactggcagagctactcaggagaccgctatatcagggtctgtcagcaagctcttgttggcattcacaatagtgtctggttttggtggttgtgtatgggatggattcccaggtgggacgggctttccttaacacttccgcagacacatctaaagatgtgctttactaacatcgtagtgatgagggatgtctcagtccaccgaggttaggaacctagattaaacaatttaatcttgactttcctttcctttgttcttctgaaagttttttccttcttcttttatatttatttaccttttggtttatctctaaaactctctgtagttggttagcatttttattaatatcctttatacacttaaagagattgctaacccacacaagataacatattgaacatagcttagaaaagggaacatcatggaacaagacatgggtagagctacaaagactttgtgtgtgtcatcctttattactgaaaaaatgtataaattttcatcaaaagacaccattatttataggatccataatcaattaaaaaaacactggggaatatgtaatgatgcataccaacaaaatctgcattcattgtaaaatgtatcttgatttataagtgataaaatgagtgagtcgtagggttttaaaaattgttgtgtttgttttctaaaaattctgcagcagtttcattgtgaactgttttattttatggctgtaggataaactaaacatcataatgcagtccttcatctttttcttttcgattcatcataggtacggctggcagctgccttcgtcgcttcagtaccatgcctttcatgttctgcaacattaacaacgtttgtaactttgcttcaagaaatgactattcttactggctttccaccccagagcccatgccaatgaacatggaacccctgaagggacagagcatccagccattcattagtcggtaaggcactggtttagctttgacatttaccaattaccccttagtttagctagtaagaaatcagtgtaaaatggataatccatgatactcacccaagttaagtatacaagagtgatttttaatattcaacccaacattttagtttgaactatatttcttagagatcagcttttgactaagccctatgcaaaatattttaataaaaagagaactcagtcaagttattatgcaaatatccccatgtatatttcttctggtttttactaatttgggatgcatccagcttagaccaagtgctacaaaagatcaaactggaaaaaaaaatggaaaaagtataaggaaaggatgtttaatcctaagtgaagaaatctggagatatatgtctcaaagaaatgtgttttgaactggtctgtctttggtagattggtaaacaactagacacacatacagttttaaagggaaagtcatactaaggaaagaaaatgagaatgggtagtatatgaatgtatctagaatgtagtatttaaagttttcataggagaaaaggttagaagttagcttgggcacagatagcagaatgatttcactgccaatttaaagcttggaatttatttagtgcattataatgagtagcactacaagccctcaaccaatatttgggataaagttcagggaagattaaggagctatcagtgcacttgaattgtatagtgacagtcgtcaggtcacactgaacactattgctatggtcctgaggtaactggattagatcttgcaatgggaaacatgcatcccattattggagtaagctaaaattgggagttgaagtaatagatgagttttggcatgcttttaactaggccgggtcctagcaaacacataagtagatgctcacagtcagctattggatggagcacagggcccccaatggaggagctagagaaagtatccaaggagctaaagagatctgcaaccctgtaggtgcaacaacattatgaactaaccagtaccccggagctcttgactctagctgcatatgtatcaaaagatggcctagttggccatcactggaaagagaggcccattggacacgcaaactttatatgtcccagtacaggggaatgccagggccaaaaaatgggaatgggtgggtagggaagtggggggggggagggtatgggggacttttgggatagcattctaaatgtaattgaggaaaatacgtaataataaaaatattaaaaaaataaataaataaagtaacaaatagatgttggtaccattaacggagatgtcctggtattttccatattgaatcaatcacttgagcatattagatagtgctattttcattgtgagcctgatgcaaggttctagtaaccacaaggaatgaatcattcattactgatattgactacaaagatgtaacctagtttggcttatttgcaaaatcattgtttcctttgtagcatagctacctaaatctctctctctctctctctctctctctctctctctctctctctctgtgtgtgtgtgtgtgtgtgtgtgtgagagagagagagagagaaagagagagagagagagagagagagagagagagagagagagagacatatagcatgcaagtgtgtgagggagtttttttcagtttcaactttatggagtaagagtttccataatatataatgaattgtgtagacaaattttgctaaattgacctccattatgtttcaagatgtcccctcatgttctttattaaagttttgatatgttcattaacatgtattctgtggctgtttttacttactttgtcatttttaaccacatctccgactgcctgggcacctgcccagctgttttgggtttgttgtacttacccaaatatggccaaatggctaataaatgtctttggcagaacaatagtgggtggatattgagaaaatatctgctttttgtcttttccagtttactagacattcttcttaccacaataatagcattactaagtgtctacctcaagttgggccctttgacagcaagtatgtagaacacactaagccaaactcctacatcaattatcacatttactacagcaagtgtgaatgcaaatttatgtcacaatggaaaataaaaatgcaatagctgtaattctacaatgtactgaaaggcttacagtttttgcttataaatgcattatgcttgagaaaagagagttcttatgcaaaaaaaaaaagattgtcaaagtgcatttttctcctcttctaatcactgaaaacagttgtcaagggcctccataataggaaggtttctgaagaagagcaattgctgttttctacgccctcactctgtaattcatatcctctccccctttcctttaccagatgtgcagtgtgtgaggcgccagctgtggtgatcgctgttcacagccagactattcagattccacactgtcctcaggggtgggactctctgtggattggctattccttcatgatggtatgaaacacccatcttcccttttctcatcacagctgaccttctatataagtacatttctcacaacttgaaccatcactgtcacttgcatagtaataaaaagctggaatcttaaataacctctgtccaagcacagtgctctcccacccgcattttctagagtcagtttttataatatgccctttgcttttgttgactgtttttgatgcagatacagttctcttacctttactcatagtcaaattcattgcattctaatttgtggccaggttaggtatatattattgaataatcactataatagtatatcacatatgtgttgttgaacattttccttatcttttcagcatacaagtgcaggagcagaaggctctggccaagccctagcctctcctggctcctgtttggaagaatttcgttccgctcccttcatcgaatgtcatgggcgagggacatgcaattactatgccaattcgtacagcttttggctggccactgttgatatgtcagacatgttcaagtaagttccttatggctttagttgaaatctaaatgtttcttcatagatactaggaaagagagattctattaatgggttgtttacccctagtaaattttaggaatttgttggagcaagtttttgagtcttacctcgttctccacatgtaactaacttgtaatacaaactttactttgtcttgtaactgtcgttacaggtggcttagtattagcctttcaataccaaaaacagtcaggagttgggatactaaagtgataccatctcaagaagtgaaactataatgtataggaacttataacataatttttgtgaatgtttttgggcacatcacctgagtctttgagggatgaaataacacataactctgaatatttcaatctctttaagtttgtctttatttttatgtattgcttttttcttggtatttttatttaaaatcgtattacgtattgctcataaactggctaaacttctcccatactataatattaagaatggttaaaaaatacaaagaaacaaatacataaaaataacagtagtggggacaatggtcacaaaaaatacatgtgacgatatagagaatgaagtttaaatatattgtggagtattattctgccataaagtattaaattatatatgaaactaatgaacatgatattcaaaataagccatacttagacaaatatccatattttctctcttattcctggactctgggttttacacacacacacatatatgcacacatgtatgcaaatgaagtgaaagcaagattgtctgggaaaagggaaaaggaaagggactatgggaatgatagagagaaagggaagggaatgggggatgaagttatattgtaagttttctttatggaacacatcactacatgcaatgaatgcaaggcaacaaaatttttgttgcatacctgtgatcagtagtagatattaagccatagcaatcaatgtatattaagagattaagggcaaacgtgatattgctcagcaggttaagacacttgcccctaagccccacttagttatgtgccttggacccacacagtacaaggaagagagcaacttctacaacttgttctgacctttacatacatgctgtgacaggtatacttggacatactgacaggcagatagacagacaagcattttaaaatgaaaacatacacttaagtcccttgtaaagctgtttaacaggaggagaatgtctaaatatgaattcatccctataatagaatttaggtagcaaaaatggaaacacaaacctgattgtttcattttttttttatttcctagcaaacctcagtcagaaaccctgaaagcaggagacttgaggacgcgtattagccgatgtcaagtatgcatgaagaggacataacttgttgaagagttccttgtgttttttttaatgtgattatatatatatacatacataaactattatatgtgattcccaggatgcaatgtctcactcactctccccacctttaccactgctcccaccaatggtgctaatatcctctatgacgaagagaacatgctgactagcaaccatgaagattcagatgtacctcagcaatgtgccagagcaagggctccatccttccttatgaaagcaataggaaagtgactatacttctggggctccaataaattccttcaaggattgtaaggcgaagttcatatgctttgcctagttactgaaatggcacatcaaaaattcaatgaagagaagagttatactgagtaaaagtactgagtgcggtttgaggaagtattctttttcatggtgctactaatcctaatgtaccacaggattttaataaaagagtgttcatcttactttgctttgtaagtaaaagaaatgtgtatatgctgtaaacaacctcttagttcaaaatgttgagtcatttagatgtgatctggcataaaccctactttactgaaaaatctatgaaatcttactctatagacagcaagatatacatgtgagaaaatgtatcctttcatcgagttattactgaaagcaaattaattgggagtttttaaaaaaaaatttaagtaactttgaccagaattttagtggttcatataaaacttatcaaattatcatatccaatgaagcaatctcttattttatgtcttgttttacttaatcctgacagttttgagaaaaaaaataccaaattaattaataattcttattattctggtgctatgcaagaattattctcctgtgggctcatttgtgtaagaagacagtatttgcttagtcttctcccttcaattagaaaaagccaatggacttttaaaacctttatattttaaacatttttattaagaatagtcataggataccttattttcttaactgtcatcttctcactgaattttttttaatttaccagtatcaacttaattaaagatatatgttataattatggttcattgtctctttctttagcataagaataaaaccatgttcattt

SEQ ID NO: 687 - DNA, 115674 bp, mus musculus
agcccccggcgcgcccccggcggccggggccgcagcgtgctcgcccccgccgccagctcgcctcacttatgggtcggaagcgctgcgtgggggagactgttccaagatggcggcgggttgctgtggggtgaagaagcagaaactgtccagttcgcccccctccggctcgggtggtggtggtggcgcctcctcctcctctcactgcagcggggagagccagtgccgagccggggagctgggactaggaggcgccgggacgcggctcaacggactgggcgggctgagcggcggcggcggcagcggcggcggcggtggctgtcccctctctccccctcagggctgcggcggcggcggcggcggcggcggcggcggcggcagcggcagcggcggcgggggcatctcgctgtctccacctctgagctgcggagtgggaaccctactttctactccggccgccgccaccgcctcctcgccgtcctcctcgtcctcatcccccggctcccggaagatggtggtgtcagcggagatgtgctgcttctgcttcgatgtgctctactgtcacctgtacggataccagcagccccggaccccccgcttcaccaacgagccctagtgagtaccgcgctccccgtcgccctcttcccccgggctcgggatggggctcagagttgaggcaaagtgtaagtcctccgcctcctgttcgcgggtgcccctctgtccctcctgcctctagggtccccagagtcgcccgacccgtggggggccctcggcgctcctctgctccacgaggagagcaccctaccctcggagcagggggctgctttgccagccatggcccccctggcttccagactgctcccgcttcctctttgcgctaacttccaggagttttgccccttcccttcgatcctttctacccctcaccctccaccccaccagcgtctggggcgatctggatcactgtcggtaccgacctctcctcactttactcgccattgccccacgtgaaagccccgccagtattcccgccccgcgtaccttgcacatggagagctactatcccattgcagggtgaaaaatagcagtgatctaacttctattctgctagtgatggaacttagctctcgatctccagggaggttgcccatcttttcctccgggtttccctgttcctcggggaggggagaggtttcttaaaacaccttttgccttactacctatttttatctgaacgtacccattaaaatgcatttctagtgaagctagcgcaccacctcacagttgagagtgagaccttttttttttttccctcttccttcttcattccagtgtcttggtatagcacattcaaagaatgttgtccccaaagaggcactgtcaatatgtaccaagcgtgcgttcgcttttgtgtagatttcacatttaagcaacctatgttaaactcaatgattcgaggaatagttaacccagtacatgtgtaggcatttttacgatttcctttggcttttgtaactttacattattttatccttcaagtatatggttgaaattgtttaaaatagcactgttacaggctaaaagccaggttacttctaatctctgtccatttggatgtgtgggagatggggcatatggtttttcttttaaaatgtgtaaactgagtgtaaactgactttctgagttaaatgctagacagaatgtaaagtacaaaggaaggcagaatgggaaaagggacgattgtttttattatgactactggcatccacaagaaaaatacagaaaaaaaaaattaagcacactcatactgaaaaccatcaaccccatcccttctgcccaagagctccttgtttcccacagcgtaaagacatgaattgatgttcattttaacttgctgcctctcattttgtgagattagaagaacgaactactactgctggataattatagtagtctgacgctactaaaatattaaattaatatgtaaagtggaaattgcaataaagtgtcctggaaattgtgcgtttgtattgtttgttttctttgctttcattctttaaaatgcctttaattttgtcggactccgctgtgctccggacatttctttaggtttcatgaggaatggacgagaaggtgcccaggtggacactgtggagtgaatgaggggcgtttggaaagttcctaatgtgaattctaggagcttaaatcctaaatctccacctttaattggcctatttatttttcattaagaggtaaaattcatgttaaaaggaaatctgtgagatacttaggtcaagtcacttattagtggccttctcttgggtggctggggtgacttttaggctggctctggaaagtcatgggattgtcaaaatgtactcctgttcagttcttgagctgttacatagttctgcagaggctttttagcattcatgccccattgctctaaagcatatgagaacacactttcaggaggtgcaattttctcactttttagagtgagtgtgggttaactgaataactatcacagtatttaagaggaaaatgagcttgaccaattcataaggggaatgttttaaaaacttattattactattattattattattattattattattattagcagtggccacgttccacatggacttaggtgtttcccttttaatacccgagttgctgaatttttgcctctcaggtccttaagcaactaagacatgcatctgaccactgtgaatacattgagatggtggtggaagaattgtggctatgaggggttaggaggctttcagtgtgtcccatttctacagactagctagtttatagaaggcactgaacctcagcaaccagagaatgaagaatgtctctcctttccatttaaactgatttttcaagtgtacgatgtcaaattcaagaacatcttcctgatggtgggagtgcaataactggatatttcacagtgccttggaaaagcaccacacgtttctccattttatgagtttgatattgtgtgcttattcttgtggcactgtataggcttaaattgtttttctttttactccactgacttatgggaataatgtcatgggcaatatgtttaaagtctttttttttccttgtctagcagaagatgtgcttctgacaatatcaaattatcatatgtaaaagcatagagtagtattgtcatctcctccctaggaccttactgtcagaatgcttgtaactggtgggatctgacatttatagatttagaagtcaccgctacatctgttaaccctgccacagtaaaaggtcattagagaatttaattatttatatgtttttcagggttggggaagaggtcgtttgtgaaaggtcacgtagatgcaactactccatgcttgcccccgtcttttgagtacccagccattgcagagagcactgttggttttttcctccagaaataaggttcaagatgcaaggaaactacaatgttaggtacatcttcgtatttaacagtcaacgcacttctgtgtgaggaagctggtaaaagctactttagaagaacctgttggctactctaaaggttcccctgtggcaggtgtggagccagttagattccagaacattccttctcaatcatggctacacattggaatcattgggaagttattcaaaacgtggatacctgtactctcaccaaagattctgatttagtccctcatggatgggacctggggatcagaattatttaacgccccccccaggtaattttagtgtgtagcatggagaactgctgactgttttctaggtttttaatttgagatttggattaatttgatcggggtagtgccacagactccatattttatgagcatcttgggtaattttggcagacaatcaggttgggaaatacttgcagtgtggtccataaaagacatcacctgggaacttattagaaatgtaggttcccaagccccacctcaacaccccctgaattagaatctgcattttaacaagctccctaggtgattctcatccacattaaagtttatggtggacttgttctctgactttagcatacattgtagttttctgttgtgcttgttaaaattgcaagttgctgggcactttcccagagtttgatccagttgctctggggtgaagctgtacatttgcatttctaacaagctccctggtgatgctgatgctacagttcccagggtcacaccctgagtaactggttagggagaaatgagggcctgcatgggtgcgtgagtgactgactgtggcaggttggactggcatgggtctctctctgttttcctgtcctttatcactctcaaacatcactacgggaattgagtgctaccaagagcagaaatcagattctggggatggtgtggggcaggggttactctaggaaacttgttatgtgattttaggtttttcaaggaaagtgaccatgtgaagggcatatttcaggagttaaaaatcagcataaatagactatcttagcatgagttactgttaagtaaagacccctcttgtctccacgaaagtacttttttataggtgataagattttttcaaagcccttatgtatacttctgtttgctggaacttatttaaagaatttccctcattagtaaagaaatatgaaaagggtcccagttaaagcactgagattatatagtcttaggtttttaatgctgtggtataggttatatctcatgaaccttttaaattattgtaccatctgggaaattaatgtaacactagatttttttgtggacatttacacatggatgttttgcttttaaatatcagtaagtgtgattttctgttgcaaggaacataacctttttttaaaaacccactcttggacatgctgatctcgcaacgctcaagtcagaggatgcagcattaactcttgccttactatgagaataaaatgactgtttcaacaggcttgggaggtggagggttgccttgagatgtaagcattgtgctccaccggagtagtagcaaccctgcttattgaggatcatcaagatcaaaaagatgatttgataatgcagttcaggtcaagtgatagtaaattggcattgtaaacatacacaattacatttctattgtcttttttggaagaagagggactaaaataagtagaaagtgtgtctctactgcagatgatacaactggaccatgacagattttcttatccatactagcataatgggactaacttcctttctctgaccatatggtatagttttttttttttaattataaaagaaaaacattttttctgacacttactgagacttttgaaggtataatatggtttttttgcaccaatgttgatttacattggagaacttagtgtctcttcttactgatagagaagacagacatgttctgttattacttgtgccacaaaaccatcagtgactgacacagacgtgtaaaaacatgaattacaaaattatttttaatctgtacatccaggtgtatatacagttgagtgtatttaatgtaaaaagtagagctctttattttccagtcttccccatatggctgaaaggactgataatctaacccataaattttccttgcttataaattgtgcttgagttcagattccagttaaagtagcaggctaggaggagcctctgctggcttctctcagttctatgggaagaaagatcataaacaaaaatgtaaaagttactttgctaacacatgtatgagctgcttttctaagtatgtttttctcttttaaaaactacactttctgaaactgaagctgtgtcatagacacacaaaacctttttggctacaatggattgtatttttaagtcagttgtgtttcccctttctatggataaattcgctttttgacaacgcatatgtatggaacactaaacttgtgtaatgagattagtcagagtgcccaggtttcctggatttcaataggcattattctgtgctttccatgtcacacatgcttgcctgttttagagcagcacaatgcccagagcttttacatttacattttgtaagtagtctctttttcaaacttgtgtaataatgtctttttatactgttctgaatcaattaagctaagtgaggactagcagtaaaaacaagtggctgccaagaatggaccttcaatgtgtaagctgtccttccacattcagtaattgggcggttgctcacaagacactggagactgtgggaaggcagtggttgtgtaggtgggaagactagattcccaacagtaaacttatttagagttgagcttctgtagttattgttgctaagagcaaaacgaatcacaagcttatatagtataaagaaaaaaaaatccaaagcaagatgtatggtgtaatagtatattgttggttgggtggaggaaaattatgtttggtccaactataagtggcatttttgtatcaagtgtgggtgtattttctacatttcttaatatatcacactttaaaacttgcccaaccttaaaaatatgttagtgttgaatatctgactggaaattatgtgtcaccacaatctctctctctctctctctctctctctctctctctctctccctctctctctctctctctgtgtgtgtgtgtgtgtctgtgtgtctgtgtgtgtgttaagcgtatggagaaaaatggtcctatccccttaaagtttcctatcttcttcaagcaatgatagaaataaggaagttgcttataattatttcaacacaatgcaggcctgctcagttaataagatacaggtaaaataaaaaggcacggcataaaagagggaccaggaaaagatatgtgggaggggatgacttaagtcttttttttttttaatgggaaaagcacaggggttgaagagctttcgtggccaacagagattgaactctaggttgttctcaaaccggttgctgttactgccacaccctttccacagtgcacagggattcccagcagctgtcttcagtcaccagcttgctctctcagcattcttcacaccattctgctttgctgtggtctctttaattcataaaaacttcaaagaaattctactttgtgctgggagttcccaggggagtctggatgagaggttttgaattagatgatcatttcttgaattagagatcaggaacataagagaggcttctgcagtgtaagaggaattggaagatgagtcttcagataggagagagtggctaagatggcgtggtagtcggagagtggtgttggaaagtgggcaagttgacactgagtggagattgtgactgtgagagtgttgcgaaatgaagagctggaagaagggatcagcgttttcaggcatttcttcctggagggccaggttttgtgtaggagtgagaagattgcagctcacctgctttctggcttccatcattgcctagctattctgatgcgcagaaaagatagttaagccacggtagtagaatggctgtgtaatctgctcatgagtacatctttcttaggagaaagaagactgctttatagaattaggatcaagtgtaaagatgagatagtttttggaaggggttcttaagtgaggtggctgcatatgagtaaacaaagcaaaactgagggacagcgcactcttcaacattccagttgctgggataggggaattcaaagaagagaggatttgaacatgagtcagagcttataagactgaagcccatggcaggatgcaccagagaaaacaggaagaaacaaatggtccaacaggtgacatcatgtttcttggtatgtatcgttcgatatgttggcagttactaaatggcattttttaaggattttttaaattaatttatttttttacactcccacccactcccatccacccacccggcatttaattttattttattttattttattttattttattttattttatttattttttttggtggcgttgcttctccttctacctttacaagggctcaggggattgaactctgctcaccagactttcattttcatggcaaacacctttacccttgagccatttctctttaaattatcagaagcacagagcagccacagcttttgtgatgttttggttagtctctggggatcacttctgcttcttgagctacacagtgaccgtgaactgctcagatgggcagagatcaatgagagttttcagctttgtactgctagtaaaaactaactggcagaaagttgcatttccctactgtatgtgtttttacagtcaatcttcaagcttgccaatttgtgaagcggtcagtgatttcttagctttccttagttctgtatcataatacagccttcagcaaacttgtctcatggaggattaccaaaggaagttaattgtttcagaacctcaattaaaggggaataaaaatgagggactaggagtgttggtactagatgctaggttgtgtgtcctcaagcttagaagggaaaatagattgaaacaaggacactcttttgcagctttgctcaacaggggaggaagggtgttatcaattgacaggattagccatattgctttatgatctttgctatgggacgttgtaaatgtcctgctccaggccaggcctactaattagttaaagaataaggcctgtgatagtcttggtgattcttgccttccccttgtccatttcatttttcagataatctacagtgtgacccaaagccacatgcaatgctggcaaagcaaacttgactctgttaggcaatatcccgccagaagatgctgacaagctctctagtaatggaaactggcgacactgacttcaacgtctctagtttgccttgccattccatatattttaatgaggtctgtaggcatatgctgtacaattctagaaccatatttgccctccatcggggtttggatattgcgaggttagctaacaacagaaactgttttcctttaggtgttagtggatctttgtgtcattcttccagaatggaagctgagacaaaaacaaacctttggtagtgttggcttaaggtttccacaggattgtgtttgcctcatatgttcatgtgattgtcacattagtgtgtttcttctctgtaacatcatttttgcttatagtagcctaataactacacagttaattatagatgctttggatacaaattaagtttcgtaaatgttggtaaagctggacctcgatgcatagatccatatagtaaggccaccatttgtgtgctgaatttgcagttaggaggtaagtatttatatatgatgggtgctcatacatcatttttcatgttgataagtagagaatggtatagatttattcgctaaagatgaatcttgtgacgccatttgacctttttctttgttacagtagtgctttcaacacattttaagagttcccacattacaaaaacaaaaaacaaaacaatgtttgttgaagttagttagcagtagggtctggggcagtcagtagttaaccatctacttctgcagccctgcatgcctcagttcaaaacccctctcaggaacaaatgggagcgagagctgacattaaggaggcaatgtgtgctttgtggtctattttactccacaaactcccccagcttgcttgctttctcatctgtagaaagtcacctagagctagaggcaggaatagagggctcatgagaatcaaggagtggaaaaatgacttgggagtgacatgaccaggatttaggaccgaactcttttgactcagctctgagtctgagcacatggtccagagagatgagctccaggaagcatggtttatagcgtatgcactgagatagttctccttcagcaccagtgggcacggcactcctgttcaaaaataattattttaatcagaaacagatataagagtgccaactgtagggcctctgagtaatttcagcagactgcattgaaaaccattaacacatggtttcatcagaatgaggccttggcaaatatttgaaagctgtaagacaaataactttaccgtagttataaatgcctctgattattacccttatttttcttatactgctgtgaatatagttagagattcttggatattcagctataccttatttttctgcctttctccctccccctctctctttctctctcccccccacagccttatctaaatgtgtgtgatgtttgcttttttgtgatgtttcttttatttagttttctcccgcttgctatttataacagattatgggacatgtaatattagaggacagacacaactataatttttatccctccctccttttcatagtacttagtattgaatgcagagcatccttacccctgtactataatttctgtttgcacagttgcataacatagctgtatgaagactcatccttctatcttatacaccttttgtctcccgtgacccttaacaacctaatttgtacataatattcccacagtttcagccatatacatgcttctgatttttctgtattttacatatatgagactctgcctactgtggcaaggagttacctgtttctggtttttaaaaattattcattttaaacttgtatatatgtacatgtctttctgtctctgtctgtctgtctgtctctctctctctttatgtgtatatatgtatgagtatcccagtgctgttagtagacttttcttggttctccaccttattcattgaggcaaaaactctccactgaacctgtagttccctaattatggctagtttagctggccagcttgctccaaggatcctctacctctgccttccaaagagctggaaattacaggtggcccaccacagacatctacatggtttgggggagggtgtccaagcaccagtccctatacttgctgggctgtccatctggactagtttttgttttcttttggacccagagtcttactctagcctaagctgacctggagttcactctgtaggcaggctcagcttcagattgatggtggtcctcctaccttaggctctcaagataaaatgatggacatgaactgccatgcttggctactttaattttttattgtagtaaaatcctaacaagatctttcctcttagcaaatattaaagagtacttattttctaattatacaggatagtggctccacctaaagcaactcatctttttcataggaattttggtaatactttaaaaattaaacttaccaacatatagcagagagtgcagagcagtttacaatatagctcaatttagggcttgatatatttttctaaacttgctgataattatgactaaaccaggttacaaataatcataactgtaaatctatgtttgaaatattttaaattgctagaatttccaaattggcttcatagttatcatttattgctttgcttgattctgaatgcttgtatttgagaagaagtcaactttctagatttctttttagcttatttttctcctctctgtccgttagggttttatgatgaatctgctaataataattcacagaaatgcctttgacaggtagaagcttcgcctttgttcacccactttcaaaggtacaaggactaaggcattaaaggagaaaattatttttgacagtttctcagaaatctgtctgggaaaatgtgctttctagagagatggaaaattggaagataaattgcataatgggaattataagtagggcctttaagtccatatgtgtattgtaagccactttaagttaaggtacttcatgagattgctttttatactgtacacacttgtttgtaatgaaaaaatgtcacttaaaggtggaagcagcacctgtgaaataatagctacagtcaagccatagatcttgaaaatttgatttttccccctgttgttgctacccagccagtgtgagattctttaccattagtggggggtatgcagagatttaaaaatacttctattgaattagaaagcatcagtttgaatttggaagcatttcccccttccatttaatgatagtttttcagttctaaataagaaaataaaatttccatcatgaatatcattttaaaatagacctttaaaattgactattcttcaaaccttaagatgtattgaccagtgttagattacggtagtatatgctttatgttacactgagttgtaatactacattcagctcaaacagtatggttgttgtgggcagaaaactgtgctagtgtggtttccgagtggatgtgagaggtctataaaaaggcattcttgtccttaaaaaacttgtagtcatattgaggagttgaggttcataaaatgcataatcaagttgcatatcctttagtggctgaatagatggtaaaagacaatcagtttcataggaatttgcaccgatcgatgtgggctaggattatatagaagggctttacagacaaagtggaatccaatctgggtagaatttcatagacaggaaaaacagtctaggtggggaaacaaacaaacaggtcagaatgagcattagacagtggtcattggataccaatcaaaggtagattgaacttatggagaacctagcaagaaacggacctgttagctgatagttgaaattcaggcactgggaaatgatgctctaccaattgacaacttaaagctagtaatggtcctgtgaattccctctttcttgctaaagcttccctttgttcagttcattatgcttcagcagctcttttaatgcatgaatgtcatgaagcctggacaagagacaacacaagcaggagtctgctgcgtagacaaagtgacaaagtgctttcattcatcaatacatattcagcataagtcacttagaacatcgttatgtcatactcagtgctttctgtgtcttgtatctttttcttttagacacccatgtcttaaatgtaaagttgaaaaaaactgacttgctgtaaagattatgtaatttaaaaaacaaaccaccctagttattatagaactaaacagttcaaaccacttttttctcccacaattaatagtttgctttgatattcagcttatttaatataatgaaggtactgagaattatatcaattattggaggattgtatactaattattgaaaatatttttaaaattggtttaaacatctattagtctaatgaatgttctcattgtagttcttaacataccctgtttaagatgtttcaattttgagacaaaccatataagcaaactttattaaagctctatactactattttgtaacaaaattttagaatcatttcctaaattaccagagaacagcactttatttcctagtgaatactgcttactcttagaaaaaaagcaaatctttccatctattacctgatggtttatctttagttatattaagacataaatttaagacacaaattgaccactgttaaagaagagctttcttccctttgaggtgttttgagatagactcatgttttagactgtcttctcgctagagtggaggataactttcagttgctgatttttctgcctatacttcctaattattggttttcaggcatatgtcacgatgaccagtttcatgtggcactggagatcaaatctaggacttggtgcattctaggcaaacactctataaactgaactacatccccagcccaggagagtgggaggtaatattatatattgtccatgtttacaagctaactttattttcccaggtttcaatgaatgtgcatttttatttgtcagtggcctctataaggtagagataatagttaagaaagagtcattttggctatcgcagtaaaacaagtaaattctatattaaagtggaaatctgggcttgggtcccatgggtctccattccagtgctgactaggcagctcctaaaaccttgactcatgtttattgcaattcagtatagcatgtcagtttttgcttgatcttcatgtttcttttcacaaccatgaagagttgtggccatttgctaggttaaataatgtttcatcaacccaggatggcctctactgttttcatatatcagaattgctatgttaattttaatactttcctctcctagtctgtctccccttaaatttaatatataaatttagggagaaccttttactcttccactgcataattcctttttgttgtttcaccaatttcaagaatgagtgtccaatttcttgaatgtctaaaggcctgggagcactggaattttacagtttctatggctttaattctagcagtgcatatcctcttatatcatatggaatcttatttcctggtcttaactgtttcttccatttgcgggacctagtggagtaatgagtggaagggactctaaactttttttttttttgtttttgttttgttttgtttttttgagacagggtttctctgtatagccctggctgtcctggaactcactctgtagaccaggctgacctcaaactcagaaattcacctgcctctgtctcccaagtgctgggattaaaggtgtgcgccaccactgcccggctgggattataaacttatcactgtcaaattgtttcagacaatggatttgaatatatacagaagtgtagatacaccatttaatgggatcaattttgaatttgtgataatataattctaaaaagtttacagaatctttttcttgacagtatttaaagcaaagaatgagtgaaatgtccagtaatgcataaactttaactgtgtttaccaaactgctgaaatctactcttagatgctaagtttacctgaatatagacatattagaaaacaatgaagaatttttctaaacataagtacctatactctatttttggattctagattacaattttctctggagtataaaaaccttaagacacaatcattattaacccgaatatattgatacatatactagatacctagtagaaaataacacatgctagaaacataaatggagatacagctttctagacttaaaatttagaacacaaatttgatgttaaaataaataggtgtaaaatagattataaattcacaaaaataaagcatgagaagacaaagaaaattaaaattaccatttacaaagagctactgttattgttaggacatggcaagtttctcaaaggcaatttatccctcatcttggtgatatggagatgtggtgggacatttagggcatagacccttagagaaggaagttaggtcatttgggacttgcccttaaaaagagatattgggtccatgttccctttatttcttttctctgcttctggttgacatggggttcactcaacttttgtttatcatcacagtacagtgctgccccaggcctaaagcaacagaaagaaatgactgttgactaaagtctttaaaactgtgagccaaagtaaacctttcctctggttaagttggttatctcagctatttgtcacctaacagaagattaacccaccgctactcacagcacctctcatcaaatctgaccatttatacttttgcatcctttgtctacatcatgatacttaaatttaatagttttaaaagatttatggtatgttggcccagtgactggaccagtattactcctttgtaagaaaaaaaaaggcactgtggtagaaagctgatttctaccatatacccactttatccttatattgccacattggggatagcctacattttgtgggaaaagccaattccttttagcctgaatagacatatgtcctaattagatacacagccactaagtaaatgaaatatggtcaatatctcttaacaatcaaggaaatgcaaatcataactattcatccctactaagatggcaattataagaaagagaaaacattagcagggatagagagcaaaggaaagcttacatacttttggagttaatgtcagtcaattcttacaatcaggaaaagtagtatatagacattcttaaatatagagaacttccatatgatccagttacagcacttccaaagaacaaaaggagtaggttgaagataaatctgtatgttcatgttgttacattagcgacactaatgaccaaagtgtgtactgataaaatagataaggaaattgatacacacatagtcacaaacatactttggaatgctgtctagccataaaagaaggaaatcctgccattttaaaagcataaacaaacctggaaaagataatgctatgtgaaataaactagacacaaaaaatataccacattgcatcctttttctgttgattcaaattcatagtaaaatatatggatgtagagtagactagcagggtctgaggtcaggatgaaaggaatcttaattgaagtatataaacttagttataagctgaatcaagttttagggatcagatgtacagcatggatggtgatggatatgttcatttgattgtcattatagtataaatgtatacacaagtaatcactatataccatgaatgcataccatatatttttggcaggatctttctctgtagccttggctgtcttggaatttgctatgtagagcagtctggccttgaactcagaaatccacctgcctctgcctcctgagtagtgggattaaagacatgtactgctacatcagacttataccatatttttaattgaatgtctggagaacatctttgtttctgtagaaatttctctctctctctctctctttctctctttctttctctctctctctctctctctctctctctctctctctctctctctctctgtgtgtgtgtgtgtgtgtgtgtagagggggtgtgcacatgtatctatgtggctgtggattacagtgaacagtcttgggtcttgggtgtcatttctctgttgcatttcacctcttgttttgggaaaaggtctattgacttgaacttctgccagctctgccaagctcactgggccagcaagcttccaaggatcttgtttctgctttccatcttcccatcgctgggtttacaggcatgtaccactatctttggttttcttcttttaaagacatgggttctggggaccagtactttacctcctaaaacccacctagccttgtttacataaaaagtcctgatgtctttgttctcattttaatgtacaaaaagtgatttgactaagcctttctccaagggattataaggtgtctttgaaagcaaaaatattatttttgtatgtaatctccctcaaaaatgtttaacaaccgacctgtttattttgtgggtctgagttgaaactgtattcaatgcattagtctttaacctgtacaaaattaatcttttggctgagaagaaacaacactaatttacaactcttaaaccactctatgttaatctccagcactaggtatttgggaaaaacatcttcagaaagaaaatttcatcacatcttaaattattatataatttatgatgcaaagaaaatattcaggcctggtcacatgatacaacagactcacaaagcaacttattctcacatattagccttaaaacatatcagatttatattcttaaaattactctccctgttaagtgaaaaattatttaatgaaagaccttaatggctatccataaaagtttttactcataaatttttgcaattgcatattttagtcccacagattttcaactcttagcagtggaaatatatattgtccattgtatatgcatgctgtttcttttttaataaaatccgtatttacaaaatggaattcagcaaccaggcactgcaaatgtgacaacatcatgaacaacgggactgctattgctggttttatgagtgatttcttatattcagtaactgttcttttaaattggcttcccagaaaagggcttggattttgcaatcatttacaaattgccactgattttcaacgttttattcctgcagcagaaatctgtacactgccacatgagtccccaaactagtctcacgtataattctaggtactattttaatagggacaaaagaatgttacatatttgtctgtttttcttcttgccccatcatttcttcctttcccctcctgcctctgactgtgccctcctctctcaccttctccagatctccttctctatacatatgaatgtgcacacaattgcatacagacattattgtatttatgctgttattaattataccctgaaagctcgctaagtggagagtcacttttatattttatatctcctctcctaatctagtatcaggataatgttactgttgtcaaactttcatagcatactatgttttggcaacatcatgatgagtagttgtagtggataaaagagtatcttctgtattgaaatgaatttttaaagatttttgattgtttatgaaagtcaagacttagagctcataattactgtgttcttcatttcatcaaagaaatgcactgattcctcttttttgaaaccttttatctgttgagttacagtgttagacattgaacagtattgtataattagtctgactggctagcaacatttatttttttctcatcttcttttatataaaattggcacatgtgaatctttaaaacctaagcagaatattgataataacaaatacatttttactgtatctttcagtggaaatcacaattatttgtttgtagtcaccaaagttaaaaaaggaacaggtttcaaggccgatcatatcttttcctctgctgattttatagactttcatagagtaccttaaaatagcagtctaggtggtgatatcaccagagatcctacatatttttctgtggatttttaagagctgaagttaatttttaaaaagactccattaccagtatgattttcatgctcaaggaggggattacaggaataaagacattaaaatttttacccttctataaaattaatgtgactattgacaacagttgtcaaaatagctttttgggccatcaggaagatgacttataaggtgcatgatgcaaagtctgatgccctgagtttgattcttgggacttatgtggtagaagggaagtgccaaattccacaaactgtcctctggcctccactcatactccatggcacatatgcatgagtgtgtgtgcacacacatacacaaacacacacagtataagtaaaatattttgtggttctaaaaaaccacgaaagaaatgaaatttgaacatgaaattctatatcgaagaatatcttttataaaaataagagactaaggacatttttagctaactaaaaattaagaatttgttgcagtctgtcctttaagaaatttttaaagttgggaggaattcttcagactgaaatgaaaggaaactccatgtattgtattcctcagtttacagtagttcaacttaagttttgccttttgtttttgtttttatcaaagtgatatttactcactagattccaaaatttgagttctgaatttgtaacatttaccaggctaaggatatgagatattatgctgtctcaagataccaaatggtaatagtcccagctcccactgagccatgtggtcctgatggtaaacaactgagactctacaatgttctctgttgctaagatgtgatgtttgcggaggctaattttgttaaatatatttttgacttatgatattttttaatttatgatgagtttattggaatgtaacccccacataagtatctatagatataaacttaaatgcacacaaagaaagagcagtagtaaaattaactctaaatgtaaaactaagagagaaaagtattttgattacaactgctttctctgatttaaaagacagcagctgcataaaacaatgatcataaaacccttaatgggtttgtcatctacaaatatgttatttgaactcaggcatggtggtatacacctgtgatcccaccgtttaggaggcttaggcaagagaattatattttccagaacactctgggttacatagtgagttctaagccatcctgggctacatagagactctgtcttggtggtggtggtggggacctgaatggcaggatggcacgaataaaggaggttttaacgaacagatatagatgaagagtttttgtgcattgctgctgttgtttgtattctaaagtagatgaatttaagacagtactattcccaaggtaacccttagttatatgacttaaaagttggtatttaggattagaatctcaatgctttggcatatactcagattctcaattttgagagtaaaaataaatgatatttccaaaaataagctttatttgacagtttctttcatttagtataactaggtacaaatattttgcctaggtaggatattttaatttttttctggatgaaccttaataaaatacttaaaaattcacaacaaacaaaatctgagaacattacagtgaactatgagttcttgtaatttgaagttgataaagctctattgaagagaatttaatttttgcttgcttagaacgtacacaaacttacataatgtgattaatggcataatataataaagaaattctcgatcataagtaatattgtagtttatataacaatcttgttgatttgttcctatgggaagacagtacaatctcctttggtttgttgggttttttttgtttgttttgtttacttacggggaaaatgtgccagacaaaatgagtaaaagctgaataattttgattgttatcttgaattggtcataagtagcaccacacaaggggccttcaggatccaggacgggagcagacaaagcaagatgtcttgctggtaggatgctattgaacttgagctctcagaagggactactagcttccatctgcctccagggatcctagtctccttatttagcatttgtttaccaagtttaaagagagtagtttagcaattttgtcttaatgtttcagctgagaagcaagctctgcctagtgaatggcaagagaaaggaaacagttttctttaatgcacaaaatgccactctcccacccacgaagtcaaaataatatcctcaagggataaagccttgttagttaggaatgcctaatttctttctataatatatgtatacagtctttttcattgccttcataatagtaacagtgttctattttaagccaattagtttaagatctgtttttatagttacttaatttttaaaatttgaagtgttaattaaatgaactggtctccaagatgagtgaccagtataatatttgctgtgaggaatgctgtgacagttgtaaaggattccctgcccttaagaaggttactttctagaacaagaactaatttataagctcataaacctactaagtgccttagagacatctaaataaagcttagagaattttggctaaggtgacacatggtcacagacatagaatattaacataacaaatgtataagaaactcatttccacaagaaagtctaccttcactatataagcttacatccttttcagtattgatagttaaggttagacagttgttgattagagaatgacttatgcttgtgagagcttaagtttttaacagtgtcatctcaggcacagaaccattggtaaggaatttttctgggcctagggttctaagagtaggtcagttggaaaggtcaggctaataggttgaaggtttgtgtctgttactgtgacagtcattgtggcaggaatagctcatacaatggcacgttacacttgaatagctcatagtgtagctcagaatgttggatcagtggaaaaacctatccctaaatcctatcccatgatctccagatgttctcagttgggtgaaaggcaatatgccagatggagggacaccttaaaagtttgtaacaggaaataatgggcccatggaaagggcaaatagtatatgctcatgttataaacatagtacattccaatattatatgaaggaaatgcagtgtaacagtaccccatctctcatatatctagttcgcttctccagaggtaactagcacggctgccaattgttcgtgttttacagagactttctgtgtgtagacaggtatttatagtacatacttttttgcttttgttttgttttacacaaaagtagcatattatatgtgtaatttttctacacattctcttcagcagttaaggatttatttgagggttactttattttgggagcagttttatttcacagcaaaaagagagagcaggagacatatagagagacaccacataatcctattcactgtttcagtgtatatagtccattatcaagagcacatttttaaaaactgaagactatacattggtaaatcatcttttcaaattcacttaccaaggggtgatatagattttacagaactgaacatatataaacatcttccatcataggctcccgtagaataattttcccgcagcaagtttactatcttaaaacttctctgctttaccgatccctccacctctggaaaccattgattttttttttttttaatgtttcaggattatgttctttccccagaatgacacatagttggaatcatacactacatagcctttcagattggctcctttcacttagtaatttgtattttatttaagtctcatcatgtctttctgtggcttgatagcttgttttttattaagcgctgaatgttagtttattatctgaagtaacatactgtttttatccatttgtctattgaaagacatcttagctgtttccaggttttggcaattaggcataaaaccacttttagacatcagtgtgtgggtttttatgtagacataaaatttcaagtcattcttataaataccaagaagagtaattattgggtcccacaatacgaataacagccaaactcttccaaagttgactggagcattctccttcctcccttcctctcacctcagccagtaatgagtatgtcctgggacatacttccaccgtctgcatatttactaatatccagtttgtctctgtctacttttacttttgattttggaataattatagactcacaagatactgtcaaaaatatagatagatcctatgcactcatcacagcttcacttctggtgccaatcttacataaatataatgcattatcaataccaagatgttaattttttggaatctaatttatctattgtactgtgtcttttatcttaatgctttcaaagtatctttctatatgatatagcatagctaatttaaccaactctatattgaagggcatttagattgtggtgttgctggcacaagaaagggcaagaaacaggatacatcatgtatatactgttagaatgttatctgtgtcaattaggaaaaaaatgccctcttaatatatgtagccctataagcacatatattggaagacagaatgttatgttacaagaccaatagtgtttagcaactctacatgcatacatctgtggatctatgtaggaacctatgtctgatagtggaatgttctttgaaattctttagcatattagtgttctagtttgaatgaagctgtccatttcagactgagcacaactgttttcctcactgctacttcaggtgttgggtgttttctgttatgtatatatgtattgattacaatggattgtgggcttcttggataccagagaccttatgtcttcatctttggtttcctttccttggagaatattattttcaaataaaagtgctgaaagaatttttgttgacatttttttaagtaagccatgagcagtgaattttaaatctgcttctcaatacttcaagaaagtatcttgaaatttgaaaccaaattatctgaattaaaatacccacacataccactcttgcaagagagcaaaagaattgctataaaatcaaccagctaataatggggtactacagtctcaaaagcatgaaggattatagctttaggaagaaaatccagagtaagaacactccttgtgagtaagcaggtggttgcattttggttccactgagtattatagtattggaagaagaataatttttcaccagtgtcttaacttgatgtatatgaaagacttttatatttttataggtcaaagaaagcatattaaactctatttgtaacaagcctaaagtctattatatacattgtatgcttttgctaagtaagtgtagttctgagatagcccatacattttatgccacaaagctcccaattttaccagctcttaatttgtcattgattaggagggaaaaatgcatttttaagactgagtttatcattactgttgagctgtagaaatactttatgactttattttaaatatttcattaaaacttacctcactggaatcacatgtgatatatacatatatgtaaatatatgtatgtatatgactgctataattaaaagacaaaggaaactactgttttgttaaatatgtctgcatatactttttattagtaaataaaattagtagattggccgttcagcatgatcaagacatcttatacaagtgacaactgaaaataggtaaccatagttgtaaaagtgccatgattctaaactgagggaatgaaatgctcgacacccataatgtgtaacagttgacataatagtagaggtcgcttcaaagagactgttgagacagaacttgctctttgtctataatgttcacagtgaattatccagtgtgctttgctactagcacataaatattttaataaaggaggattattacttaaattggaaaaaaatttgtttttcttgattatttgctgtaaaaagtttttttggaaccaaagcacaaaaggattgtgggttcaatgtgagactacgcagtttagtagaagctctgttaacctgctgttaattataacaggcttttacctgttttctaagaaatacagctaattgggttcatttcagtaggtttatttttcaacattagtactaaaatcagattgtgtgcaactttgaatcatggttctataaattcttggctatacttagtaaattacagtattacttccagtataattataagaatgctttaacatgctggatgttgattttaagaatttttatggttaaatattaattttcccttgaatttgaattattcttgtcaactatcattcgaatcccatgtattcatttgacagcctattgctgaaaagtaggaatttaaagactagaacagtatcttagtttcacaagttttcatagtagtgacttggataggcacgtttatattgtgattatgtatgcttatgcacacatttcttatagtgatcttggtctctctgcacttggtatatccatcaaattaatctacttaatcttacagtatatgtaaacatgctatcttttccatggaactgaatgattgacaatttctatggctgtaaggtatgtgtaaatttctaataaaatttgatatcacatatctctatctatctatctatctatctataattgtaaacctaggtatacacaattaaattgtgagttcagttttaaatatgtatggatatgactgtcacttcccattattctggcttttgtgaatgacagccatctataatcttgcctccttttcttgatctgtccccttgtttgtgtgcctttttgatcttgctccattgctttcagtgaagtgggttgttttacaagtaggaaacacaaagactacatggtgagctgagtaaatttgatagactgtgggagcggcagtgtacacagtagtcattttatagttagtgaacgatttgttgaggaaggactcaggaaggggtttgaattatgattcaagtcacagtgattagaatgtggttgtgttgaagacaactagacattccaggcatcgaggatcatagtcacggctgaatgattaggtttgttcataggactagagggtaatgatatttgagaatttatgaactaaatgtgccccagaatattgcaatgacttgaaattaaagcatttattcattcatgtttactttgttttctgacctactggggaatgctgtaagagttatgtggatgaataagagtaaggggaagtcacatataaaaccattgcattgttaaagagatcactgttgtggttaaagagaggactctggactacataagaaccagttgtgaaattggatttgggaagaacaaatgggtgcaaataatagaccaggaaaggaagggcgtccttttgaatttaattaactactgtgggtgctagttcagaggctcctgttaggttagatctagtcttcaaaagagaagggctgtgcttacttggttaaaagagaagggttgtgcttacttggttaaaagagaagggctgtgcttacttggttaaaagagaagggctgtgcttacttggttaaaagagaagggctgtgcttacttggttaaaagagaagggctgtgcttacttggttaaaagagaagggctgtgcttacttggttaaaagagaagggctgtgcttacttggttaaaagagaagggctgtgcttacttggttaaaagagaagggctgtgcttacttggttaaaagagaagggctgtgcttacttggttaaaagcagaaggcctatcctatcaagccatctgtcttctaaaaaggtaaatactatggcctttctttttcccttctctctattgatttatgctttctgattgctttaagacatacctagagtatgcaatggtgtcatcgtttggaggctgattatgggatggatccctggatatggcagtctcttgatggtccatccttttgtctcagctccaaactttgtctctgtaactccttccatgggtgattgtttccaattctaagaaggggcaaagtgtcctcactttggtcttcgttcttcttcagtttcatgtgttttgcaaaggcctaacaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatgacctagtaggccatcagcggaaagagaggcccattggtcttgcaaactttatatgccccagtacaggggaatgccagggccaaaaaggggaagtgggtgggcaggggagtcgggggggggtgtaggaggcttttgggatagcattggaaatgtaattgaggaaaatacgtaataaaaaaaataagaggaaaaaaaagagaaaaaaaagacatacctagagatataatatcctccgtaataaccatctcttttttagtttcctgaaattgaaaattggataattggcctcctcacatttctcattcatagttatattcttaccatatatttctttcatcccaaacttctgtttagtttttcctctcatgctttactagctcctgaagctagggatgataaaacaccttttaatttttgattcctagcgtgtgacacttactagagaagatttgtaatgatatttattttttaagattaatttttacttttagttatgcatgtatgtctctgtgtatttatgtacacatgagtgcagtgcctgtggaggctagaagcagggtatcagatctcctggaactggagttagagatggttgtaaatcacctggcatgggtcctgagaactaaacctagatcctgagcaagaacagtacctgttcttaagtgccgagccatctctaacccataatgctctcttatattaaattgacccgatgaactgcagactggattctcatcttgtttgtgttaaggagttgtgtctccagtactctatccaattttgtctacagaggaaaactcaaaggcttctttggagtctctcttaatctagataacctatatctactctgacttgcctccaaataacacagtaattctccataggcataatgtccacattctccatgtacaagatgatgcatgtagattgatgtgtatgtagtgattgagacaaggaatttagagcagcagtatacacacccatgtgtatggatgaaaactcaggagaacaaggagccagccccctggatacccaacatggagtcaactgctgcaggtagaaatcagaataagccgcactagtttttgtcactatagtgactggaatcctgatatccaggtatcctttctcctacatcaacaaggcagcctttctttaccaagattggagaagaaactagaactgcttgaaacttcttagtgagctaggtctggaggagaaagagccattgctttagtgactccttataactcccagtcatattagatgactgaaatgtattcccttagtaaggggaaaagtataatacattgttatagactaggtggacaccctactggacagtatatcacagaatatttctactatctatatataactttgtattctttgaccaagaaatgtaaattccctccttccttcagcccctagtagctatcattgttattctttttttcttgtatgagtattaaatttcatatatgagatgtggtatttactgttctgtgaaaaactaatcatccatagcatgtcctccagatttatccatgttatagcaaaagacaagattccttaccaccttttaaaggttgaatggtatcccaacgtgtgttatcacattttctccatccatccatccacccatccatccacccatccatccatccatccatccatccatccatccatccatcatctgttggtgaatacttacgctgtttctgttttcttggctgttaaaaggttttgtaaggaacacgaaaaggtagatattagttcctttagttacagaaccagacataggaacatggtaagacgtggcgcttggggctcatgtactccacttattactagcttaattttgtataggtcttgtatagataacctcagctgctctgagttcatgagtgtggtaaccataccatgtctagaaggcagcatttcatggcaatctcctaatcctctggcttttacattctttttgccccttttttgtttgatgttcgctaagcattggtcaagagaatttttatatgtggcatgtggtaaagaactaatttcattcttttccacacgaatatccagttttctttaaactgtttttgaaggccactattgattcctcactgtgtactcttagactcttcgtaaaaaaataataaacaaacaatcagttgaccataaatatgtgagtttgttcttggtgttatattctcttctgttagtaatatatttatatttatgatcacagcattctacttttgttgtggttgctttataatatgttttgatttcagagagcacagtggtgctagtcttgttcttcttgttcactattgctttggctatttgtttgtttttcttccatatacatctaagaattgttttttctatttctatgaaaaatgacattacagttttgatagagattacattgaatctgcagcttccttagaatagtatggacattttctcaacctgagttctcccaggttttgaactgaagatagctttccatttctttcacctttgtctatctgtatctcatatcctctatactgaggtatataaggtctgcatgacaaatgggcctctctttccattctttttaatagctgagtagtactccattgtgtaaatgtaccacattttctgtatccattcctctgttgaggggcatctgggttctttccagcttctgactattataaataaggctgctatgaacatagtggagcatgggtccttcttaccggttggaacatcttctggatatatgcccaggagaggtattgcagaatcctccggtagtactatgtccaattttctgaggaacctccagactgatttccagagtggttgtacaagcttgcaatcccaccaacaatggaggagtgttcctctttctccacatcctcgccagcatctgttgtcacctgaatttttgatcttagccattctgactggtgtgaactggaatctcagggttgttttgatttgcatttccctgatgattaaggatgctgaacattttttcaggtgcttctcagccattcagtatttctcaggtgagaattctttgtttacctctgagccccattttttaatggggttatttgattttctggagtccaccttcttgaattctttatatatattggatattagtcccctatctgatttaggataggtaaagatcctttcccaatctgttggtggtcttattgatggtgtctttggccttacagaagctttgcaattttatgaggtcccatttatcgattctcgatcttacagcacaagccattgctgttctatttaggaatttttcccctgtgcccatatctttgaggctttcccccactttctcctctataagtttcagtgtctctggttttatgtggagctccttgatccacttagatttgaccttagtacaaggagataggaatggatcaattctcattcttctacatgataaccgccagttgtgccagcaccatttgttggaaatgctgtcttttttccactggatggttttagctcccttgtcgaagatcaagtgaccataggtgtgtgggttcatttctgggtcttcaattctattccattggtctacttgtctgtagctataccagtaccatgcagattttatcacaattgctctgtagtacagctttaggtcaggcatggtgattctaccagaggttcttttatccttgagataaaaggttttctgttattccagatgaatttggagattgccctttccaattcgttgaagaattgagttggaattttggtggggattgcattgaatctgtagattgcttttggcaagatagccatttttactatattgattctgccaatccatgagcatgggagatctttccatcttctgagagcttctttaatttcattctttagagacttgaagttcttatcatacagatctttcacttccttagttagagtcacgccaaagcattttatattatttgtgactattgagaagggtgttctttccctaatttctttctcagcctgtttatcctttgtgtagagaaaggccattgacttgtttgagttaattttatatccatatacttcattgaacctgcttatcaggtttaggagttctctggtggaatttttagggtcacttatatatactatcatatcatctgcaaaaagtgatattttgacttcttcctttccaatttgtatccccttgatctccttttgatgtcgaattgctctggctaggacttcaagtacaatgttgaataggtagggagaaagtgggcagccttttctagtccctgattttagtgggattgcttccagcttctcaccatttactctgatgttggctactggtttgctgtagattgcttttatcatggttaggtatgggccttgaattcctgatctttccaagacttttatcatgaatgggtgttggattttgtcaaatgctttctcagcatccaatgagatgatcatgtggtttttgtctttcagtttatttatatattggattacattgatggattttcgtatattaaaccatccctgcatccctggaatgaaacctacttggtcaggatggatgattgttttgatgtgttcttgaattcggttatcgagaattttattgagtatttttgcatcgattcataagggaaattggtctgaagttctccatctttgttgggtctttttgtggtttaggtattagagtaattgtggcttcatagaatgagttgggtagagtaccttctacttctattttgtggaatagtttgtgcagaactggaattagatcttctttgaaggtctgatagaactctgcactaaacccatctggtcctgggattttttttttttgttcagagactattaatgactgcttctatttctttagggggatataggactgtttagatcagtaacctgatcctgatttaactttggtacctggtatctgtgtagaaatgtgtccatttcatccaggttctccagtgttgttgagaatagccttttgtagaaggatctgatggtgttttggatttcttcaggatatgttgttatgtctcccttttcatttctgattttgttaattaggatgctttccctgtgctctttagtgagtctggctaagggtttatctatcttgttgattttctcaaagaaccagctccttgtttggtgcattaaactctaaaaagtctttaatttctttctttatttcttccttgaccaaggtatcattaagaagagtgttgtccagtttccatgagaatgttggctttctattatttatgttgttattgaagatcagccttagtccatggtgatctgataggatgcatgggacaatttcaatatttttgtatctgttgaagcctgttttgtgaccaattacatggtcaattttggagaaggtaccatgaggtgctgagaataaggtatatccttttcttttaggataaaatgttctgtagatatctgttagatccatttgtttcataacgtctgttagtttcactgtgtccctgttttgtttctgtttccacgatctgtccattgatgaaagtggtatgttgaagtctcccactattattgtgtgaggtgcaatgtgtgttttgagctttactaaagtttctttaatgaatgtggctgcccttgtatttggagcatagatattcagaattgagagttcctcttggaagattttacctttgataagtatgaagtgcccctccttgtctttttgatgagtttgggttggaagttgattttattagatattaggatggctactctagcttgtttcttcatatcgtttgcttggaaaattgttttccagcctttcattctgaggtagtttgtcttttttcctgagatgggtttcctgtaagcagcagaatgttgggtcctgtttgtgtagcctgtctgttagtctttgtctttattttggggagttgattccattgatattaagagatattaaggaaacgtaattgttgcttcctattatttttgttgttaaagttggtattctgttcttgtggctgtctttttttaggtttgttgaagtattactttcttgctttttctaggatgtggtttcagtccttgtattgttttttccctgttattatcctttgaagggctggattcgtggaaaggcaatgtgtgaatttgtattgtcgtggaatactttgttttccccatctatggtaattgaaagtttggttgggtatagtagcctgggatggcatttgtgttctcatagtgtctgtataacatctgtccaggctcttctggctttcatagtctctggtgaaaaatctggtataattctgataggcctgcctttatatgttacttgacctttttctcttactgcatttaatattctatctttatttagtgcatttgttgttctgattattatgttttgggaggaatttcttttctggtcctgtctatttggagttctgtaggcttcttttatgttcatgggcatgtctttctttaggtttgggaagttttcttctataattttgttgaagatgtttgctggtcctttaagttgaaaatcttcattctcatcaactcctattatccgtaggtttggtcttctcattgtgtcctggatttcctggatgttttgagttaggatctttttgcattttgcattttctttgattgttgtgccgatgttctctatggaatcttctgcacctgagattctctcttccatctcttgtattctgttgctgatgcttgcatctatggttccagattactttcctagggtttctatctctagcgttgcctcactttgggttttcttaattgtgtccacttccctttttaggtctagtatggttttgttcatttccatcacctgtttggatgttttttcctctttttcttgaaggacttgtaactctttagcaatgttctcctgtatttctttaagtgagttattaatgttcttcttgatgtcctttaccatcatcatgagatatgccttcaaatccgggtctagcttttcaggtgtgttggggtacccaggactggctgaggtgggagtgctgggttctggtgatggtgagtggtcttggtttctgttagtaagattcttatatttgcctttcgctatctggtaatctctggagttagttgttatagttgtctctggttagagcttgtacctctcgtgattctgttagcctctaccagcagacctgggagactagctctctcctgagttttagtggttagatcattctctgtaggcaacctctcctcttgcagagaaggtgcacagatatctgttgttcgaacttgcctcgaacagggcctgtcccagaagctgttagcttcagtagttcatactctcacctgtgcagactagtcttggcaggatccaggaacgaagatggctccagcagatgctctggcaaagccctcctgggcggggtggacacctctcctctggcagggaaggtgcccggatgtctggagtccaaaaaggggtctgccacagaagctgtgtggctctcgcctgtcccagaagctgttagcttctgtagtccaccctctcacttgtgcagactagtcttggggggattcacgaaagaagatggctcctgaagatgctacagccttgccaatagttttttgaagaattttacgcttatatttaatagaaacaatgccttatgattttcttgtggtttcttggactatggtgatatacacccatcttttactaatttttcagttgataatttttattattgtgcttaatctttttactttataatttttacttatgttcagattttctattccttcacagtttgttcttggtttggtttatgtctttaaggattaattttcttctacgctatcacttttgttaaactagtattatccatggatagctcttctgatcctttgtgttttggtgatatcagttgtgtaatgtttttaatttctgatcttatttaatagcctttctattcattagttgaggtagtggtttgtctattttttctcttcaaaacccaaatcttttcattgccttttctctattttatttttattttttataacattccatttgtttatgatctgatctttattcttctactatgttgcttttatgtgcttttgttctttttgatatgttgatatactgctaataaattactgatgggattggatttttggaatggttgatttcccattttttgtccctgtagtttttcccctgtagttggactctcttagagagtctaggctgtccttgaattcatgtcggtcctccagcctcagccttctacgtgctgggattgtaggtgtgaatggcaccatgcctgactcccattttcttctgactaaagcatttttatttctttttaaatttcttctgtggtccatttgctgtttaataatatttgtttaatgccccactatttgtgtgttttccaagattctgttaataatttttagtttcatcacattatgatctaatttaaaaatactttctacctacctgctcttatcttttgatgttagatttttttagcctgatgtttgataacttattcttttttcccctgctctggaccttccgttctttgatttaactggcttttgtttagaacattctgtctctgaaactattttcttgctgtccagttttattttggtttgattaaagtttctttggtattctggtcttaggcaggaaaaggacctcttaacaagcactatgatataaatatttatttcctccaaacttcatatgccaaatcgtaattctacagttgacaaacttaagcagtaggttcctgggaggtaactggaactttatcatgtgcacttcatgagtaggacttagaacccttatagaaagaaggcccagggagaagttgttgtctatgagcaactgacacttaccagacaaacttatctgctggtacctttatctgaaaattcatagtgaacagagttatgagaaatcagtttgtcttgccattatgtgtattgttatcttgtttattattgcttattattacctactttatgatatcttatagtaaggaatccaaatgaactaagatagtaggcatttctttggtatttctgggaagaactcttacttagaatcacctatctatatgctcctaagtcagagaatatttgtcagatggataatactggaatggacatttctagttgacaaagatatgtcaggtttgagaaatggtttgaaaagtcattccaggcatagttaatagactttcctattcacctgtactaaggggctggacttcactactgtccccaaattgagatgtgagttttaccatgaattcagagttttctccttaaaatctgagtcctggtggcacagagtgtacccatgtatttgaacccatgtattaaccaaatttttgagtgaaataacagaagaggaaatgatatacaagctttcttctatctggacatgagaacccttttctgtgtctttgaaggcaaacagccgtggttggtcatattccgtctgctctatatagtgtctttggcaagtaaacttgtctctttaaattcagaactaaacttactttactatttatataaaaattcaatagttgtgcataggtaaaacaatcttgctgtgaaagtaaccaatagtacttaacacctagtgtgctctcactagatgcttatcttattttccttcttgatgttcttaactctgaaccatttgacagatcaaggtacaatctcttatgacccatattcgctccagaagtttacagtttctagatatggaatcatttcatgaactacctgctaaatgactgtcattgtaattaataatagtacttaggaatgtcaatattctctcaggtatctaaggaaggaaattgagaggctgcctacttagtagatgtcacattgactgaaaatgatgagaacatttagagtcatacctttattcatagggacacactacatgggcagtttgcaaaattccttttatcagcaatgtccttgggttatgtattagttatttttcacactcttgtgacaaaaataccaacttaagggagagaggaagggcttcttttcaatcatggtttcaagtgatgtaagttatgacaatggagccagcccagctgtggaggtagtatagaaccagctcatctgtagaggtaggaacttgagttttttgtttgtttgttttcccacatctctgaggaccaggaagcagggagaaaaggaagtaggatttgactataaatatcaaagcctgtcccagtgacctatttcctacatgtacgctttaagaggcagaggttttacagcctcataaaacagtgccactagctaggactcaagtgttgagattacatgagtttacaggacacattttacatccaaacaattctagatctctaaaacaagtcatcaaatgtgtggccttcatcttgagtaaccatgtctgaagaagaagagacttggatggttccttgtgttaaatattgtgcctgaggcacatatcttctgaaaaccctctccttcctgtcctgttccatcgcctttgtcttactaagccccagtgatttgaactccgaggttctggtacctgatatatgtagttactggatttgtaagaagaaagcatttctttgctttctcccaattttatctttgggatgtttctttccctacgatagtcaaaagtgtgtgacttagaatctcaagaaacacgagctatgtctttggtatacatgctgtgcactgtacatccaaaagcagtattcattggtcttagattttggagagaaataatttttaatatgatagattcttgttagaactattagattaaattattccatttatttttcttcaacaaacatatttcatccttgttatgttcttgggctatgcttatgtccatttgaagtttgactctctgtcctcttatgattcataatctagtgagatagatgataaaaatgatagttattgtaaagaaaaatgaagtacttcaaaatttgcctatgttaggatataactttgacaaagttagtactgggaaggtggccttaggaaaggagctctttgcaccttcatttccattatttgtgctatttcttgtgtggctgtggcagccttgatcgagctggagcttaagggagtggccaaatgagtgggagtgaaaggaagttagaaatgaaaccattgtggagagtcagcctcatatgatttcagagtgattttaccttttattcgttcaaatggtgcaacgtgtagtgtcttaatactaagagcaatgaggattgacatattaaaaatatatattaactctgctatgttgatgaaaattgtatgaaaagcattctacttggacgcttttagttctgtggcattaggaccatagaataaattctttttgacatcagttttgaagaaggagctgataagttggaaggaagcagtttttacaatggagtaaatatacttgagtttgaattttaaactataactgtggtttgaccataaattaagacagcctccttaacaacaagaaaaacatttaaagcagctttcatcgattcaactgattcataagtgctggccataaataaatattcttggaggtttaacttgttgaagccagcttctttagccagtgtcttcctggaaagcattttgataaaatgcatattgtgataaaatattttcagactttgatctggtaatcctgtttctttagcagtgtgtactgagtaaataaatctaaaatctcgataaatcatagtgcaccaccactttgtccaacagtttaacaagaagaaaatgattagctaaggtttggaatacttgtgtaatgaaatatcatggagcctttcaaacattgttaaagaatattaaccatgcaggaatagatttctacagttcaactgaaaaggaataacaaacaaacaaacaacaccaagctgtgctgggaatgaacacaagccagtgctgggaatgaaccctaggtcttcacatgtgctcagcaagcaatttcccaccctgacctagacctccagcctgcttctgtagacagcatctccattataagtctttctgttctttgtgttggaagatttatattttcttctctctagttttctgtatgacagaatatatgtagccaacatgaattaaattcatactgaataaacatgttctataagcatttcagcctttgcctcagtgagacaattttgactactatccaatccatttccattagtatgatatatacctttttcagatttttatctttaaaacattttttctttgtagtgaatttttaatcttctaatatttattttgattttttggcatgattttatctttgttggttctggtttcaaggtattcttaaaatactgacagttttattccccattgcaagagtattttttcaggggtaaagtgcttacctagcacatcgcaaggccttcgattcagtgcctagtaccacctcctccatccagagttcatgggctcattaccagctatgctaatctattatttgccgtatgcatgaaaattctatgttagtgggaaaagggagtagggaaggtgtcagtagatcccaaaattaagatctatatttgtttcttctaaaactttacgatctagatttctctaactgaatcttatcttcccaaacatattcatgatgagaagagagctaactttcactgaatttgtctttgagccagatacttttatgtattgtacagttttgcagtctattacaaaaattcttttaaataaaaccatcatttggaaattgtacttacattagaaaattacaaatgtgttcaacagaaagcaatttgaatttaacttaattctaatggcttatttctaatgaaatagttctttatagctaattaattttgccattgctcccattccttccacccaagaaaagatacttttgtggtctctactccctcctttctttcttgcttgcctccttgctgtgatagtggatgccagcactctgctacagagttgtactcccagctcgctttcttactttatgttttctgaaggttttcactaagttagccaagctgttcttgaacttactatagccaaggcaggccttgagcttacagtccttcttccttagccttctgagtagctgaaatgatagataatgcttgtgacaccagaactgacaaatcatgcttttctctgtagtgcctatgattaagtaggctcctctcattccttactatatcctagtctctagtctaccatcggcctagcaggttagttgtagactcttttaaaaaattttttattaggtattttcttcatttatatttccaatgctatcccaaaagtccccccatatcccccccactctcctacccacccactcccactttttggccctgacgttcccctgtactggggcatataaagtttgcaagaccaaggggcctctcttcccaatgatggccaactagcccatcttctgatacatatgcagctagagtccagagctccggggtactggttagttcataatgttgttctacctatagggttgcagatccctttagctccttggatactttctctagctcctccattgggggccctgtgctccatccaatagctgactgtgagcctccacttctgtgtttgctaggcccgggcatagtctcacaagagacagctatatcagggtcctttcagcaaaatcttgctagtgtatgcaatggtgtcagattttttaaacccaagcatttaaatacacgtagaaagttgtattagagattgttggtacagctgtgtgtgtgtgtgtgtgtgtgtgtgtgtgtgtgtgtgtgttttcctcctcctttctcttatcttcctggggtccctttgtttggcttctatttgatttgtttacagagatgtaggctttgaagtaacagctatataggactattaaagagaagggtagagcaagtggactgctttataggtaaacatgtacctgggttgcagccactgtcattcataggttgtactttcctctcacatgtctgcattgactttcttgttgctgtcctaatttcctgtagaaatttactttgttctttgtctcctaaattagaaagtagttcacattactctataaatattgaactatcatagtgttgcctgatgtgttagtgggtacttttaaaatacatttttggatataatcatttaatggtattatcttattcttttttttttctgtttcgtgataaagggctttgtgtatctgttttccttcatatggaatttctgtccttaggtaaatgctcctttatagatatgccattgccattgcaaggtttgtagtagtaaaactgatatattttgtgttgttgtgatcatagtgagataagtagctgcgaggtaaaactgtataaatagtcacaactaaaatatcccctataaaaatagaaataaagacatatacatcatatacagttcatgattactgagaacatcctcaagtatgtcaggtcttgtaaatatggcttttcagattgtttttattttttaactcatggagggggaataagagtgatctatttttggcagggactcaagggaatatcagtgtgactgttacctgccacttttgtcacggtcaatttctacctgagttctttgggtttttttttctctttctttctctcattattttggacagtgacatctctaaccttttggtctgagcaatgtgttgcccctgaaattggttgagtcacttaatattttccccacctgtcaaagctgtagagatctgtaccttttgccttctgcttcctgagccattttcctgctagtagtaatcttctattgtgtctggcaagttttcccacatgtttgatatgaaacctaccagagtttgatccttaaagttactcaaggttaagaggctttgagacttctgttcacgaaagagtaactggtacatgattggttactttcaagttaagaactgggaaccacacaaaatatgtgaagaaaaaaatgtattctgacattgggcaccaggcatacaggctgcaatctctgaaacggaacaaatgaacaacatgaatgttacagacatcctgactttttgtttgcaatcagtttcaagatctgtgagcctgtgatcttgctgaacttaagagacaaagaggtgccgggcgtggtggcgcacgcctttattcccagcacttgggaggcagaggcagtcggatttctgagttcgaggccagcctggtgtacaaagtgagctccaggacagccagggctatacagagaaaccctgtttcaaaaaaccaaaaaaaaaaaaaaaagacaaagaggtgccgatagcaggaattggtggaagatgttattagagatggggagctatggacagaagtaactcccaaattctgcatggatgtaattctgtgtaggtatcgtcataaacatctgagtttctacaccaggatctaggaaacactgcctaattaccatgtgcatacagtagagcctcacaaaccttcaactatagtagtagagttaaattaaccctagagtaaaaggctactctgatcacaagtgaacaaacaaaaccacaccttgaaaaatgactaacagaagttttactgcatacaaaacttgaatgctccctaagggaatagagcaaagcccagatcctcagcagtgtaattgttaaaaaagatctagcccccccccccatattagatcttccaagaagcagtaaaatgtgagctgtaactaggagaaagtcagtcaacagaaacagaaccaaagattaatagagggagacttaaacgactctgaaaatacattgaaggattaaatggaaagcataaatattacaaataaagaaatagaagagtatagagaaccaaaaggaacttctggaagggaaaagtgtaccatatgaaatcaacatttattggatgagataaatagcaaggtaaacattacagaaaaaagtactgatgaatttgaatatgtaagagtagaaattgtccaatctcagacacaatgagaatagccaagttggggaaaagtcactgaagtctgaggaactattaagcagatttatatgctatgtaactagagtcaaggaaagagaataggtagaaaatagttgaagtaatgagtataaaatttccaaatatgttgaacactttggacctctctctccatagatctaagaaactaaataacagaaaatttagaagcaaaaaaactacaagtaagagtaattgtaatcaacctgttaaaaccagtgattgcatttcaaatgctaatggagaaaaaaaaaacattaagtgcagagagggtcatttccttctcatcagaaacactgatagtcagaggacaatacactggcaactttcaagtacttaaagtgagaaaatgtacttctgattttaaagtctataggtaataaaagcatctataaaacgaagaagaaatagaaatgagggtgaaattcatggtttgagatgaaaatagaaataataggctccatcacaccccagctgtaagaaatattcctggcagttttgagacagaaggcaagtaatggctgatgggggcagagagaggtatgaccttgggctggctggccagtcagtcagtctaagcaaaacagtgagctccagatttagggacacggagtttcaatctctagccaacagataagcgggcactcatacttctcacacatacatgaaaacaatgtatacacatacatgcacacacaaatatagatattgtagatgtaaatgtaaccatacaatagttagttagaagtaatgtaatcactgctattaaaagttacaaaaaatgtaagacctaaatggatactgtagataagagctaactttaaaaataaacactgcttaaaagcatgaatgtggaaaaagatatgtgaacaataaaccaagaggaagccagaatgctcatattagtataaaatgtagtctttaggaagagtggtgttaccaggaataaggctagccatttcataaagataaagtgaccaattcactaagaaatcaatgactggaaatatgtccctaacagaacttggaaagtaaatggaaacatgcatattctgataagataaatagacaaaactatcatcagaattgggtattttaactatattaacttggtgcttcatagaaccagaactagtagggaaaacttcattgaggagatagaaggcaaatagcacaaccaactaaatctaattgacatttataaagtattggaaacaagactaccagaatacattttcttctccaatttatgttacattcactgtgagccataaaacatactttcaacatatttaacaaggaactcagataatgtatattctttgaggaaaatgaaattaaaaacaacaaaaggatatctggaaattccccaaatattgggctattatacagtatatttgtttgttgtgattattgttattttgaggtagtcttgtagtgtaatacaggccagcctagaatttactttgtaaccaaagctggcctcaaacttacaatgattttcctgccttaccgtctcatgtgctgggattacaatcatgagctgccatgcctggcttttagtatgcaattcatgtaacatgaattggagaagaaaatgtgaataatgagccaaaatcataagagacattaggagatattttagatataataatgaaaatacagcatatgcaaatttatgggatacaagtaccacagtgcttgaacagaaataactttaaaataaactaaattcaacacacttctactgtaagcaacgagggaacaagtgcagatcctttcaggtaaatgagagaaatgaagaaaaggaaagattagcaaatggaaaataagtaatacaggaaaaatacaaggcagatgtcagctcctagtaagagcaataaacttgctgagctgatagctagacttacaaagattaaaagggaaaaaacatgcttgcaaatactcaatgttggagacaatataatagatccctttacaacttttggagtcacaggaagaataagagactgttgtgaatattatgctagatatttttacaatgtagataaatgaaagattccttgaaaggcacagttgatcaaaatgaactcagaaggagctaagaaatctgaagagcttaacatctgtcaaagaaattaattaagaatcatccctcagttaaaaatctagctactgacatatttcatggtaaatcctataagatgtttaaagaacaaataaggtaaattcagaatagagaggacagtagaacacttctgaattcatgccacaaggccgatgagattgggacctgttggtgagaatgtacaggagccatggagaacagtgtagaaattgctgagaaatattaattcaggactgccacagtgctccaacagttcacatttgagtacatattcaaaagaattgaaaacagcttaggggtttcgcaggtctaatatacactgtgtcattattcacaatagccaaggtatggaagtaacacataatagtcaataaataaataaataaataaataaaggaattgttatactgccttttaaatggaaaacattcctggtatttgcaacaatgtggattcatgtagagactattttgctaagtgagataaagcagccacaggagaacaaacactgcatgattacaaatgctgtggcgatgcttctatgagaactctgtagaagtgattactagaagcttaagacagagctgggggattgttcattgttatgttaggttacagttacacttgatttaagctgtaaaaaatctcctatgtgacagagtcctatagttaatatagtacggttatatcaaaatccatgaaggtggtttcatgttaagtatccctaaacaaaaggatgcaactttgggtaagctgacagataggtcttttaccttgcttgtgatgatagtgtcatagttgtttgtaaccatacaaactcattaaattgtgtataatacatttagctaactaaagctgttaaaacttgaagaaaaatatcagtgtcctcatttgtaatagtctcaaacaagaagccacctgcagatctttcaccaaacttgaacaacctacacatctatcactaaactagaggcaacctatatagctatcacagtttactggataactctttgttgtattcattcaatggaatgctaaacaatagtaatgatcattcaagacgtttcaatatccagagcactgttgctaggtgcaagaatactgacacagtagaagctagatagaatgatcctatttatatggaattctagaaaagacgaaactttagtgatagaaagtaggttagtatttaccaagatccaggattgcaaggaaggaagctataactaaagggcatgaaggaactctttgggataataagagttccagaccttgattgaggttcaacttacatgcatgtgtacatttgctacagtttttggaattttacatttgattctggtgcttttttgtataaaaattatgtttaggtaaagggatgtttaagaagcagtttggaagaaataccactgcaggctaaaccaattgtagctgagtggtagaatgcttgcctaacttgtatgagggtattggttcagtcctcaacaccacacacgcacacactctcatacacacagagacacacaatcctatatagttcatggtagaggaccttggaagtttcaggtgttttctgaaagtgaaaagaaggaatgagggagaggaaaactagatcatcagttgtttgcatagtccctggagtctgattttcttccttgcttgcagccaaagaaggaccttaaaaatcaaaagagtcagccttgttaactaaatgcagaaagcacgtgaaaaacaaatccatcacttttattatgggtcttatttattaggctgacacattccatcagatctccatggaatgagaaaggagataaaatctagaacaaagaagctaaaatgattttccagctcattttacattagtgcttaaattaatcagcgtgtttatttcctatctactccattcctcctgagtgggctccacagcaaaggcaagaaggtaaagaatagatcattaactgagaagatagaacataggtacaaaatctaaccacttgcttgtttctgttgttttatttaaagtattgtgatttccctggttgtgctatatattcagtcacaggaaaataccaaagcaaagccccttaaaaatctttaatggtagaaaaaaactaagaggagaccgtacccactaattgtgtccattgctattcattctaaaacttctggacctaattttgttttcttaattttgttcatgctgaggaatcttcagatgtcaacaataaagcctctttttgctcggtctgtttcatattaaaataacccttttcataggaaaagctgagttgcaaggtttaaagctctttgagaaaaacgattttggaataggaaattcaaatggaaattgtttcatttttgaaatttgtagtaaattgtcacctaaaattagtgagttagatactcaaggaataaaaatttgtggtgtgtttctcttatcagggaagaaaccatagctagtccattttcagaatgttgccatgtattaaatccaatgcttattgcagtataaattaggaaaagaaaatgtgtacagatacattacttttcccggccaggtaatcatgcttatctaaattggactgtaataaaataagacagcctgtcgacctgaaactggattttaaagaagtttgctgaaaatggttgatttagtctttctaagggtaagaaatggttccttccgttcgaaaatggacagaatcatagtaatggcctaaaagtccacttctgattggggtcactgcgcgtcgggggtgattagtcttgatttataaagagaatccattttcctagacttcactcctctccttcctttgccatttaccaactaaattagaaatataaaagtaggaggaaagcatatagtgctgctattcttttatttctgttacaaccaaaccaaaaaaactattagaatatggtaattcttgattctcaaaatgtagatatttatgatcttctatactagtcatgctggctgacctcagtgccttagtttcccaggagccatgaggtacaggctccatggttgaagggaggggtatagtataaagctatggttttttgtgtgtttttattaggatatttttatctataataaacaatggtgtgtaaagccgggcgtggtggtacacgcctttaatcccagcactcgaaaggcagaagcaggcggatttctgagttcgaggccagcctggtctacagagtgagttccaggacagccagggctatacagagaaaccctgtctcgaaaaaccaaagaacccccccaaaaaaaaatggtgtggatgaaaaagtgtccaatgcatttagccaccccttcactctcttgatccctccagtttagcctattttctcatttccagttgatgtgagatacagattacccagagcttaaacattatacagtccataatataaattgtataattaatgatcagattccatacagagataaataatcactaaacaaaggcagtgggatttttttatttggaggacagttggtagagaaaaagacagaagaagacttgcatttcccaactgctgtcaaataacaggacagcgtgcaatgagaaagcggggaggaggctctaaagggtgttggtaatagaggatgaaatggtaggctttgatgtgcatttctaataggaactgtgtaagaatttgtaaattggtgctggtctttctagatcagtagttctcaacccgtgggggtcaaatgaccctttttatagggatcccttaagaccatcagaaagcatagatatttaaattatgattcctaacagtagcaaaattacacttattcagtagcaatgaaaataattttatggctggggtcaccacaacatgaggaagtgtattaaagggctgcagctttagagaagtcctgtctcaacctctgatgcacttctggagggggaggaggaggacagggaggaagaggaggggaagaggaatgcgagaagactcgtccctctgcttatctagagagttaacagtttggtatccatagaaatgttcctattctgtggtcatttacacgacagctgtacttactcccctgaagataccacctcaccatgctcacaggaagtggcatgtgaggaccaagtagctttctataagacctgaactctactatatcctggatcatgggatttgtagctcctaaagtataagaaaagtttctttaagcaattattgataattattgatatagtttctgttgcagtcctgctgacaaattcaggatgtaatgatattggcatattttatattcatgaaacctgcaatttatgtggcttggaaaggaaatatacaacttcttttcatcgaagtaggaagagaagtgttttcactcggtggtggaaggaaggcaccatcatttttggtttttatttaagcttcctagatcccagtgtgtaattacatggtatgagaaatataattggatttttgagctaagaaacaaagatacaaggcttctctcttttctcttttatctacctttaaaataaataatcttgcctgagtgcccacagcaaaatataggtatgatttatattatttgtgctaatattgttatctgaaaacttcattcaaaatgagaagtgagagctcgccatggactgtgttctttttttttttttttaacttctcactttacgttgttgtggaaggagaggtaggccttgagctacactattgttaagtaaatacatctgtttcattgtctcatgtgattgtactccaggccgacaaacacatttctaatgcattgtcgcttaaatcaatagactgtctcagaagaggacattggaaatggcatgaaatttgtactgggacaatcctgtacagatttatattgttctttgtgtcattattgttctataacagctatgttttggagagctacttttgatctgacaggaactggctgccacttggcagcgaggattcacctagattaggtagttgcttcctgtttctatatatgggcttgggaaaatagcgtttactttcctccaaagatttctcagaacatactggtacggaatgttcagacgtaggataattcctttaaaagctacatctggttaccctcagaaaaataattccattaatatttcaactcattttgatccttttgtagtttgtagtatttttttttcaatgtatgtaggtggccttaaaccatatggcaaaagcatttccccaaaacatacaatccttgtcttactatgaactattttccatatttccttgttatttgaatagctcctctcagcaggctccaaacccccttttcccctttgatccagttctgcttatgctgatggctaagcttacatacactgacaaacttatacgtgttttaataacgtgtttaagaatgaaatcacctattcctttcctgtgtttggagtgaaaatatgttgttactatttttaggtaaaacgcatcgaatgtctgtgcagtcattgccctgtacagggtcattattattcatacgatgctgtattttgggctcagtgatttgttttgtatcagtctactttaaaatactcaactgcctagattctttttttccattaaatggtgcttttagatgctttacttttaagcctgtgaatactttttttcaagataaaaggtactggatgtgcatttatacatgaaaaatcagagactcagacatttaaggaaaaacttttttctgtctactaaaagtctgaattcttacatcttcaaacatctgtcttaaacttagtaaggctgtcattccctccccttcttgacagctgctttacttcagtcttaactcccaaagtggatgttgcctagggcatgtaagaaataggaaataacatagataatttacctgctatgaggactcttaacaacacatattcaataatgtcaaaaattcaaagaatgttaaatctggcttccagtcctctgcagctttacatccccatgccctgagttactgtgacgtgcctttgcttcctaggctgctttgcaaagatataatcctggagcacccttagccatatattaacaattcctcaaagaatgaccatagcattataagaaaccacatgtaattctctcgactatgtggtcaaattccttttaacatatttcatagttcagtatagtgttagtatgtgtagctctatttatccttatattttaagtatttactggagaagatgtagttatattattagaagaatgacttgtatgtgttctagtggtgtaaataattgaaggtgtagcacttctaagtggcttccatttcaagtgttttggtaagaaatgaattcactcccacttttatgtttcttaattcactggtgatgaaagtatacaatataggtctgtattattgaaaaaccctcaaggtactttgaaagcatggctttatacagatcatagaatgactttcttcattctgtagctgtcagtgctgtcaaaggacctgtcttgtgtagggatgttgtctagtcaatgtaacaagagagtattgatgatcttgctgtccataggagtggttgcagaggtggactacaccaagatggaaaatggaaaaaataaagaggtgaaatttatctatatttagcacatggaagctagaaaacagaaaagttggactttccctttggattttcttttaatacctttggtataggtcacacccagtgcctgaatgtcacctttgccttgatagtgctgtcatagatttcagtactattgagcattgagttcatggaggaagggaccttttcatagtgcaccctggtttgtctgcagtgcttgtttgggacccagtctgccattgtgcctgtcagaacttgccataatttaaatgtttaaggtgggtgggtgattaacctgtttagcagactgtcttactgcccaagaactttttgtttttacctttttattgattctttgtgaattttacactgtgcatctcagtcctgcttgtctccccagcccttcatatcagccctctgcccttgcaagtcccacaaaagaaaacaaaaagaaaagcaagcaaacaagcaaaaacctagtcatggaagctgcagtgtgtcagtgtgccccactacatccccttctgtgcacacatcttcacttgcaaatgttcactgcaatgagtcattggtgtggtttgaggcctcaggcttctgctgcactgggtcctcaccaggactcctcttagttatcatattgttgccctgggtcatggagatactgcaggctttcttgttctttttctaaatttggtttttattttttcaagacagggtttctctatgtacccttggctgtccttgaacttaactctgtagacaagcctggtcttgaactcacagcgatctgtgtgcctcgccatttcagtgctaagattaaaggcatgtaactagggactaatgagaaatacataaaatatggtatatcatcctaaatttaaatattttagaaagcagaagtaagttataccactattattatgaatattcatagtaatacagaccatgctacctgtgatatatttctatttttgcaaaatgtcctaaagcataattggaacataattgttcaactgagtcatgaatcgaggctgttactggcttgctgcagaacccaagtgtctaccatattcagctccattttgtgtaccacatagtatataaaaccttttgtgtaaaactaaaaacttctggagtaagggtatttgctggttaatgtttgcagccactcttcacctatctgaaccatcctgattttactcgggcaaactaaagacgcatcggatctgatgaaatgtctttgtatccctttagcttaattgatggtattttgggcttggtttatagtgcgtgttttcacctgccttgtgagtaagctgtgactgtttgcctcttgctggcttcctatgaaccaatggctgcctttttaatctttcataaggaaaggtttttgctgaagttgttgattatctgttcccagttttttagatgtgacttacaaatgaggcagtgatcctaggtttaaacagaatcctgcagacacctgtgctgatttacggctctagactcaacattaccaggtctgagtgtttattttactatgtttgatctgcaaacaggaaattaatagcggtctgcaagaattgttgatgaagattaacatatagactttgttaaaaccttaattttgtatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtttggagctgagatgaaaggatggaccatgtagagactgccatatccagggatccaccccataatcagcatccaaacgctgacaccattgcatatactagcaagattttatcgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacaccagggccaaagggggggagtgggtgggtaggggagtgggggtgggtgggtaagggggacttttggtatagcattggaaatgtaaatgagctaaatacctaataaaaaatggaaaaaaaaaaaaaaaaaaaaaaaaaaaaaaaaaaaaaccttaattttggtgtctaatgtctcaacccaatgcactagccttgagctccttcaggccttgtcttttggtctttatgtcttaggcactgaacctagcatatgggaaagactcagtagatgctgtcttgttgaattgactggtttaccctattttatcttctgttacagcccactgtttgtaacatggaagattggtcgagacaaaagactgcgtggatgcataggtaccttttctgccatgaatttgcattcaggactcagggagtacacacttaccaggtgaagacccatttctgttttcatgtacttctacttacaaaaaactcttccgctccttgaaagtgatgctttgactccttttcatttgttcaatggttgacattactctctcatttcttgttagcttttttctttttggtgtccaggtaccttatcttataaagtattattgctatgtatcattctataaatgctatggtgacatttatcttgccactgatttttagagtgacttttttttcttccattgggcagcttattttgtataacttgaaaatgagtgactaaatatccatgagttaccaaaagtctgatttctaccttaacagcctagatttgatcacctttaagacctttaaaaaatacttgttggttttttccccttcattttatacattttgcccaacttttatgtgctttaaaacttgaaaagaagtcctaggaagaaagtgctgtcacagcctgacagcatacccgttctcattcccattttgccctcaactgtagcttgcttaagtgctttcctctaacacaatgggaaagtcacaagtgcctccttacatttcataaggctcagccttcaacttctccactaacagaaagctatctaccatgccatctgattttgataaatacaacttgtagcaaattatgttccataattatttcagagaagaagaaaatgtcttaaataatgacctattagtaaaggcatttcctagttttgttcatgttttagtgtggctaccgacacatagttgtaatccatacagtattagtataataagagattggtctttgctaactgttgttacttggggcaagttgcatgacttccataggtaaagtgataattctagtattttcttctatatactcaatatcagtgttaggaggatgttaggagaatgaaataattagttactactttgttacatgattggtgtgaaaatctatcttactgtagagttgtgtaaagccagacttagagcaccaatatttaaaaagccgtaccattaatgttctcatgttctaaatctagaaaactctataaagcagcattttagactccagtttatctgagtgcagacccttttgtccctctagtctggtgtcttgtgtcacgacgattccaaggaacttaactttgtaaactcaagcctgttaagaacttttacaagtgtaaaattttatgtttatgtatacactatttctagtgtagagtttcttggtgctttcaagtgaaattgtgggaaacattccattatgaaatattccatactttacaaatctttggtagcaatggtaactggtaacaacttgcttttgtttagagaaattcttttgcctaggaagtgagaatatccaactttttttttttaagcttgtggtttttttcctgagaataatgtgaactgagtaaatttttcacacaattgaaaattgcctgtatttgtgtacttttaactctgattgcattgtggtctgtgcctgggaacttcctggttacttttcaaccctttccttgtatttctatacagcttccttaaattgtatatagtacattcaaaggaatgcatatatatatatatatatgtatatgtatatgtatatacacacacacacatattttgtgttttatatgcacacatataagcatcctgtttgcctctcaggtttgtgtcaataatttacatataaatcttgatatttagaagagataaacaaaagaaatcttaaaaatttaattactattttaattcattttggaatcataagctgtatagagtcattctttttagaagttttaatgtaataatgcttttcagtcccaaaaacatacttatgttcctctacctgtgtgtttctatgtgtgagtatcttgagaaatgtattttgaattaagagtttttaaagacaagtaattttggattagttacaattattatttgacagcctcataaaatgcattcttcttatccttatcccaccttcttttctcatcactgtcatgctcatcgtccttagaagaccctttctcacagccatgcctctgtttggtttatgacagtgagtttagcatgggttgcttgtatgactagaaggttggaaatatatactgaagcttggtggtctcaccagtgggcaaacaagggaatacagtgactcccctttccctagtgtttatcttccagcagcagtagttcagcagtgaggtactggggcccatgagcccttctctcctccttgtctgactccgtgtacttatttcctacatgtgatgctgttgggaggagctttgttcattctttgtactaacttgtagatattagtaactacatctttacagcgaggaaacagagattaaagaatttaattaatttacttagtcttgcatctagttagtaagtggtagaactcaaatgcatgttcaggccacggactgcaagaacatactttgcactgtgacataaacacagaattctatgtcatgtctatgttctcttaatgggaagtttgattaagttagttaaaatagatgtcataaacagaaataaaattgttattcttattttattttgtagcttcaccatgaaaataacaaactcaaaagattactttaaatttaacaagtcaatgatcagtaattcttcaaaagttctaatgaagagttatgattaaagtttacttgaattattattgtataaaagaaaatgcttatatcaaaatactactctcagataggaaactataatttttggttgtatagcctagatttcaagaggaatttagaatttctaaacatagcaagttagtggttgtttttgaagtctagtcttcctatcataaagtttataactcacaaatgaacagacacaaagagatgaacttaggggcctggctttagccggggagtaaggagagcaggagaatcaaacagttttcagtgatggggtaataataaggacatctagttattggtgggcttcatcagcgattaggtagacattccattttccagaatgctattcacacccattcatattttggtaaaatattagtaaaattatgttttatcattttacaatgtacacttctgtgatcttaactacattcatgttgttgcatgaccatccccacttcttatctcaagaactttttaatcctccctgattggaactttttaccctttaaatgttcattccattcattcctcataagccctaacaactacttttctaccttctgtctctatgaattgacccctccaggtccccaattgctatcacatggctgacttactttactaagcataatgtcttcaaaatttcttcaagtgctaggatatgccattttctttcccttttaagactgaataataatcttgtgtcaattatttatgatggtttgtgtatccatttgttcatctgtggacccttggtcagtgtctacctttgggctattgtgaatagtgctacaatgaagatgggtctccaaatacctgaatagtctctctataaaatagttatctcaaatgacaatcatgtagcttgtttatagtccattaatcttttaaaatagttcttcaaattttccatgtattttttaaatgaaatatctagccttggtttaagttttgattcataaatgaagtctttaattgaaattttgtcatagtcaatgtttacttaattgaaattttgatttattttggattgaaagaagactttataagttgcccgaagatgttctcccaaccaattttaaaaatccatagttagaaggtatgaacactgtgtgataattacagtatgaaactctacagaagctattgcccctctcttcggcttaaagacaaaagcagggaagtttatagtgaacatgaagctggatgcatagctgagggtcacagagacatactcaaaacacagtttggcggtgaagtacatgggttactgtccttttcattgcctagactttgaagtagaaatagtcttttgtctcattgaataagaagtttctagtatttatcattttgttttacccataacttatagtatttatgtggatttatagcttttctaggctggacaatagaaaggcttatctttttttgtacttaaaagcatacttgtaagtaggagatgaggattaagagaggagtgtagtcatctccgtcaatgaaggggtctttaaaatgtcttataaattgatcttgaaagcacagctctaactctatgtgaattcatggcaataacatgttattctagaatacaggagtgactgatacttagtaaagacagggatgtggccagtcaccacacttacaaaatgattatcttttttcccatctgtttcttgtacatagatgtctgctgagcagtggagtaattatgtaggttacagcgggacctggagctccagtcttcactatgctgcctttgttgtgctctgcattctgagaaatttgcagtgggggtttagttctttctaagaaatggagtaaccatataaaaagaagagattgttttgattttgagttttcttttattcggtgtgcacaagtggtgggtatatgtatgtgtgtatgtgctgaaatggaataaccagaaaagcaagcaagggattgtttgcacattgcaaatgttggcttgctgttaggttgtttgagatactgaaaattacaaacagctttgctttttttttctttgaaagggcttattcagattgagtatgtctgggtgactacttgcattgtaaactgatttttttggtgtgtgtttgataacataatctttcatttttggtagagtggtatgggtttacaaccattgtatacagcgtaattatgttttcccactcagaacaggctattctgtgctaattcttgtgattgattattttagtaatacacatggctcattgtgaataattaaattaaacgagttcttccctttttgtgtaatattggttcttacattagcatctgccagattgattgttcttatgaaaactcactgagtcacttctgactgtacattattgtcatggcagcttattctgagatgttaaggacagacagcttttggtaagtgtctatggcaagtgtatgctttgggggaaatacatttatcaaaaaatataatgcaaaactaataacaaatctatgctttactgtttgaaaagggggaaatggctgagttctaaaatgtataccttccatggttatttcaattgaattaccaagtgaaaacttgctagattttgtaaactatttaacttaagaaacaatttggaacctagattgccatacgttttattcaatattacccttatgtaagcatgatgaagatacttatctgtagaaatctgggatcttcgttttagctgctgggttaatgcattcttttcattatcccaagattgtgctaatgtgcagagatgtggctaaaaaaattggccagctgaatgtagaaagagaagcgaaagagcgtggaccattcccagtatggctaatgggtcccgaatcatggagaattgtctgaacccatcttgcacctcttgccatagaaattaaatgcactgagtgtatcagattctaatttcctatcccatctttcagatctccagtctgtacttggaattcccctgctgctttgattaagtgccacaggcacaatgccttggggcagaaaagcagaaagagccatctgcaaaaagctgtgagagaagctgcaaatggagcgtcttcagtgtcaggcctcctgattcttgagtttgacaggcagagagtaaactacaaaaacctgactgcattcttacatacatttatgaccttaaccttcttgctcccatgatgttgctatttcgcctttctaattgtggacacttttaccacattttgagaatgggggtgggggtggtggtagtggtggtggtggtagtgctagtgatctgaatagtttaaaataatgaatgttgaggtttgggtgtggcaatttcatattaaatttttcgctatggtatttttgagcataagaaaatgcttttgaaaagatttccttaaaaggcaaaaagaaagcctttctctgtgatctgtgccctgctcttagacacatgtatattcaaagtagcagtcactagaagaaaattcttttttttttattactgataaccatttgttgcccttctaaggccaaacactgtgttatgctttaatgttgcatcaagaatatatttttcttagaaacaacttccagatgtctttacataattttgtgctttttaaacaaatcacaaatattgagtataaaatgaggtttgaaaggactacattgtttgaactgcttctagttaacaaaattaattatatacacacatatgtcatatgtggaaagagattatgtagcatgtttttcagtatatttaaattttttaagatgaagaatgtaaaaatacagcctaataattggtgccatgatcagaaaatatttgtattactttttaagatttttaaaattttattttatgtgcatatatctatatgcactgtgtgtgttcctggtgccgcattggatcttctggaatttgagttacaggcagttgtgtggggattctgggagcagaaccaggtctgttgcaagagcaacaagtactcttaaccactaagccatctctccagacttattggttttattgattttacaaccttactttagctcacaaaattcacctgtatatgcacattcaaactgcagggacttcatttaaatgagattagcatattggagtccccatttcctcccaaccccctttttaacattttcacattgaaatacgaacttggtgtccttccttatggtaaaagggaaaataagaaaaagccatatagaaaattctacggaagctttaattacagggattgctgagagcgcaacttcctcttgttatacccagctaccctaggcctgctttatatgttctacaaagtcagtttgaaaggttccaactgtggccacttcattggcagtggcaggcaagagaatttctttttgtttgtttttcaggttgcttttaacctaagtcattctagtaagaatttgttgcttcctaaatagggggagttgctagctagatatcaagcactattctaaggttttgaaatagggatcaaggtcgtatatgaaaagtagtgaatttttcactgatggttagtcttatactactaaaaggatcattgctttaagccccaatttaaactatttgctttgttgtgttccacatcccataccccaggctccagttggttgacaggcagagtatatgcatgatcaattatgaaactcaaacacggtatcagtatcaggcaggttacattaagacttctaacagtgagctgtcataagaagagttaataattgctttgactctaagaaaaagtgcagattttaaaaaactgctgatttattttcaaaagctctcttaagagagccaatatggctttgggggaaaggttttcagctctttggaatggaaggaaaactgagaacataggttggccttcaagaagcctgaaagtactatggaaaaaagaaaatctggactcacaacatcctggagaactcgtttattacttcctctttcctgcatttccacctctaacgcaggactagaattagggagagtcattgcagataatactagatttaagctgctgccactattaaatatttcagtgggaaaggctgactagattaaatttaacagtgtgaaaaatccatcaggtacaattgcttctcgttcaaaagtacatcttaaaaggctacattttaaagtactcatctgttgtgggtggagatgttcccatgcctcaggtagcagctcactaaagtgagattctgtggtctcaaactgtgtgccctcctgtgcaatcgcctcttccactccatagattttattattgcctagagcagcacacttaccccattagcccatgtggccacagacactcattggcacagctgaactctacctacgcgcccccttcttttgcctagagtaaaaggcaacatcattacaaaatctccatttcactcagaataaaattatcacaaggctctgcctacttcccctttctttataatcttctgcttcggtctccacgttccacgttcctcagttagccacagcttggctagcttctttgttttcctttgaacatgttgagcgaggttcctcctcagggcttttgtgcatgccatcttctcaacctggactaatcttcgtccagaaacctatacacttggctcatttcttccctttatgtctcagtccaaatgcctttgaatagtatgtctgtctttttgataacagcaacatttgcctcttaatttaccttgcatctttttgatacttagtttttaagaatagaggctctgttgagactgtttcaagagcccaagccttagagctagcagtggccaccttcctgtgccagttacctcaaccctttgtgaaatcagagaagctaaagaatttctatgcactttggtgtctttggttgtaagagagatgataccaatgtgatatgtttcttgtgaaagctaagaggcatatttatgtaaaaatatcagcacattctggttatgtcatatttctgcttttgaagttaaatagtaaacatagtaaacaagtaaactttaaatatgcttgtaggaatttgaattttcctttatcccttacacatgtaaattaacaggcgttcatatagtatgaaaagacacaacccatcgttaaaaataaatcagtgacaatgtgctctgtcaccacacacacacacacacacacacacacacacacacacacacaatgtgacccttgaacaaagtgccactagtcgatattgtctgttgattgtacactaccaagtaagtatgtccttagttcatctcttcagtttaagccttaatgccactcctttattcaagtctctgattttgactcacagggtacacattcccatccaaaccatttcagaccaggctccagtgttgttttaacaaaattcatatcattgcttaaatgagctactcttttctgtttgcacagagggaggcccatcctcctaagctgcttcccctaccaagccccaacctcacaatccaacatgtgtgcttaggtaccattttctgtgtatattctttcatgcctttctggctttgaacatgtttttcctctgccagctttgcctcaccccatttccatccagtcaactcctactcattattcaagacttggcttgcttgttacttcctctatgaaatttctttgacactccccagcaaagctggttagtcttttgtgttcccacagcacttcgttcaggcctctgttgtaaatatttaacccactggattatcattattgactttatatgtttgtctctccagtatgaaattgcccttactgttagtttaccaagccacgtcaaagcaaataaacacaagccagtctcattgcttggtagcagctttacttgatcctgatagccatgtctgcattcttcctttccatttgcctctgttggcttttgtgacctttcgtatttgagcttataagagatgctgaagctgattgatagtgatgagttgctttaaggccagttgcagttttattgagttgtaggacagaactgggtacagaagactttacagagcagattcacacaagattaatcccttgtctaaatagtcataagagattgatgaagctccacaggaactgatgcttgctgtagagttggaagagacccttagaagtcttctaggcaacctgcctttaaatcttccaggaaatgagcgtttagcttctgtcttagttatttccattgacctggaacgcactactagctaaggagaccctttcattttcagatacctctaacctcactaccttgaccccagttactcttttactaggcgccagtgagtttgaatgccggaagccacagactgcctgtatttagcacattattctttatgaaagccacattaaccagcagtggtaaaaaattactctctgagtaattctttgtcttcagatgtttagtagtggtaagatgcagagttgtacagttgacttccatccacccagccataagatttttaactgactcttattttttaaagctttgaagctactgccatcactgtctatactgtggccctgggggccatagaatctagagatttcaagctagaactagaattagatctttcagttgtctcaatactttatgacatagaattggagctagagttagaacatagacactgtcttgggctatcactcaatttatgtgatagaaggtatacaagtatgcaaatttctatatttttgttttatattaatatatacatcattttaatgaatcctacaataaaagaatcattttataatgtaaagactaatttttaaactacatgcctgacatcatatttttatattaattccatcaaatatagactagtattagagcttttcaatctaaagaagaagactgggccaggaggatggctcagtgagtaaaagcatttgcttccaagccaggtgacctggatttgattcctgggacccaattggtataagaagagaactgactgccacaaattatcctctgacctctacacccatgtgtattcacacactcaataaatgtgatagtcatttaaacctgtagcagtggaagctgttttaggaatgtgaagcaaaacctttagtctattgtgttaggtctctctctctctctctttttttttaatgaaaaaatgtcttcagtgtgaaaacaaacctctactcatgactgaggagctcttgacaattgctggcttctgggggaggctagccagaggctgctaatgctgttcccctgctgggtcagcttcactctagcaggtggccccccactcacagatagatggggggaggattgggagcatggctaagattagtgttcattgaagttcttaaatagttaaaaatacataataaaagtaacaatgtctcaaacatagtagtagttatgttttctaataataattatcatatcaataatcataaactttattttctgtgtactggacctgtactgattgtgttatatgttgcctcatttaatctcttcagcacctacatcaacttgaagtcatttgatttatattctacatagttagggaaatccaaggcttaggaaaattcagttttactgaatgacaattacaatagcacctggatttgactctgatccaacctctaaaacttgtatttcaaagcacaatatcacactgttcttccctcatgagctttattccctcttctttatagagatacttgcttcattcaatcagctaatcttctagtgttatcttcaattgaaaaaaaaaaattgagtgagcatccttatccttcaggcattcagtttctccactctttgttttgcacaatttcccggtacatggaagtttgtttgttccagttctatttatctccccggccctccagttctcttctctgttaaaatcccaaggcactatcttccttaacaataactgactttcactgcctgagaagccagcaactgtcagtagctcctcagttagaagtggaggtttggtcccaccgttgaaaatatttttcaaaacaaaaggaaacctaatacaataaactacaggctttcttcacagcagtcttcttactccagttcagccttatgcactcccatattccaacacgagcctctcattcaggggacatagaggctgaaagctttgatttccctttctgtgtaatgtgggtacccagcctctaatacatttacatggaatactagttcaattctcaggttctaggaaggaacaactctctgaaacctatgactttgggggcttggggaaagattgaccataagggacaggagaatcatcctgactctgctcatccctacaactggtcagatggaaggcatcatttgagcagtaagaagttagtctactctttagaattacattgaagtaagtacccagatttctaggtcatttaggtcaagcattgctttcattttcttttcttcttcctttttttcctttgtaacttaagactcttaaaacttagcataaaagaagaaagttatataagcagaacataaatgtacctatgactgaattttcctcatagaagaaaaacagattttaggaaggaaatgtgtatgtgtggtaacaggctatacctcttctaccagttttagatttacaagaatcaggcttttaaaaaaaataataaaatcatccagaatttgtcatttttttactgtagtggagatttgaggaataatggaaaaaaggaaatacttttaaatttatagtaatatttttatagatattatctttatatttttgagttaaagaataatgaaaactttagaaatataggcattattgaatgtcttatgggttttctcctgatccaagtaagagcttttctttgtctgatccagataaaacatcatcaagaatcctggtatcaggataggtatttttaaatttgacagtgaaaacaactttctatttttattcacatattgcctgttaattataatgaaatgggtagcagtatttggaacattatccatgttacatgtctcttagaatttaagagaattttactaatgtaagatattgtcatatcacatatttagggcctacatatttgctcttagcaacactgcaaattaatgctggcatggatgagaaaccagcaagcggctagaggtgctagcccagaaattagtagcattttgttcctttaggatgtcagggagactaagcagtattcatgtcacttttttataaagagaaatggaaaactgaatttatttacaatgttagccagaaccagagtgaaagaaattcttaatttgtctgtaccttgcctgtagcaaagttacaatttatagaaaagatgaagcaaaaagcaagacttttcatctgtggatatagttttgagaacagcctatagaactgagagatgagtctttctctgtgagaaaatcctccctctggcaccaaggttctcttgagtgacctatactcatgaccattatgaaatttcctggaatagagataatctttggactctctttgctttgctcattattttagtcttgagggattaggggtgctgtggcatctactgctggattactgtgtaggtaccattggtggcttctgaaacatagaggtataaaagagccatgtacctgccacgtgaaggaacccccctgagcagaatccaagtagtagcctaggttagaagacagccaactaggtatcagcagcaggcagttgcatataaaacctttttctccattgcctgctatctggttacattaggaaggtctagcacaagtgattcacgtttgtgtagtcagcttttgagacagggtctcactgtgtagtgcaggcgggcctcggatacgtgacccttctgcttcaacgtcctgactcaaatgctggggttacagacagtgcaccagtacagtcagtgcgacttcattttgtgttttgatagctttccctcttgtctctgagtcatttcttttttcagaagccatcgctgattaatcatcctgtggcttgttctcagttgtcctttcttgccagaatgagatgtgttcctgttatctgattgggagtctactctaaattttaatttcgttttcatgtaggccctatcctacctagcatttcagggtattttgctagaagatgtatttctcaataagcagtcaaactatctttaagttactagaaggatgagtgtctgaatgaagatcagacttcttactgggctcttctgtaggagcaagtcctaggaggcacacctcaaccatcccctggtcttccagcagcaaatgcatacatttgacctatatctacacttggagcctcaagaagagttagttcaccagagtaatggcaatattaaacatggtggcatctgaacccttcataaaacggaacctgtaggttcaattctgtggattttgaggccgatgtggctgaatgagagcagatgtcagcatctggtgtcaagggtcataaaacccagctttgtaggagtttttgttcaaagcagtagatcagtgtatgtctgatgaatcccagttcactcagtcatgactcagaacaaagtcttccgaagtatgaatttagggttccggttaaaaagtctccagaacctaggaggaatctcgtcctgtctgacttagagcaccatcagtgcagttctgcccagtgaatctgttacctagtgtatggattcagcaggagtcttagttctctagtccagaataccttgcttatttcattgtccacagctccccacagcctctcgttgcttcaccggaagtgctagcccagtgcagacacataacctcctcccaccactgaactggtatgtgctccaagccacaactttaagtgtcatttgtagcctgaagtcatagttgctaaagaagtaggaggaaagggtgatgggtcttggtacagtggtaattttgccaaatagttgagtgtcagagttggtttttgctattctgttctcgtgtaaggcatatgctattttcagttcacaattcccagaaagaaacttaaactttttcaaagcacataaatgggtacatacttgtggctttatccttttaaaactgtagattttcttttctgtttcccaaaggagtcatttagaaatttcccccaagttcccagagttcctgttccttcctctgtgtgctcacatcacactgcatacggctgtgtggcagtgcttgtttctttgcttgtacacttgtgtgccctacttaggttgatgatcccctccccaacctcgttccgatatttcaccattgctttcccttggtaattgctagaagttaggtatagaccaaaataagagtttgactaagagacaggtctctcggtatacagaatatacagaagtatctgtttataagataattaaggtaatgaaagcactggcaactgtaatcctatatgtgagatgcaaggaaacttctgaaaattgtgttaagtcataagaagatgaatcactttgtaatagtggactgttttcatttgtagcaatttactttggaattgaggacctatattttttgttttctgcttacaattttaaatcacagaccttctgcctcattgtgttataacagtatcagtcatcctttaataaaggatggggttactcagttcctacatttagatattctaggtatagtgatgaagttgtgatagtctaaagatgtggcaattaaaatacaaatgtggaatttgttcccaaactggaaggggggcgaccctatatacagtctaaatatgaggtgaatgagaaagagcaggagccggaagaaaagtggtaagtacattatgtgtgtgttcatgtgtacattattgcacaaagttatagctcacaaacatttgtaagacaaggtacagtgaagcctttgtaattgtttttgcagaaaacattttattcatagaagcactactacttgtgtaaatttgaatcctcatgaaagagagatggccatttctgtgaagtgttgcttatagttccttgttttgcaaaggctgagtgggtaggcaagggtggcttcacagaatggtctttctgtggtagcggaacaatttggaagcaccaaagtaataggtaagcaaccggaggtcatgggtccatattgtaccatttattagtagctaactaattatgcttaattttgctaatggataaaggcacttaggttctgttggtacagaaataaaacttgaattcaacaaattgaacgaatcgacagaagatattacttaatgactttttcccagggaagaagagttgagctagcgacttagtcattttcatcattaaatgtagccagtacaaagtgctttggaaatccagcctctaagagctgctgtttacagtcattaattgtggtactatccattcccaaaaggatgccacccctttctgaacttgactttcttctcccattccctgtggaataaatatcgcacagtaaatgtctctgtgaggaataaacagtttggaggttaaatggaggactcagtgtaataaagctgacatgctctaaggagaatgtccttttgatatgcatttggtagggatgtattaatttcaacaaaacatctgatacaaaaagttatgaatgtaggccattgaatgtgtgggtgggggtgaggggcaattctagaaagagaagggatttactgtgtttaacagttgccaacagtcaggtacttggaagttgtgacttttgccagacttggaaatcaagttggatcagctctactgagtccttcagtgggagaagatccaaaccaagctacaagatgaaccagtgtatgaattagaaatatgcttaaaacatgtctccccgttagttttcattagtgtgcttactgttgccctttctgtattctgggctcttaaaaaaaggagctctttgtgacttattggttgcccatgtacagctggatttactgtaaaggtctttagtttgcagcgggtgtcatgttactagagtgcagtgtgtttgctctcttgcttcattcctttctacttatttccttactgtggtcattccaactcagaatagttaccatagttccaaagcttgattgaaagattcattcagttttctccaaatatgtaacaattataacaacacagctgtagttaaagttagaatttttcataaatcctcatggttttgcttcttaatcacatcaggctgaattaaggttttatttatttcagtgcggttattgaatacttaattctggaaaaagtcacagtactaagtactatacagcactactgatgaccatcagggtacatccaccttcaaggcgcttacaattttgtaagaaatacttgtctgtacacaaaagatctatgattaagaatgtaaaaaacagccaggtttggtggagatacaatgtcactggagtgggaagaattagttgaggctcaatagattggcactttgaaggaatggacttaaagctgactctctatggacattttaaaattcaatttcaacattcatgggtggagatatagaaagggtagatatgcgttctctatctaaaacacaccttgcactaaatttaagaaggtatgtgttatttagggaagaagtgttaagtatagtacagcttggcctctagagaccaggagatacagtgatagattgtaaaggcatcgagctgccattggaagatgtcaacagaagagcagggttatctgggatgactctggttatctacatttaagatttggaagggacagatattagtaacaaagatgggcacagtgacaagaatctaataccttctaatgacaaagcaattttgaatttgtcttaagctgtcttttcctctcaactttaagcatggatgatttgttttttatttgtgtgtatatgtgtgttcatgcatatgtgcaggtgcccataagaccaagctgttggaccctctggagttgccattatagacagttgtgagcctcctggtgtcagtgctgggactgaactcagctcatctacatgagtagaaagaactctaaattgctgagccatctctctgagtcctcaacatttattattttttttcctgtgtgggggatttattttttaaaaaaataaatattagtctcttaatatcaattatccagtatcaaataaaaaaatacaaccctgaaaaatgcatatgagcatcattatacagactgagcaggttgggtacatgtatctagtaatacatacatgcatgtttgtagcaataattaatgaaaggagaagctgggaatttggaagagagcaaggaggagtatatgagcaggtttggagagaaagggaaagggaaatgatgtattataatctaaaagtggaattagtttctcagttatagacaaaattatttttgtaaatgcggtggggctgatgagatgacccattgggtaaaatcatttgccatgcaaacctgacaagtcaaggctgatgtccagaaccaatgtcaaggtggaaggagagaaagggttccacaaagttgaacctaacaaagttcctcctatgttagaacatttgttaaaatacagcagaatcctgaaaaaaattatttctaaccaaaaatacatttgtggatgacaagtatgcaaggaaataaatgtttgtaaacactgcatggttgttaggtaatttaatatctgtacttattacttagttttgaggcggtattaaaatagatcctaggttttcttaaaggtaaagagtacatcctttgagtagtacaatgggaactaaagtctgagtgttacaaaaggctgtgttttctactccactcatgtagcaatacttttgagtaatctgttctctcttagggagttttccagatttttttttgtaaatatggttccaatttataagatgcagctttattttgtagctgagtgatgtcctaactaggaaacttttagatggagtaaaattctatccaaagaactgggcatgcatggtggccttgactttgattttctgatcttcttggggaggaagctgaggagagtttcctgttcattgcagtaatacacagtaacaaagaaaacatttccagcagttagctagggtcactaagttttgaataatgttcatataatacaaatgaatagctggttctacaaaaaaaaatttagatggctcattgggtgcaaatattgacacacattctcaagggaaattcctgaaataaagcagaacgagaggatggctgtactatacacaatgttgaagcagaaggattttcaagtaacagattgcatcatttaatgcagatgtgttgtagtagattagcactgaatagtaaaacaacttcagacaagtgcccaaattattttatagctatttttgtttttaatatttatgtgtagtctctatttagttttgctgattttgatagggctccatagaaaagcaatcctcatgtggaacaactcagtagctggtgtgtgccccgtgcttgttggctatcttagaaatattgtcctgagaaaactctcatttctaaggtcccaagcatatgatgtcctgtggtagatgatttttggactgacaatacagaattgacctgaacgattaactcaaaacataaacattcatccttccgtttaaaacagagactctttatggctctccttcccaaaaccattttgacttttcccctgtataaaatgtactggttagcatttcacttttgttggaacattgacctgtgattattttatccagtattcctatgtaggcctgtgaaaggatacctatcaattttagtgtcccaagttttcttaagcaaacacatttggtggttctggtgttttcaaggtttccatagaaacaggatagcttgttgcctttttgttttcttcctaatcgttgtggtttacaattctatttatgaaaaggaggcatcttatcctggccaaccaaagcaaaactaggagaaaatccatggtgtgctactttaatatgtcttgtgctttagggaaacctgtataaatccaggagctagcaatagagttagagtggccagatgtagatttttgacaggataacagagcttcctaggcagtgagccatgcttgcaggggaaatggttgtagggagctggcaagacttccctgtgctcgtgaagtgagagccaatgtagatgcatgcggagtaacaacttccaggaatgcttcctcgggacagtaatgatgctttgttgggtttttacctggtatttatttcacaatgtctagatgcgtagtacttaacgtacagtgttccaaaagattttattagttgttgtagctttatatttttgttgggttaggtgtgtaaatctctaacttcaagaacataagcatttcttaacctcctttctccctcttttatggatagagctatctcgcatagtaaacttaattgggtcagatggtgagcaagcaattgagcttggtgcagatgttttcgttttattttctgttttagttattagtggccattgtcacagtaagcaagtggctagtaataccaccatgtgaataaaagcttccaaattcaaaacagttgcaggaagaccagaatcagcaataaaaatgaatgaaatatttattttaaaattaattgtacttggtttagtgacacagatgtatcaaaataggttgtgttatagtgacagttcactggaaacctgcattttacctgacacagtagctttgtaactaggatgttatactgcctgtagatgagtaaagtcaggaaaataatttgttctttttgagcaagctctttatttcccttacaatcttaattacaaacttgatttgcttagcagatccttattttccagactcgctaaaggaaaccttcagccaaggtctgtttgaattaggccaaattttttgaaatagtagagtttaaattaatgagcctttattctgtttggagagtttgttttccatcattgataattatttccaggaaagttaagtccacagaaaatattcactcagtttccttaatgttgtttaccaaagtcttaagaagtagcttttcctttcacagggctacagagaggacaaggcagtggctgaggaaaatgaggtactataacctggtctcatccctctggagcaggctctgagaagccttctaagctaatactattccatgtaaaaagcaaagcagaccttggaatttgaaagtctaatgtgattgatagagtgcatgctagtacttcaacccccatgagccatgagactaggaccttccaagttgacagacattggacagccctgcccagtgtgcactgctcccacatgtctttcagagaatctaccttttcctataagtaagcctcctggtttccctttgtgtctgtctgtctgtttgtctgtttatttattttaaattcttctctcatatattacagcccatccacaatttcccctccctataagggtctttctctcctatctctcctttcccccagatccacctccccacacacactccacctcgcctcacaaaagaggagagcagaggcttgattttcatcaaggcccctttctccctttcgacattggacacttactaacctaaaatctaacagagaacagaaagtggccagaggtttttttttttcgtattctctctctctctctctctctctctctctctctctctgtgtgtgtgtgtgtgtgtgtgagagagagagagagagagagagagagaattggtagctgattccccaggtatatgttcacttaaggagactattatgctgcctttttcatctatgcctacctttgatgtcttgtgattcatccagtttataatatgtctttttataagatgatgtgaaaagcataaaataggttagtaatatgggcccctatatgtttcatgctacaacaaaatggtaataataacagcataaacattaagatgctgttaaactcgtcaggatgcgagcattcatgttttcctcagggggaaaaggcttgtgagatcaaagctactctatgattctatcatggaatattattacctatttatagcactatgtgagtttcagataaaaatattgccaacacttgcacagtaatctaaataaaaactagaaagaccagttaccacttactaaatgaatatcatttaatggctataaagaaaggaagatatattttaatggcatagtttttaagctgagcaataaaagatatgcataaaatataaggataaaagaatttaagggagcatttaccatttaataaagtatatgtagcagaattattttaatgcctattatattaccaataaatgtgtattgaatgagactttctatattttttacttcattcactatagccctacttaccagctactctgtattatatagtagatgtacagaactgtaaaaaaataatagctattcacctttagtgtaattaaattataatatatacatggatacaaatagtcagaattccttttaaatttgggttcctatagagttttgcctagcctaatagatatctccatagacagattagtatccataaaagttatgatgtcataagaccttgagtttaagtatcattctgtttcttttttattattttattctttcagaagcaacttagtttataagatttgtacttggtattaggtgttatgggtagcacatatgaagtctagtcatgttactgaagtgtagtaaaacttccatgaagcaaagtgttccacaaagcagagtagaacattgaatgaccctagatacattcttgttctttccctgtagcaggcactcataagtatctgctaaaatacatcatgttcattgatactccctgatgcccagagtcattacagctgctaccttgtcatggcaagttctgctcccatgggtgatagtactactatcatatgactatgatttaacttgcatggcttttatctatcgcatttcccatcctcaaatgatgctgtcagccttttcagtatcacttgtgggtttttactattgtacatcataggctggaattagcaactgctatttcagctgcatattatgaagcttctccagtgtgttttatcaccccatgttcttttctcatggaggcccttttcattgagctattccatttttgatggtaaaagaatggaaaactatactggtgaaaatgttgtttgactttgaaaattaggtttctttaaataagaaacagagttaaattatgtccttttctatttatcaaggtcagtttaaacatattgaagggagtaaagtaagatctggtctagtttaggagactaggggtggattaaagtccgagagagccttagtacatcaagcaccacacatatctccatgtactaaatctgcatgtggcattgtgctgtttacctgaaaatgagcactgaggttatcttgccctgaccagcttatagtctgacatatttgtacatacacaatcagaacatacagtggctttttaccatggggacaagactctccagttgttagactttaataaaagggaattaaatgtcttattttaaaaatatgtaacttttgccgttgaatgatcctttatgtaaccaagtaactaaggagaaaggatgcatgtgaatagatggaaatcagaataaggaaagcaggaaagggagagaacctcactgtagaagacagtataagtactgtatatgagcaggggagactgtgtatggactatttaagattaaataaataaatgagcaagaaggagatggtaagaaatgcaggagggctgctctcatgcccttatctattcagtttcttagttgcccttggccttaataggctgacaattgccaggcacccaacattgttaaattatgctgagcagtagctcactgttttgcttcttaaacatctgctttcaagtgttattggatcaggatggagctgatcaagtagtaggtggcagaatgatggaatgttcagtggaaacaggaagaagtcagaagatgtggtagcatctccgtcctgctgcctggtagctgagtaactctggatacatggagtccgctgtcctatgaagagtacatgttctctaaggattttcagcagtgccacttggttgaacccatgactacaggggacttgctcttggaggacttctattatagtttctaagactaagggactatttgctttgtctacttcatgaggttttttgaggttcagctatgatgaaaagaggtaaatgtactttggaaacagtgaaataccatgggaaatggaaatattctccccaaagttaccatgtagcggtcatcatgaaaatagttcagtgtaaatgaatggatgacaaattacaatggtcttaggaagtcaccagtacttatatatatatagtagagaaataggtatgtaaaaagtacagacgaactgtgtagtagacacaacctaacactggatggttaagcagggaggctgtagagatgaggtatgctactttctttcccaaccccctctctgttcattcctggtttctctaaaatccttagggagaagtagacagtgggtcactcacttttctctgtcaccatcacctatctccagaaagaatgaactggaacatggaaacctgttcagcagggaaaaggtcatcttgacccagtgggaaaatgtaggaccacaaacccgcctcacaggtgcctctttcacctgtattcactggcatgtgtaatgttgtaggtggccactgtgtacctttgtctgatagtcacctcgtctcccatcgctaatattttctttcatgtcttccctctagcatattactgtcctttcttccttatcttactaaggtaaacagcaagagaggaaaccatctacaaaggcacaaaggaagaggactgaagggaaactatgaagtaggaagggttcacttccttctattgctttctttcttagttatagagaacagaagctcactttgtatctgatatttctggttagctttacttcttcccttagttacctttagtcctctgccagtgataagtagaaaaattatcaacaaatcacacaatatgaaccatcatatcctctgtcacctgtcctagcctcaaggactgatggtaatgttagaaaggacagtaaatcagtaggtaagactggatggctctaacagggcacacaagttagagtaataacacatgtcttacagtttataaaattcaaattatagatttgattgtcatggaaaaggggaaagaaaaataatatgacatttgtggcagacatgagacaacttattcaggtccaaaaagcagataaaaaatcagaaacaggcccatcagcctagatatgtccaaatcctagtactttggtaactttattatgacttccagcagattaaatttcaagctgtggaaaggcttcaggataagggaatgcttagaatcccactaataagacttattaagtttagacaaaacagatgtctttcaatggcaacagctctgaatcaccaagatgaaaatgggagaagagaaggagggaaaggagcgagtgctttcgctgcagcagtctgcagcctgctcatccttgtacgtcaagctacaagttaaactccccaaaaggaagcaccattaagagggaattcttgaaactgactgaatgtatgtgtatttgtggttattggctacattctgggatatgacaaaggcaatagacaccaggttttgaagtgggcattgtcaacttcaagttttctcacctattttgtgaccatagacaagttgcttaaatctcaacttcattttcttcacatacatcatagcatttatgtactttgaggactgaacttctagaagagtccatgcataacacctggatcacagtaagtgctcactaaattttgattctttagtggctaaagctgcttttgctcgaagtattgtgtctaagtaggttaagaccagtcttctagaacttggtaggaagagttggttagcagctccaaagtggggtgtgtccaagtgggaagaaatattagaaattctttccaggattattttatctagactatgtgaagatatttaagccctactaatatatggcatttgggttgccttttgtaccgttctgttttacacattggcgagtttccctaacattaaatgaggagttctaagggcagctctgattcactatttggtgtgctgtggtcatggagcctgctgtttcattcacacttagcacactccagtgtatttcagtttacacatggctggttaagtcgattctttcggcttgcagtttctttgtagcaatcttcttaagctgttcaaccagttcacccaaagctagataaagcaacctaagcaaaattgacatagcttaaggtttcagtaacagaatgagggcgaggactggcgtgtcaccgcttttcttgccaacagaaggcttcaacccaaggagtttggaaaggaaggaaggaagctactgcctttgggggtctctgagtcctcctccacccgtccatgcttctctctctgcctcttttggtctctgcctttgcccctcatgccctcacccctccactgggccactctgccaccccgtctcccctagctctttagggagttgtctttttccttctgatcattttgttagaatgtaaccagtaggatagaaaataatacacagtgattataatttcatgagcagtttctttatattagtgtatgttaattgtacaaaattggtttcattgtacaaactaaattgcttgataacatctcttggacagaagtaaaatttgccctagagagttaggaaaaaaactagttcaggaaatccaagaaaatattacataacatatgactgcactcttctgtgttgatgtaattattgaagaagcccacagcttacttggcgaaacaggttcctttctgtaaagttacctacaatcctaggtcatttggcacctaacaaactagtagttagatcttccccaaaagggaattaacctatctgatcattcctcttggcgttttataatttattattttaacaggcagtttacacttgttcatgtgttatttagtaatcgacttactgcaagctgaacatcctttatctgaactgcttaggatcagaatgtgcttcggatgtcagatgatgttccagtgctgggggatttgccatacctaatctgattctgcaatctgaaatgctctaaggtctaaaacattttgagtcttctgttgatactcgaaaagttttggattttggagcattttggcttttaggttttcccagtaggatgctcagccattcctattattagtctctgttttccctctcataaataacagaccttaagtgcttcatagatcctttgaaaatgaaagaaaatgaaacaaaggtttttcaaagatgcttgttaaaatcttcctgtggtgggacagaaagccaagcttagtcctgtagctcccttccttttatcaaaccagtccctgggtgtaaacttagtaaatatacccactatcagagttcttcaacaggcactacttaagtatctagtgtatgcaagtcacttctgcagttgtgattcattattttattatttattctgcagttattatttatttacttttattaccgtagtagcactgtgagaccagggactgttctggtgaaaggaagggagctagagcttgactttgtagtcgcactatgggaagattttaacaagcatctttgaggggcctctgtttcattttcaaaatacttagcaagcacttaggacctgtcatttgtgagagggagtgcagaggtactattattttcttcattttacaaatgaaacttccacagattaagatatcacaaggctagtatgcggtgaagccaatatccacatgcaaggatttctcattccacaatacatttgattctatacaactataaaatgtttcttatgtgttaactacaacttcaggtttgcatttgaggtgctctgtctagtggctccaccattaagacatgctttcagtgattgcaaagagatattcagcctggaatataaactaagttttaaaattctaagtattttaagaagtaattcattgagagacaagtgtaaaggtgcttgcctgtaatcccagcatttggacggctcaagcaggaatattgtgaattggtagtcagcctgagctgcagagtaataccttgtctcaagaaatttaacaaattgggtggggtgatgcatgccttcaatcccagcacacctttaatcctaggcagaggcacatggacctttaaaattcaaagccagcattatctacataggcctagctaaatagccctatctacatagttccaggctagctggggctacatagtgagaccccgtttcaaaaccaaaaccaaacaagaaccaaaacaacaacagcaacggagagcttacaactaaagtgaaaccatagtgccctcatttagatgagggagagctccatggaagattctagtctgcgtcagctcattattagattgcagccacttgaaatcagaaataatctcgttttcagttttgccaaaatggaaattgttcgtggccatatcatagtctgttttccaaacccacacagtctttccttcccaatgtgatgagagtactgttcttactgtgtgtagtaatggatgactcaaactcatactgagtcttaaagatgaacctgactcatgcagtgaaaaataaattatcatttgctctggtaggatgtagtttaaagactttcatcagaaaaaaaaagaagcaaaatttaaaacacgatttcatgttgtttgtttccaaaagcagagtagagtaatccagcagcaactctacagagaatgtgttatgtggacgttgcacaggaagaaatgaggtatatttgccatgtgcacatttagccatctgcttctttaggtagcatacatttggcactcttcatcttgctcgactaaatcaaatttgcagccagttcctctagtttgcagcatacagagacagattctgatgatactcttgccccaggaggagatttctgatggacggctatgactgtctcaaagaacataggcttttacaacagtatttcctcttttattttttgagattataatttaaatatatgtaggtgttttaagaatccaagaaccccaataaaagaccaattgggtgatagcactcttgaaggctaaatgaatttcacaggagccaaacaatacctagcaactggtacagaagttcctaggaggttccttgtttgtacctttgcatgtaggtctctactggagacttttctcggtgtcctccgtgtgtactctcccacccatttcctcatttcttttcttttccctcctttcagccctctttggatcccagacctgtgttcttttctccattcctcatgaattgcccattatcatataacactaaaatgggcatcagagttcaccaatagaaacgtctgttaaacagccagtaagttatctgtaaaactgttaaggaaagaaagaactgtggccaggcaacagtagacatatggcatagagttggaaatgtcctttccctgcataggcagtcaaggtcactttcatctcgcttgttggcagtgtgcttaggtttgagcattacttccatgtttgcattttggtttgtgtcccattgtttcttggttttgaaaaactaaaacacactactcagtgaggaagagaagctctgtgtaaattttcagatgggggtttaggattctagttctctacgtttctgaggtgcaaaggtgttgcatatgcattctgttctcagggtcctagtgctgcctgggaatggcaaaacaaggaatttcctaatggtctaaacctctcagaaagaaatggaaaaagctagttcatacacacttcacttgcttctcttttacccaatagcagtgcttagttgcgggtttaataacttgtgctgcaatatgactgtcagtaataggaagcccctgtcactttggtaacttccgactgcttaagttattagccaactgactctgtttcaggaagcgaatggctgccttgccaggtgcgtcccagtcattcctgttgtaagtaagaatgttatttaggatgagccttgcaatatctaatgttgtgcccttttcagcagtgctttatttcgtttttagcaaacaccctcacaaacctcttgattccttgatagctaaagtcccattttcttaactttttcgttgaagtgctgcttaacattagcttctaactgacagacattaacactgcttctcacttaggtgaaatgtgaccgtggcaaggtgccaggtccaactgaatacattcaaatttggtgtttgaactaaattgtgttttaaattcatcaccatcatatggttaatggggcaaccagctgattttgttcataaacatttggttattttccctaggactatttaaacattagagaatggcttcctatcatttcaaagagaatttcattatcagtttactaggaaatcctcctgttgaattcttaagcgccctccaatttaagttggcagatacttgttgggtataaaatgtttttagtgagccaggcgtggtggcgcacgcctttaatcccagcacttgggaggcagaggcaggcagatttctgagttcaaggccagcctggtctacagagtgagttccaggacagccagggctacacagagaaaccctgtctggaaaaacaaaaacaaaaaaatgttttcagtggacactattcatcatttatttttgtggaattccagtggccaagaagtctaggaatatttgccatttggctactaatgaatgcaactgaattgattgtttatatttttttaggcagagacagtacaggtttcagatcagaattgccaagtaagacaattgttttgtgttccagttaaaatgtataatctattcaaaggtgaagactaacgtgtggttagtaaagggaatttttggacttgagcctaaaaatctgggttagagacttacctccgtctttggcttagctggatcatctcagctaagtcattgcccaactttagaatgcagcatcttctccaaagccctagctttaacagtgtgtacagagtattctgaaaggagcctggctgagggaagctgaattctctcgtgtgtaagctatccacaccagcttggcagcttggcagctcggaatttgcattgagagccattgatgtttctttgctcacaagtttaatgaaaagttacttggagttgggaaacaacgtgactactaacatttccgtttgaatttttgatacaatcagatggtccccccccccccccgtgcctaacatccctttacttctcatgtcggagctttgcagcactgtgcttgagccctaggacagtgacgtaccatgtcatcttctatccgttctcacctcactcttgttctagagcttttctcttcagctctagagtgactgagcagcaagcgcccacagcatgagaacaacttgttccagtttaggtacttgaaaatactaatccatttgaaataggttgaattttactggccttgaattactcttttgttggtcagtttaggaaataacacacactacaaagtattgagaaaatagctatgtaatgacttcatcccatgtattcttttagtgaaaaaaaaaaaaagatctggatgcaaaaagtttatgttcttaaaacagacccagagttattatacaaaatggtgattcccatggtgggaaccatctgattatattaaaaattcaaacggaaatgttagcagtcacattttttttcacccatctccaagtaacttttcattaaacttgtgagcaaagaaacatcaatggctctcaatgcaaattcctggagaaatacagtggcagtgaaagcctagcagggctctaagggatcccaaagagatcaacaaacaagcaaagcaggcccagagttcttagagaaaacaacaaacaaagcagtagatgagcacagtcttggtgaggatgttaaaatcagggacctccatatgtcggagatgggaatacacagttatgcaggtctttgtgggaactcttagtccctcacaaagttaaagacagcattaccttttttattttaaaggtttgcttatttgatttaggtgttttccttgtcctctaggctactgagccatctttccagctcaacagaattaccttaattaccttaatgactagtctttactagtatttaccttaaatgctagtaggtatgtacccaagagaagtgaaaaactcatgtcttgattaaagctgatgtagatattcaagcagcatatttcatttctctgtatttttctctgttgtaagtctaattctacatacatatgtggccaggaactggaggggcgagggggctgggaagttgtggttaatggggatagtttttcagttgaggaatctgtgcatttctggagctaggtgatagtgaatgctacatgaaaccgtgaagatacttaattctacagagacatagatatgtacaaatggtgaaaacattaagtttcgtgcatactttaccacaataaaactccctccctaattcccaaaaatacattttatgatgctaagtatagagggtttgttcctttccttatgtcctttttaatgagaaaactgaaaaatgtgattggccttttaattagctggggatacttctgcacaatgtgttagcattttattccagcatttgtgtgtaaaaggtggttaaaaatatgtcttcaacttgcctttggatgagaacttgagaacatttttaagatctttattgtcagtaggaaaataaagggagccaaaccatagggcatttatgttgttaaactgtaaaacagtgaaatgctgctttcagagtaagactttgcaatttcctggttttcttggttgattttggcttcttgagtgacatggccatttctactgtataaatatgtaacatctctgcatcttcctcagagaatcttcttttgtatagttagatgggaggagcaccagagtgcactgaaaatacaaatgcagtgagtttcagaatgccaagaagggttagaaagtgggggaaaggtgcaaagcgagagcccatttaaaatacaaaatgtacaaggagtctgcattttggctgagtcagttaaaagggaatgaagttctttctgaaggctgtgggacttccttatgtttctgagtttgtaatctatgagaaagaaacaatgaaaaggttttctaagatactgggtcaatagtttgatccatatgttagataatcagaggtgtgttttgcttgaccaggaagtggtttcgtataaaagcacagggcatatggtgtgtgtgacaggcagggagacagtaagagggggtggggacggtactgttgatttagctcttctactcttggaagaaaaccattttcatcctttacaagggtctttctggagtttggcacagtggcacttgattaaagggtctaatcagagttgatgtactcagaactccactgatggggttaatggcctcactagctcctcctaatcagacctccgtcgcacacacgggcccttttccttgtccttccagagcttttgagtcctgtcttccgttgccctttgtagggcacatgagatccttgtattttgaagagactctgatttgaatgattattttcttttactttgattttttttctgtgatgaaaaaaatcatctttttgagttatttaatgctctgtggtagccgttgcaagttgtattaatgtttctctgttttacaatgtgatttcctctatggaagaaaatcatgtgtgaccagtcattgactcggaggtcttccagcatgttcccactactctagtttttattttcctctaatggaaaagacagcatgttctgcatttacagatgatccagagaaacagagaaagtgctcttgaggaggttgacttgaaccttcactctttccagctgaagtggccacgggattggccagtaaacagactctggtaaatgaagaatactgacttctaaaatggcccttgatgaccacttgtgcacctttgatacagttctgctgcttcttagttatttacctgattcaaatgattgccagtatttgaactgaacgtaggaactgtcatatccagtgatggctttaatctccgctctcttcaacagtgcccttaaagacagccgttttccaccaatgacaagggatgagctgccaaggcttttctgctcggtgtctctgctcactaactttgaagatgtttgcgactatttggactgggaggtaagattatagacacgttacatgaaggtgactcctgagtagatgttaacaacttggaccataaagtgaagctttccatccattcttacccagaaataaagctccccgcggaacaatgagatatgattggcttttttcttttttaaggcaactataccctgtgctgttagaatctcgaaactgaatttggtcttcacttttatgctagctcacctaagcacccaataaaggctgttaataagtagtgagaaggagtgcctgcaatctgtttctccctgcatttccattccattctagtgcactgtactgtatgtaactgctactgagcatttagacagtctgagtatacatgttagaaaggagcagcaaaagttagcataattattatcatttgggggaaagaagtttgtgacaatggcagtaaactagaatgaaataatgtgagtttattcctggctacattaatatagacatttgaaattacagcaacaatactgttctatctagggtatgtctgtgcattgctattatcagagaaacctaccttaatcatatctttatttgactttactgtgtgggaactttactaagctctcatggcgatttactttggaggttaaaattgctgagtggaggtcttgcctgtattcctgaataccagctgtgttctcggctttgttgtacatgtacagaggggcgagataggctctttaccttgattcagagagaaatttatatataaggtatgaagaaacgtgtgggggaagattgaaaacaagggaaagatgctgataaatagcatcctctcacataccacttagaaaccgaactactgtacccttccaagagcctttcagtctactgctgttttcgaagaatcattcctattgttactgagacagccttgtaaccagatcattgtcttcatagttaattggacttgaattttatttttgtttttttttatgacttcttggactacagatagttgacttcaccatagtttacttcttctgggtacagaataatattctggagatctgtctcagaagatctctgatctgaattatttttgtgacaccagagctattttatagctttttgtatccgaagatgatgaaagcagcccctctgggttttctcattggctttttgtgtccttatcagaaaatgaaaccatcctaggatctttataaaggaagaaataaaataatttaataacagttatactagaaagtttgaaaagtgtcaacccctttatagaacggaaattccctactttctttttgttaagtctgacattccaatttgatccccctttcctccttcttttccccttatctttcaacctttttgtttgtttgcttgagataggctgtcaccatgttgtccaggctgcccttgaactcaagatcctcttaccctctgccttcctagcagcaggaccacaggtgtgcttcacaccatgagtgctgttgttgttttgttttgatttaatggttccaattgacgtccctatttatgaacatttactatgctctgtatggctatacttttactggtttggaactgttgctttttttttctctagccagagtttaatttttgctctgtagagtagaaaatgcagtgtatatagtggtggtgtggggggcgagaagcagggaaggcctcagatggaggggatgaccaagctacagaagcacttctaccctcattgcagccactgagttgaaaatacagtgcagcatgggtgaacacattcagatgtcttattcacacgtgcttgttcagtagtgtgtgtatgtttcatgggaaagaaaaaaattgcgactccaacaactgataagtaggtaggtaagaataagcacagaattagcaacagcacctgacatcacatcacaggttctcatcagcaaaagctcacctcgctatgtggctttgatgttcgtaaaatgtatctgttttctactgggtggatgggaagtacagcaattgaaatattagcactatgtattttgtcaagtattatttatcttttgtggtcactatctgtcagcttgaatttctacaagagtcaatattctttcgacttcgtgtttgggaacatacattttttaacatttttttaaaaaaatgtatttatatgagcacactgtagctgtctcaaacacaccagaagagggcatcagatctcattacagggggttgctgggaattgaactcagaacctctggaaaggcaggcactactcttaaccactgggccatctccagccctcaatatttgtcttattatgtaaccttctcttgttaatttaaaacaatacacatggcttggtatcagcatttgaaagtgaattacacactgctagaatggtggtactaggaggaacagactgtctctttctgtgatttcatcagtgtttcaaagaagacactggaaactcacaagaagtatattctcaaagagtaacaattgcatttgtaattataagaatgtgagttagttttaggtgtactgttgtagttgaaaatggaatactgttcttctaggaaggatagtctaaaggttgcctttggtaattaatgaaaaccattgctatttaaacagagtgtcaaaatggaagtaaacattttttttatttataaactgatacagttccacccttagatatctgcccaaattaattcaaggctgatatggaaacaaaatcctgaacaagaatgctcatagcagtacttttcacagtaatcacaaactgaaaacccaagcgtttattaatacctatgtcgatatcagccataacccatgctttagcatggataaacctaggaaacatcatgttaaatgaaagaagccagacatgaaatctcacatactgtatgatgctacttatatgaactatccagaatagacaaatctctacaaagattgagggatgggaaaagcatgaaagggaagtgactgcttagtgggtacagcatttccatttgcagtggtcaagtgatccaattagtgggtgttaaattttacaaatgcacacacacatacacatacattcgctctctctctctcaccctctctctctttctctctctctctttctctctctctctttttctctctctctctttctctctctcactctctctctctctcacacacacacacagagacacatagagttctttcttagtaattttgacttatttaagagaacttaactttaaagtataagaaggaaacataagtccctcataatcttcacccttttgcttctgagaacagtcaggtccttggtaccatctatggcctgtacaggcacatatttaagcagatgcagactgaaaaaggttggaaaacattatttctatagcaaaaatatacacttctgttattgcatttagatgctctaaactgtttctttacatcctttgtctatcaatacatttgcacgcttagttacatgtggttattaggtaaaagatggctttgtatattatttaattatatatttttgatctttcattgtgaaaaatctattatgaaagttataaccttctctttgaaaaatttcccactgtcaaatattagacctctttcccctgaatacaataccctattttctgtatttagttttaacataaaacacagagtccttatggcatatgcttatgccataaggaaaaacaaaattattttcaaatttttaaagaaaaaataagatagtacacttgttataagcagaagttgggataactgatgacatgtgttacttcagcagaatccctaattagagggatcctttaaaggtatgaaaagtgagtgatttagggaaaatcgtcattaactgatatgttgtcatatccacctgcaaagctaaaatgattgttcagtgaggaaaattccaacacaatctccttctcaccaccaccgttctgtgttcttccactgacagcgttatgctaattctaaatgacaggatgattgacagacatggcactttacaaagaaagcaaacctcatgtagcatgttggaaccttccaaaatgacacatagcctgcaagttccactgtttgggagttgtgtttctccttgaaccactatgaaaggatgtaagacaaatggcaatcagcagagcttggtggcttgctctaggtccagtcacctcagctgctcattttcaggctattatcaaggaatcagatttgtgtttgtagcactgctgtggcatgcgtgctaccaatgattttgttgggatctaatgtaccacagagctgacaggagtcaacatagtttctaacttataaccaagcatcttttacttctgagctttagagggaagatcatttcaaggcatgaagaacagatgttttctaatgtatcctaaagtaaaagcttagatcatatttagataagttaatgacagttgcatgaactagaagactttttcttctttatctgactttgaagacagctttttgtgtgtgttgtgttggggggggggtcacttttagtataccacacttacatagatagaatcatcccatgcttaatggagctggccagcaggatacttgcatggttctaaactctgtccctggactattaaagctagaccttgtgtctctagtctctcgctgtccccacctaatgtaacaaagcatctgtcattgtatgtgagccttgaggactcctgctactcagcgagctgtacttcattttcaaaagaacctctaatgcacacctctccagcgatcacagttccatttctgatgtatctggctgcagttaataatagggcgctttgtaatagccttcgtgagaataaacagatgagatgaacaaattggctactgtcattatccccccccccatattttaaatgctaatattttccttttcactctccttccccccataaaggtttccattttttttagatcctcttaatgtacaactgaaaaacagagtccccattcatacacagatggctagcatgactcacagagtcaccaagcaaaatgacttctagttgcatatatacagtctgtttccccccttgcttatttttcgtcaactatgatgtacattatgttctgttttatttctgccttaaattcctgcctttgtgaacacgagacaacaacaaataaaacagtctacctagatgaggaaatttctctcattgatatttagaaggaccttgagatggagtgggagatgccactgtggttatggaaatgcagtccttgtcctgaagccctgctctgagtgctctatggagtgctaggggccattggggagggaatgctttgcactccctggccatcagcagaggatttgttaggaatcatcaaggcctcggagggagcaagaagcctaacagggaagcaagcagtaaagcaacttcttagaagtggatttatcccataaatatatgcattatccatttggatccttagtgaatgaacaacagagtctgttctcaggtttcctgccttcctgtctgtattgtttggtggaggaagtgtttctgttatttttttttttcctcttagaatctagactgtcttccttctccttccctggaggttcagttacagttttttcatatgcactttgcatgtgtcccagcatttaatttttttcaaagtgctgcattctgaggaaaaggagacttgggttctgtgacctttctggtccgcagtttctatactaggaagttgaaagggttggactaaagtctcttgacagagtgtagttctgtgtcagagtcccttttaaaaaatggcttctgttttattttatatgcagagaatgaatcagccatttagaaatcataaaaagagttccctaacttttgaaatggccattgtcaatgtaaatgttggccaaaaactgtcaaaagaatccagttttttaaaattatgcattctccatttcattttcacaaagaattctctttggtaacaatgaaatagagctatcaaagcctctatttcattactgcaccatttcctcccttaagtcagtattttacatgtaaatgtaagtgcaacagttgcggtagggagatattattccttttataaatggtattttgctttacagaaggacacagtatactttctttattgccttcctcataatttcaagattaatctattttcataaatcccagccccttataactgttcagaatcaaatctcttttgtaaactaagctaactcgtattgagtcacatactcaatgtacatttagaacttggataagatttttcttagcttatcaggcagacattccctacagaaacttgtttaaccagagatgccctctccacccagcatttgaagagtaaactaagctcaaaaatataaattacttgacttccctcctatttaaattcatctcctttgtcatttcttttttaaaaatggtaggaacgcatttctataacatttgatgataagcaggctttttattaaatgccacctatgttgtctgaactttgcatggtaagcttcagtgtgttcaatttttctgaatgcgtattataattagtctatatgaagtgtttttcccataattacactctgagctgtcatttgctcactgtaaacttttgagtaagaacattttctattattgcaaatgatacattaatatatttggcttcagagctttttaatgtactacttcattaatactgctttatttcaaatcttaactgattattcacaagttcatgggggttattgttagttcaggtactttagtggcaagctactaggtaaaaataaatgttatatctgatttttgttagtgaacttttatggctaaattgacatgctcatgttccttatagataagaggtctaagtttcctgcatgaagcaaaactactacaaaagctaagaactggtcctaagagactgaactaatttattgctaagctaaagtgactaatttacagagatttgagaccagagcagcatatatatattttattcaagggaacacttgcagttattgttacataacaagaaaaagtaatccattaactgaggtagatgatgaaggcaggtttttatattcagctacattaaaatattactaatgcccgagtgatgaatatgtaatcagctatctcttttgatttatattctacaaaacttctcaagaggtattcagagtgcttgaagaccccggtgtgtgatagataaaggcagcctaatatgcacaccttattgactcagttcaggagaaaaatgtttttaatcactaaattactaagtcactaagttacatgataatcatactaggaattacaggacaatcacactaccttttccttctttatattcttctaaagagaagttccatatgtgcagctcttcttatattcatggtcacagttagttgttaaaatttacaacttaaaagttactaatggtgggggaggatatccaaatttcagaaagactttagaaatttgtaaattagccagtttgttaaccagatagatagctgcagaacttcagaatttctacttaaactggtgggcaaagaaacgcagccaaccatatgaccgagaatgtaaatggaggatctagagcatatgtagtctaaacaatgctttcaggagtactgaatttgggggtaagaacacaaaatcttacaacagaattaatctagattacaaacttgaaataggcggacccaggtttgagatattgtcatctcttacgttcaatttgcttttactaggaaaagtcaccattgtggaagggagctggagtcaggtagaatctcctgtgatgggaggagtttgagagggcagtatagagcactgtgggtttgtagtatttttagagaaaagaagcatcaagtttttccacctagaaatctgagagatgcagacgctgggtcacatctgtggactgtcctgtgcagcatttatttctggtcacacagccctaggcttctttctgggtgcatgtgtatatcatcagtggtgcaagccttgaaagagttggtagtgtgccaaacatccctgcttctctcattaagaactgagtcctttcatttacttcaatggtactggtatattacgcctggcaggtcagtcttttgtgaatggccagtaactggctgtgttgttaattacaaagcatattttgccaaatgatttcatccaaaaaagcatgccaaacaacttttaattctctgacctcctgctatatatttctgtatattattcaagatgaactcactggaaaggagtgtggtgagccatggccataccgttaaaaaaaaaaaaaaaaaaaagcacgaggctccaaaaatgggaattaatggaactggccctgccaacagactgagataagatagcacctaaggaaactgattgatattcttggcccaaatattatcaggtgcagatttaatttcaaagtcaggactttggacataattttagaccctaatggtcaaaggtttcatggaacccattcaacttagctggcacacattttatagacaattatactcttgcctagacgactttctctttcttccatcatgttttaacctattcagattgtctgctcactgattaggctcaccagtaaaagcaggatccctttgtaatgctgctaacgtattataggactagcacttgccttacagatagacgagggtttattaagctttgactatgcagctgtagagtgcataacatggactatgtattataatagagtgggagagggcacttttttaatgctcttaggttgagggccactgcattagagactaataattttaagcgaagccacatttctaacaaggggccagataatgaggataaatgaaatctgtactcagtctcagggttcatttcagccattagttataatctcttccaccaaacctttttttttttttttttttttttttttttttttttttaatttcaactgtttcttttttttttttttttttttttatattcttttttttttttcatttttttttattaggtatttagctcatttacatttccaatgctataccaaaagtcccccttacccacccacccccactcccctacccacccactccccccctttggccctggcgttcccctgtaccagggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacatctgggtcctttcgataaaatcttgctagtatatgcaatggtgtcagcgtttggatgctgattatggggtggatccctggatatggcagtctctacatggtccatcctttcatctcagctccaaactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttggctcccttgtcaaagatcaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatggggattgcattgaatctgtagattgcttttggcaagatagccatttttacaatgttggtcctgccaatccatgagcatgggagatctttccatcttctgagatcttctttaatttctttcttcagggacttgaagtttttatcatacagatctttcacttccttcgttagagtcacgccgagatattttatattatttgtggctattgagaagggtgttgtttccctaatttctttctcagcctgtttattctttgtgtagagaaaggccattgacttgtttgagttaattttatatccagctacttcaccgaagctgtttatcaggtttaggagttctctgttggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaagaatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccgtctggtcctgggctttttttggctgggagactattaataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgattgtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgttttttcttgaaggcactcatagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccatgtgaatgttggctttctgttatttattttgttattgaagatcagccttagtgcatggtgatctgataggatacatgggacaatttcaatatttttgaatctgttgaggcctgatttgtgacctattatgtggtcaattttggagaaggtaccatgaggtgctgagaagaaggtatatccttttgttttaggataaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggcgcaatgtgtgctttgagctttactaaagtttctttagtgaatgtggctgctcttgtatttggagcatagatattcagaattgagagttcctcttggaggattttacctttgatgagaatgaagtgtccctccttgtcttttttgatgactttgggttggaagtcaatcttatcagatattaggatggctactcctgcttgtttcttcataccatttgcttggaaaattgttttccagcctttcattctgaggtagtgtctatctttttctctgagatgagtttcctgtaagcagcaaaatgttgggtcttgtttgtgtagccagtttgttagtctatgtctttttattggcgagttgagaccattgatgttaagagatattaaggaaaagtaattgttgcttcctgttattttagttgttaaaggtggcattctgttcttgtggctgtcttcttttaggtttgttgagggattaccttcttgttttttctagggcgttgttcccgttcttgtattggtttttttctgttattatcctttgaagggctggattcgtggagagataatgcgtgaatttggttttgtcgtggaatactttggtttctccctctatgataattgagagtttggctgggtatagtagcctgggctgcagtttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatatgcatctcattctttagatttgggaagttttcttcaataattttgttgaagatgtttgctggacctttgagttgaaaatcttcattctcatccactcctattatccgtacgtttggtcttcttattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactgggcgaagtgggtgtgctgggttctggtgatggtgagtggtcttggttcctgttagtaagattcctccgtttacctttcgccatctggtaatctctggagttagtagttatagttgactctgtttagagattgttcttctggtgattctgttaccgtctatcagcagacctgggagacagattctctcctctgagtttcagtgctcagagcactctctgctggcaagctctcttacagggaaggtgcgcagatagcttgtatttggacctcctcctggccgaagaagaaggcccaaaacaggacctttctcagacagtgtgttgctttggcagttcccaggtggtacagactctcacctaagcagactaaattcctaagttccttggagtcccgggaccaagatggcgaccgctgctgctgtggcttaggccgcctccccagccgggtgggcacctgtcctccggtccggaaggtggccggctgtccccggcccacacagggtgctgcctcagcgcctctgtgcttctgcctgttccagaagctgtcaggttctctggcgcaccctctcacctgttcagactaatttcctaagttcggcgggtcccggaccaagatggcgaccgctgctgctccaccaaaccttttactatgaagcaaaattgattaatttgcatctatctcttttccctgcacccacatgcttgctgatagaatgaacaaatagagaaatggatgagagaccaaagatgatgggggctgagacccagtagactcggggacacataatccctaaactggagaatcatgataatacatctgaggggtcaacattaatcttgacatgtaatcattcagaacaatgttaaaaacaaaagattgtatagtatcattagtaaaaattacttgcaatggaagggctcagaataaacatgactttctctttagcatgaaatagaaatttgttgaactggtcttaatgttctctcagcacacatagatataggtccctttaattccatatcctcttatctataagtcttgcatttaatttactacaactctagttgatttatagttctacatagcaaaagtacactcttgattaaaacaatattatagtagctgatagaccttgaaagcattttttttcacagacattctaattattttaaaactgacctgcagagcttctagttgaagctagatttgtaagcctccagtttttgcccacttggccatatttctgaagactggtacagtccattagggatatattgccattcttttcctagatgcgttctctttctccatcctaagtagttactaaggtaattatagagcagacttaacttcagggaataccaattctctttgtaactgatcaatatctcattgataaatacaacaatagctgtgataacacaggccagcaaagcaatgcaagggagaacacatatatttttgcttacaattccatggggcatatagtccattgtagtgaggaaggtaaagttgcaagaggatggggttagcacctcacattgcatcagaggttgggaagcagggcagaaaatgatcaagaactgtgggacgaagctataaaacctcaccctgcctgtaaggctctaccttctaaaggtccccgactggagaccaattgttcatacacaggagcggggatgctttccacattcacatcacaacagtgatttttttcagtcgagaagacttagtttgcaaagctggtgatttccataagtggatcagaattggttgtgttccacagagtaccaatttccactctcctgctttgactcttcaatgtatctgtttgttggcagccatggtccaaacatgatttaaaaattaaaaaaagctatttctaaaagagtaccaaagaaaacattactcccattctccgggttctgctagttgaaaaatgagtcaccctagtttgggcttcctagctttgtggcctatcttcctgacctattaaaacttgcttcacaccaagccgttactttgaaatcaccatatttataggagcttttccttgttcaaatcagaggaacccagaaaagtgtttttcttttaaatcaaagtggttgcctgggccttttcacaatacaaaagtaaatcaacagtcttggtaagttttattttgttcaacatgtccttcattttgatctcatataaacaggtttctcgagaaacaatttattttttatttttttaggaaacgattattttaattactaaattactaggatttaaaatctcaagagatttctatagaagagaattgtgttcttatttttaaaaaaaggatttatatatctaatctactcctccatctgattaattatttttctccaatatgtaggcgtgtggtttgtcccacttgcatggttggttagtagagattatctggtttaactagggtagtagtcaccgtcaggagttgacccttttccaaaccatacttgctgaaacgtgatctaccctgtaattctaatcaagttttcacccccttcctcacccaaagacagttaaatattgctcaacgtgcagataagaaacctgtctcagagttttgactagacatcttaataacaccaaaattatcttcaattttaacatgacagatttttgataaatagagttaaagattcaaaattgactccggtgaatgatagaggataaattacatgtgctgtgtattttgaagaaccaaattatgaagcatctgatattgtcactgatcaggaagttagtatagagaaagtatcaaatttgtcattgccttagtgctaagtcagatattggggtggttggtaaatgcccttcatcctagaaatatctgggaactagacactcatatttcctctcagcagtccacagtcacagcccatggggtctgagaggccttactgtggtggtttttaaacagctgtcctattgcatttttagcaagaggagatttgtaagaatattgatatcaaatagatagaatagccacagggatacactttaataaaaaaaaatgcagtaatcgctcaaaagatctgacaggctcaaggggtatttgtatgaagacaggatggaatccatttatcagtggacattgccttccctgaaaacctagaaaacttgtgcctaagggcagaaatagcaaaagcggttctcgctgacatgtttctcctctaaaccttaacgtgtttgcacacagagaacgcataaaagactctgtctccattcatgtgctctagaagaagcctgtgtcccaggaatagtgtgtacctgcctttgcactcaccctccagtatgttagacagccttacactcctcttgggaagtcctgatccaaggcaactagagatatgggagaatggaataggatcgttgtccatttaatttttcatttttattatcagtgttttcaaagaagttaagagcttagaatcttttttcttcagctttgtgcactattctatgaggggatggtcagcttccttttgattgtatgctaattgaagggaaagcatgttggttttgcttacaaacaaaaaaaataaaacaaaaaatatactagtagcatatcttcctacagccaatacacttcctttttgggtttcaacaaaagtttcatactttaaaatgtcacagtggtacctgagctaggataataaactatagaattgccttgtccgaggctaattcgaagtccttattgctgttacattgaagatactatgcaacatacagtctggtcgttttcattcctttttagactttccttctaagcagggtctcactatgtagtccatgctatggaactcactgtgtaacatggatacaacactccatatttttttagacttatccgtgttggtttgcctacatgtgagttacgggtttttttcttttattggatattttctttatttacatttcaaatgttatcccctttcctagtttcctctccagaaaccccctatcccatcccaggttttaaaggcactagagcttgcaagagtcagcgtaggaagtttcagaatacaatcttaaattgtgaatgtagctacttgggttttcctctagtttccttattccaggctgggaggtgtggccatcaactatcctactgtatgctactgtatcctactgtatgtatgtttgttgcagatttctaaacaaatagtgtgacatatattggacacacacaaatcagtgtttttgcaggctctatggatagcatactagccttccaatccaaaatcaaagccttggaaaacagaaaatgaatatctactcctaaagacaaggggaacgggttggggacttagcccagtggtagagtgcttatcttagcaagcacaagtccctgggtttggtcctgagctctagaaaaagtaaaaatgaaaggaggggggaattgcattggaagttaaatgataaccttttctttctgtttctatgaagaagtctgtactaataaaactgccaatttctttcaggtgggtgtgcatggcattagaatagaattcatcaatgaaaaaggatcaaaacgcaccgccacctacctaccggaggttgcaaaggagcaaggtcattgttgtcctttatttcataccatctagtgactagtttaaacacgctgcagtgcagtcactgaccttgcagttatgtctgataattgatcaacatcaaattataagaactgactcttccatcactgcctctgcaatgtctgcctcaaattggttaattactcacatggaatctgcacctttcactgatgtctgacagcatcctcataagtgcaaacttttaaaatggcacacatttgtagaagttaggggtttattttaggcagctgtttgttactgctttgtaacacagttttccaggcaccagtgtgcagtaattttgatggcgttaagaggccttaggtttagaaactacatcaaatgtagtttgatgtcattcattgtcagtatctaacaattcttatgtgactgccataactcattcagctaatagtgaaactataagctttccattaagattgggggtgttgtgaaaacatgaagttttttatgtttactctacacttcgtaatcaaaaataattttatttcacagatatgccacacatctttatgaaccaatatggtgacaccaaacaacttcactatagtagtttgtccttcctagccactactgaattctaagtttacattagtttaaatgctttttaaaaattctatcgcacttatcttttcagaaggcacttaaatgtgcttttctcatgtatgctcatataaatatgagagatataacaatagattttaatgttaaacctcaaataaaaatgttaatctttaaggcagttatgtgaagatttatttggattgctttagaaaatgtgttaatactgcaggattaccaactccataaagatattagaatagcattcatattagaaacaatggtattcattgaatatttcacacaaatgtagattatcaagcatagaagataccattaagaccagcaatcaccatgaaatagggattggagccccaactagtaagttgacacaagtcatgttttatttatttaggctttcccttctttttgaaggtaggaccattagagaagagtacctggttgtgatttgtgacagagacatgactgagtagtttcttagacaatttaaggcatgttgtgatggacctgattctatacaaggataaaatgttagctcttctatctgactggtttttaggaccaaaggaattgatggcatttggtgacagggatagctgacctctaccaagtcatttctgtatttaaccaaaggtgcttttgtgacactgcttaactgatattttatctggcttcttctgcacaggatgggaccatattcagaccatagactcattactgagaaaaggaggatacaaagctccaattactaatgaattcagaaaaaccataaagctgaccaggtactgggatggctgggatggcagtttgtaactaaccagtggactttgaaggatatgcctatacctgattttcttttttaagactctcgaactatccttgcttctcttgtctaaaatagtggaaacaaatggcagagtgtcctgagagtggctacaccggaagtctgctgtgcagtaaagcctgcatgatacccgaagtcatcctctccatctctagctccatacgatgacttgggctttgtacagcaagccctgtgagacttgaaactaccttgctggagaaagtactagaattagctattcacaagcttttgacgtcgcctagcagaaccccaggattccaataagcagtccgaaaatttaaatttaaccttagaattttggcagtgataggagtctactatgaaagcttattgaaaaacaaaattgagctgaatgtgaatgctaaataaatgtcaacatggaataatagggattcttacttaaggaaagtattgaacattttagaagaatggggtactgtttccatttatttcagttccagaaaattgtattacatgcctgtagtttcaaaaaatggattgttctcagctctgcacagttacaaatttgagaatgtccccatttctgttcttctcaagcttatagttgaaggagaatggaagggcatgaataaaaagaatcactactacaaggcagactattacagatgtgtaggatcatagtgctagggacggggaactccaggaagtcagtgggtaacagacaacttcaaagtggaggtggacttagggctggctttaaagaacgagtagactatttggcaggtagagagcaagggaggaaagggattcctgaagatgtgctgtgaatcaaagcacgtaagtggtgcagtacaaagccagttctaagaaatataaagcactatgatttggcaggtctttcagcgcacgtaggaaatgtcactaaagggaaatatagtctagaaggttcatgatagagctgatagcctggaataatctgtgagcaggtcaaagtcaaagctgtggggatcccagtgcatggaggagggcagagtgtaaagtttaaactgcgaatggtggaaccaaggaaaatcctgcaaggtaggaatagaagcagctgtcaaagagatgagaagcagggacagcatcagggaaaggtggaggtgtaaaatccatgagcctacagaacaagtggattgtgggagtatcatggaaagttccaaagagaatcctaaggagcctctgacagccatgaaaggacagtggcagaaccaagggacactgagcacctgctaggaaaagaaagaacctgaggggagaaactgtgcttactctcctgaaaagttgggtagtggacaagtaactagatagagacaaagtgagagggcttcagtactgacgtgtagcatagagcagacccaagatgtgtgaacaaaggaagagtaaagggggaagtgatggaaggtctctgctataaaaggagcccaatgaatgagatgtgtctatgatggcgatagagacatgatggtaaaagatagcctcttccttgttccttcctgatagcaaagtgggtaaaagggacaatgtcattcctggagtagaagggcagaaagagcactaagatcagtgttctgatctcagctttgctgcttaccaagtctgtgactttgggctactaattgcttctctcatggcttcttgtttcccactatataaaatgatctcatagagtccctctggctctgataatagcataccatgtgtttctcaatgttaacttttctcttccccgccttccccttcaggtaccgtagtgaaaagatgaccttgagttatgctgaataccttgctcatcgccagcatcatcatttccaaaatggcatcgggcatccccttccgccatacaaccattattcctgacactgagccgcacaaccagtcactgggcctctctgcagacctcttcccaggagaccctacaccttcttggtctagctatctcttttactgtaccattttatgatgatagtttccgttgccatggtgaagcttcgacattgttagttaagagcatcatggtaacgggtaggacaatggcatttgttaagaagatcctgttttattattttagatcactgaatttttttttcagcacatacagcttttgaagttttctttccttacaatattaggtatctttttttgctttgctatctcagacaggtttctgtctttctttgttcctttttttcttcctccttccttcttttgactgtggatggaagaaagtatgctgtttctgagggtttattagatttgtctttagtattcttcggtaagattgtcattttttgatagctgagttggggattaattcttaacaaattcaggtatttgtatattactcatgaatttgcctaaaattctatttgctatgacagcttagtatttgggtcaagtacacattttttcccatggttgaaatgagtgagctttagagtaagtaatgaacattcagaggtccatgataggacttgtcacagagagcaaggaactgtttacgccttctgtgcttctgtgttactgtagaagagactgcctcatgttatagaacaatttacaacctacaacactgttttagaaaagcataagctacctttcaaatgggccgcggaaatcattgtgaaaggcagcatatattgggaagagattagatgcagaacttagtgcctttgagaagactataattaagtcaaattaagaggggtttaaaaaggcaatttagagaatattcttataaaattttattgtttctatataagaaacaacagattacacaaattccttactccaaagtatttttttagctgaaaaaaattattttgagcaaataaccaaaaagacatttgtctattttgtattcatttaaatttgttagctttaggtttcaatgagtcataattggccagagacaactttagctactaagacatgataaagataatctagtgaaacaaaagttcatacatactatgatttcaaatttgtctatcacagagacaatgctgagtttcagagatactacaaagagtttgaatctctttctgcactacagccttttgatagaaacacatttctgtgttgacagataatatggtagacctgtaaagatggcattcagatatgttaattagagcctagctcatttgcagggctatacttcccatggcacaaagaaaacttactgatgtcaatgggaaacccttttgtttatccccaggaaaactcatgatgattctggcaaaagatgacctttgttttatggtagtatatatataggtatatagagatatatatatttgggaaatatataattttttcaaacaggaagtcattagaacaagtggtgagtgaaatgctgcagaatgtatattctacaactatgacataccgctaattattgaaatagtcaagcttatacatttaattgctgtgacaagtgacagactggtagttcagaaaatccttgtctagtttgtaattggctgaattcattgtccttgccatcagggcaaagtacacagcttcagtttttgagagttctttgaagtttggtatttcttcatccacagaatccattgttgacgtatccattttcagttatgatgccttaactaagaagctacttgctagcctgaaagacagtctcagtagccagttccattgaatacagagaaaacataagctgctgagctttagcatgggcttctaagtcccgttgtttctccttggacacactttgtgggtggattagtctttcagtatagaagcaagctgctacctgacattttcttgcccttatagggaaagtgagcacaagctgaatgatattgtctgctaggaaaagagagagcgagcgagagagagagacagagagagagagagacagaaagacagagacagagagagagaagaaaggaaaggggagaaagaaaagaaaaggaaagagaaacggaaaaaagagaagtaaagataacatagaaactgaagagagacagactagaccaatcttgttgtgaaatccatctactccatcatctcatcatttcagagctcctcagcccgggggagcgtacggctagttttttgttgttgttgttgtttttaaagaaaagatctatcacatacatatatgcgtgtatgtctccatatacttacacatgcatacatgcatatgtgtgtgtttatgtatttaacggtgctaatcaatcttgagcaggtcacgtgactggtcatgcggactctaaaatcatatcagattttttaaaaaatccttgatatatgcagatattatacagattttcttaccggtgtaataatgttctactgaagaataaccatcctgcaggcttcaaaggacgaggtcagcaatatttcccaccatggcttggggggaaaggatagttttgtctccttttgtattcaagttgatgcatagtgcatttttgtgtctaagtagctgttgactaaaagactttgtagtgtaaagggtgttatacaaactataatggtgtgcttcaaacaaaccaatgctaggccctttcactcttgttgtatatgacaaagttgttaaatatgtggtttgaaataactttgaacatgtggaaatatgtagcatgtgtctttaactcagacaaagattctaattgcacaagttgtgttctagccagttgtggtttatttgttcagaaacacaaatgtgaattgtactctttatcaccagaatattgtatgagttccgtgatctttaaacagctcagaagtaatacttgaacttcatttgaatagcacaaagtttacagagccccttttaaatgttaattagttccagttaagttttcctttaattttttcttttttttttttttttcttttttcaaatgcaactgggtattttcttggaaaacaatgtgtagtttatttttggtatgtagcaaaaggcttccaattctggaaggttttattgttcttaaacaaggtcagccaggtaccagattctaaaaagaacaattgccccccccctcaagtggccttctgattgcacgaatgtgctactcccctctccaatcccccctcccttgaggaggtcagtgaaagtgatggaggaagtgcaaggcttgctctcccctcccctcccctcccctcccccccacacctcacctaggatgtccactccaatgcaaatggttccattgcacacacagcacaccgcacaccgggaagtttgtatactggcctcttttcctgtcttcaaatgtgcaagaatttgaaagtgtcatctggaataggttccatctcttatgtgtgttagagcaaaccaaagaagcccccagccatgcccaaatgctgctccaaaagcctgccttccagtccttacaaaaaccttgcaggattaaatgtgttaacttttttatttttgtacagtttctaagtgattttttgctagtgatgttaaactgaattaagtttatttgaggagtgtgagcacctcctccatttaaataaactggtgactttccttttcttttttacaagtggaaacccattgtgtgcctctcgatttaagggtttctgattacatttattcttaagaccagcattgatcctttatatacaaagatatgttttccttgttttttattactgtttcagaagaaaatgaaccttttattttgctccagacccagtaactgcgctggtacttagacgcactgagaaaaaaaaaaaaacaaaataaaacaaacaaacaaaaaatacttttgtaagcacctctgaccgcttttgtatatcaaagttgattacttttgagatatttggatctagtttctaagttattttagtgttttatatgtttcccaaaattcctttgaatcggtcaccagcataaagagtttttggtgatgcaatggtgagacttgtaacaagcaaaaagctacctggagtagctctctcctcccttcttagtaacctggtgttttgattacagtgagacatcacaggttatctaaaagcccttcgttataaccagctcctccctccctccttccacactgaattgcttactagtttgaagaagttattggaagtgggcattttatatgacatgtatggctttaaaatattaaaaatgaacaaaaaaagagaaaaatatgaaaaggtttatgtgggtctgtaaggtatggctgtggaaagacattgtagtagctttgacactattgttattacccaataaaatgttaaaaatgaa

SEQ ID NO: 688 - DNA, 115698 bp, mus musculus
agccgcgtgtgcgcgcagaccgcgagcccccggcgcgcccccggcggccggggccgcagcgtgctcgcccccgccgccagctcgcctcacttatgggtcggaagcgctgcgtgggggagactgttccaagatggcggcgggttgctgtggggtgaagaagcagaaactgtccagttcgcccccctccggctcgggtggtggtggtggcgcctcctcctcctctcactgcagcggggagagccagtgccgagccggggagctgggactaggaggcgccgggacgcggctcaacggactgggcgggctgagcggcggcggcggcagcggcggcggcggtggctgtcccctctctccccctcagggctgcggcggcggcggcggcggcggcggcggcggcggcagcggcagcggcggcgggggcatctcgctgtctccacctctgagctgcggagtgggaaccctactttctactccggccgccgccaccgcctcctcgccgtcctcctcgtcctcatcccccggctcccggaagatggtggtgtcagcggagatgtgctgcttctgcttcgatgtgctctactgtcacctgtacggataccagcagccccggaccccccgcttcaccaacgagccctagtgagtaccgcgctccccgtcgccctcttcccccgggctcgggatggggctcagagttgaggcaaagtgtaagtcctccgcctcctgttcgcgggtgcccctctgtccctcctgcctctagggtccccagagtcgcccgacccgtggggggccctcggcgctcctctgctccacgaggagagcaccctaccctcggagcagggggctgctttgccagccatggcccccctggcttccagactgctcccgcttcctctttgcgctaacttccaggagttttgccccttcccttcgatcctttctacccctcaccctccaccccaccagcgtctggggcgatctggatcactgtcggtaccgacctctcctcactttactcgccattgccccacgtgaaagccccgccagtattcccgccccgcgtaccttgcacatggagagctactatcccattgcagggtgaaaaatagcagtgatctaacttctattctgctagtgatggaacttagctctcgatctccagggaggttgcccatcttttcctccgggtttccctgttcctcggggaggggagaggtttcttaaaacaccttttgccttactacctatttttatctgaacgtacccattaaaatgcatttctagtgaagctagcgcaccacctcacagttgagagtgagaccttttttttttttccctcttccttcttcattccagtgtcttggtatagcacattcaaagaatgttgtccccaaagaggcactgtcaatatgtaccaagcgtgcgttcgcttttgtgtagatttcacatttaagcaacctatgttaaactcaatgattcgaggaatagttaacccagtacatgtgtaggcatttttacgatttcctttggcttttgtaactttacattattttatccttcaagtatatggttgaaattgtttaaaatagcactgttacaggctaaaagccaggttacttctaatctctgtccatttggatgtgtgggagatggggcatatggtttttcttttaaaatgtgtaaactgagtgtaaactgactttctgagttaaatgctagacagaatgtaaagtacaaaggaaggcagaatgggaaaagggacgattgtttttattatgactactggcatccacaagaaaaatacagaaaaaaaaaattaagcacactcatactgaaaaccatcaaccccatcccttctgcccaagagctccttgtttcccacagcgtaaagacatgaattgatgttcattttaacttgctgcctctcattttgtgagattagaagaacgaactactactgctggataattatagtagtctgacgctactaaaatattaaattaatatgtaaagtggaaattgcaataaagtgtcctggaaattgtgcgtttgtattgtttgttttctttgctttcattctttaaaatgcctttaattttgtcggactccgctgtgctccggacatttctttaggtttcatgaggaatggacgagaaggtgcccaggtggacactgtggagtgaatgaggggcgtttggaaagttcctaatgtgaattctaggagcttaaatcctaaatctccacctttaattggcctatttatttttcattaagaggtaaaattcatgttaaaaggaaatctgtgagatacttaggtcaagtcacttattagtggccttctcttgggtggctggggtgacttttaggctggctctggaaagtcatgggattgtcaaaatgtactcctgttcagttcttgagctgttacatagttctgcagaggctttttagcattcatgccccattgctctaaagcatatgagaacacactttcaggaggtgcaattttctcactttttagagtgagtgtgggttaactgaataactatcacagtatttaagaggaaaatgagcttgaccaattcataaggggaatgttttaaaaacttattattactattattattattattattattattattattagcagtggccacgttccacatggacttaggtgtttcccttttaatacccgagttgctgaatttttgcctctcaggtccttaagcaactaagacatgcatctgaccactgtgaatacattgagatggtggtggaagaattgtggctatgaggggttaggaggctttcagtgtgtcccatttctacagactagctagtttatagaaggcactgaacctcagcaaccagagaatgaagaatgtctctcctttccatttaaactgatttttcaagtgtacgatgtcaaattcaagaacatcttcctgatggtgggagtgcaataactggatatttcacagtgccttggaaaagcaccacacgtttctccattttatgagtttgatattgtgtgcttattcttgtggcactgtataggcttaaattgtttttctttttactccactgacttatgggaataatgtcatgggcaatatgtttaaagtctttttttttccttgtctagcagaagatgtgcttctgacaatatcaaattatcatatgtaaaagcatagagtagtattgtcatctcctccctaggaccttactgtcagaatgcttgtaactggtgggatctgacatttatagatttagaagtcaccgctacatctgttaaccctgccacagtaaaaggtcattagagaatttaattatttatatgtttttcagggttggggaagaggtcgtttgtgaaaggtcacgtagatgcaactactccatgcttgcccccgtcttttgagtacccagccattgcagagagcactgttggttttttcctccagaaataaggttcaagatgcaaggaaactacaatgttaggtacatcttcgtatttaacagtcaacgcacttctgtgtgaggaagctggtaaaagctactttagaagaacctgttggctactctaaaggttcccctgtggcaggtgtggagccagttagattccagaacattccttctcaatcatggctacacattggaatcattgggaagttattcaaaacgtggatacctgtactctcaccaaagattctgatttagtccctcatggatgggacctggggatcagaattatttaacgccccccccaggtaattttagtgtgtagcatggagaactgctgactgttttctaggtttttaatttgagatttggattaatttgatcggggtagtgccacagactccatattttatgagcatcttgggtaattttggcagacaatcaggttgggaaatacttgcagtgtggtccataaaagacatcacctgggaacttattagaaatgtaggttcccaagccccacctcaacaccccctgaattagaatctgcattttaacaagctccctaggtgattctcatccacattaaagtttatggtggacttgttctctgactttagcatacattgtagttttctgttgtgcttgttaaaattgcaagttgctgggcactttcccagagtttgatccagttgctctggggtgaagctgtacatttgcatttctaacaagctccctggtgatgctgatgctacagttcccagggtcacaccctgagtaactggttagggagaaatgagggcctgcatgggtgcgtgagtgactgactgtggcaggttggactggcatgggtctctctctgttttcctgtcctttatcactctcaaacatcactacgggaattgagtgctaccaagagcagaaatcagattctggggatggtgtggggcaggggttactctaggaaacttgttatgtgattttaggtttttcaaggaaagtgaccatgtgaagggcatatttcaggagttaaaaatcagcataaatagactatcttagcatgagttactgttaagtaaagacccctcttgtctccacgaaagtacttttttataggtgataagattttttcaaagcccttatgtatacttctgtttgctggaacttatttaaagaatttccctcattagtaaagaaatatgaaaagggtcccagttaaagcactgagattatatagtcttaggtttttaatgctgtggtataggttatatctcatgaaccttttaaattattgtaccatctgggaaattaatgtaacactagatttttttgtggacatttacacatggatgttttgcttttaaatatcagtaagtgtgattttctgttgcaaggaacataacctttttttaaaaacccactcttggacatgctgatctcgcaacgctcaagtcagaggatgcagcattaactcttgccttactatgagaataaaatgactgtttcaacaggcttgggaggtggagggttgccttgagatgtaagcattgtgctccaccggagtagtagcaaccctgcttattgaggatcatcaagatcaaaaagatgatttgataatgcagttcaggtcaagtgatagtaaattggcattgtaaacatacacaattacatttctattgtcttttttggaagaagagggactaaaataagtagaaagtgtgtctctactgcagatgatacaactggaccatgacagattttcttatccatactagcataatgggactaacttcctttctctgaccatatggtatagttttttttttttaattataaaagaaaaacattttttctgacacttactgagacttttgaaggtataatatggtttttttgcaccaatgttgatttacattggagaacttagtgtctcttcttactgatagagaagacagacatgttctgttattacttgtgccacaaaaccatcagtgactgacacagacgtgtaaaaacatgaattacaaaattatttttaatctgtacatccaggtgtatatacagttgagtgtatttaatgtaaaaagtagagctctttattttccagtcttccccatatggctgaaaggactgataatctaacccataaattttccttgcttataaattgtgcttgagttcagattccagttaaagtagcaggctaggaggagcctctgctggcttctctcagttctatgggaagaaagatcataaacaaaaatgtaaaagttactttgctaacacatgtatgagctgcttttctaagtatgtttttctcttttaaaaactacactttctgaaactgaagctgtgtcatagacacacaaaacctttttggctacaatggattgtatttttaagtcagttgtgtttcccctttctatggataaattcgctttttgacaacgcatatgtatggaacactaaacttgtgtaatgagattagtcagagtgcccaggtttcctggatttcaataggcattattctgtgctttccatgtcacacatgcttgcctgttttagagcagcacaatgcccagagcttttacatttacattttgtaagtagtctctttttcaaacttgtgtaataatgtctttttatactgttctgaatcaattaagctaagtgaggactagcagtaaaaacaagtggctgccaagaatggaccttcaatgtgtaagctgtccttccacattcagtaattgggcggttgctcacaagacactggagactgtgggaaggcagtggttgtgtaggtgggaagactagattcccaacagtaaacttatttagagttgagcttctgtagttattgttgctaagagcaaaacgaatcacaagcttatatagtataaagaaaaaaaaatccaaagcaagatgtatggtgtaatagtatattgttggttgggtggaggaaaattatgtttggtccaactataagtggcatttttgtatcaagtgtgggtgtattttctacatttcttaatatatcacactttaaaacttgcccaaccttaaaaatatgttagtgttgaatatctgactggaaattatgtgtcaccacaatctctctctctctctctctctctctctctctctctctctccctctctctctctctctctgtgtgtgtgtgtgtgtctgtgtgtctgtgtgtgtgttaagcgtatggagaaaaatggtcctatccccttaaagtttcctatcttcttcaagcaatgatagaaataaggaagttgcttataattatttcaacacaatgcaggcctgctcagttaataagatacaggtaaaataaaaaggcacggcataaaagagggaccaggaaaagatatgtgggaggggatgacttaagtcttttttttttttaatgggaaaagcacaggggttgaagagctttcgtggccaacagagattgaactctaggttgttctcaaaccggttgctgttactgccacaccctttccacagtgcacagggattcccagcagctgtcttcagtcaccagcttgctctctcagcattcttcacaccattctgctttgctgtggtctctttaattcataaaaacttcaaagaaattctactttgtgctgggagttcccaggggagtctggatgagaggttttgaattagatgatcatttcttgaattagagatcaggaacataagagaggcttctgcagtgtaagaggaattggaagatgagtcttcagataggagagagtggctaagatggcgtggtagtcggagagtggtgttggaaagtgggcaagttgacactgagtggagattgtgactgtgagagtgttgcgaaatgaagagctggaagaagggatcagcgttttcaggcatttcttcctggagggccaggttttgtgtaggagtgagaagattgcagctcacctgctttctggcttccatcattgcctagctattctgatgcgcagaaaagatagttaagccacggtagtagaatggctgtgtaatctgctcatgagtacatctttcttaggagaaagaagactgctttatagaattaggatcaagtgtaaagatgagatagtttttggaaggggttcttaagtgaggtggctgcatatgagtaaacaaagcaaaactgagggacagcgcactcttcaacattccagttgctgggataggggaattcaaagaagagaggatttgaacatgagtcagagcttataagactgaagcccatggcaggatgcaccagagaaaacaggaagaaacaaatggtccaacaggtgacatcatgtttcttggtatgtatcgttcgatatgttggcagttactaaatggcattttttaaggattttttaaattaatttatttttttacactcccacccactcccatccacccacccggcatttaattttattttattttattttattttattttattttattttatttattttttttggtggcgttgcttctccttctacctttacaagggctcaggggattgaactctgctcaccagactttcattttcatggcaaacacctttacccttgagccatttctctttaaattatcagaagcacagagcagccacagcttttgtgatgttttggttagtctctggggatcacttctgcttcttgagctacacagtgaccgtgaactgctcagatgggcagagatcaatgagagttttcagctttgtactgctagtaaaaactaactggcagaaagttgcatttccctactgtatgtgtttttacagtcaatcttcaagcttgccaatttgtgaagcggtcagtgatttcttagctttccttagttctgtatcataatacagccttcagcaaacttgtctcatggaggattaccaaaggaagttaattgtttcagaacctcaattaaaggggaataaaaatgagggactaggagtgttggtactagatgctaggttgtgtgtcctcaagcttagaagggaaaatagattgaaacaaggacactcttttgcagctttgctcaacaggggaggaagggtgttatcaattgacaggattagccatattgctttatgatctttgctatgggacgttgtaaatgtcctgctccaggccaggcctactaattagttaaagaataaggcctgtgatagtcttggtgattcttgccttccccttgtccatttcatttttcagataatctacagtgtgacccaaagccacatgcaatgctggcaaagcaaacttgactctgttaggcaatatcccgccagaagatgctgacaagctctctagtaatggaaactggcgacactgacttcaacgtctctagtttgccttgccattccatatattttaatgaggtctgtaggcatatgctgtacaattctagaaccatatttgccctccatcggggtttggatattgcgaggttagctaacaacagaaactgttttcctttaggtgttagtggatctttgtgtcattcttccagaatggaagctgagacaaaaacaaacctttggtagtgttggcttaaggtttccacaggattgtgtttgcctcatatgttcatgtgattgtcacattagtgtgtttcttctctgtaacatcatttttgcttatagtagcctaataactacacagttaattatagatgctttggatacaaattaagtttcgtaaatgttggtaaagctggacctcgatgcatagatccatatagtaaggccaccatttgtgtgctgaatttgcagttaggaggtaagtatttatatatgatgggtgctcatacatcatttttcatgttgataagtagagaatggtatagatttattcgctaaagatgaatcttgtgacgccatttgacctttttctttgttacagtagtgctttcaacacattttaagagttcccacattacaaaaacaaaaaacaaaacaatgtttgttgaagttagttagcagtagggtctggggcagtcagtagttaaccatctacttctgcagccctgcatgcctcagttcaaaacccctctcaggaacaaatgggagcgagagctgacattaaggaggcaatgtgtgctttgtggtctattttactccacaaactcccccagcttgcttgctttctcatctgtagaaagtcacctagagctagaggcaggaatagagggctcatgagaatcaaggagtggaaaaatgacttgggagtgacatgaccaggatttaggaccgaactcttttgactcagctctgagtctgagcacatggtccagagagatgagctccaggaagcatggtttatagcgtatgcactgagatagttctccttcagcaccagtgggcacggcactcctgttcaaaaataattattttaatcagaaacagatataagagtgccaactgtagggcctctgagtaatttcagcagactgcattgaaaaccattaacacatggtttcatcagaatgaggccttggcaaatatttgaaagctgtaagacaaataactttaccgtagttataaatgcctctgattattacccttatttttcttatactgctgtgaatatagttagagattcttggatattcagctataccttatttttctgcctttctccctccccctctctctttctctctcccccccacagccttatctaaatgtgtgtgatgtttgcttttttgtgatgtttcttttatttagttttctcccgcttgctatttataacagattatgggacatgtaatattagaggacagacacaactataatttttatccctccctccttttcatagtacttagtattgaatgcagagcatccttacccctgtactataatttctgtttgcacagttgcataacatagctgtatgaagactcatccttctatcttatacaccttttgtctcccgtgacccttaacaacctaatttgtacataatattcccacagtttcagccatatacatgcttctgatttttctgtattttacatatatgagactctgcctactgtggcaaggagttacctgtttctggtttttaaaaattattcattttaaacttgtatatatgtacatgtctttctgtctctgtctgtctgtctgtctctctctctctttatgtgtatatatgtatgagtatcccagtgctgttagtagacttttcttggttctccaccttattcattgaggcaaaaactctccactgaacctgtagttccctaattatggctagtttagctggccagcttgctccaaggatcctctacctctgccttccaaagagctggaaattacaggtggcccaccacagacatctacatggtttgggggagggtgtccaagcaccagtccctatacttgctgggctgtccatctggactagtttttgttttcttttggacccagagtcttactctagcctaagctgacctggagttcactctgtaggcaggctcagcttcagattgatggtggtcctcctaccttaggctctcaagataaaatgatggacatgaactgccatgcttggctactttaattttttattgtagtaaaatcctaacaagatctttcctcttagcaaatattaaagagtacttattttctaattatacaggatagtggctccacctaaagcaactcatctttttcataggaattttggtaatactttaaaaattaaacttaccaacatatagcagagagtgcagagcagtttacaatatagctcaatttagggcttgatatatttttctaaacttgctgataattatgactaaaccaggttacaaataatcataactgtaaatctatgtttgaaatattttaaattgctagaatttccaaattggcttcatagttatcatttattgctttgcttgattctgaatgcttgtatttgagaagaagtcaactttctagatttctttttagcttatttttctcctctctgtccgttagggttttatgatgaatctgctaataataattcacagaaatgcctttgacaggtagaagcttcgcctttgttcacccactttcaaaggtacaaggactaaggcattaaaggagaaaattatttttgacagtttctcagaaatctgtctgggaaaatgtgctttctagagagatggaaaattggaagataaattgcataatgggaattataagtagggcctttaagtccatatgtgtattgtaagccactttaagttaaggtacttcatgagattgctttttatactgtacacacttgtttgtaatgaaaaaatgtcacttaaaggtggaagcagcacctgtgaaataatagctacagtcaagccatagatcttgaaaatttgatttttccccctgttgttgctacccagccagtgtgagattctttaccattagtggggggtatgcagagatttaaaaatacttctattgaattagaaagcatcagtttgaatttggaagcatttcccccttccatttaatgatagtttttcagttctaaataagaaaataaaatttccatcatgaatatcattttaaaatagacctttaaaattgactattcttcaaaccttaagatgtattgaccagtgttagattacggtagtatatgctttatgttacactgagttgtaatactacattcagctcaaacagtatggttgttgtgggcagaaaactgtgctagtgtggtttccgagtggatgtgagaggtctataaaaaggcattcttgtccttaaaaaacttgtagtcatattgaggagttgaggttcataaaatgcataatcaagttgcatatcctttagtggctgaatagatggtaaaagacaatcagtttcataggaatttgcaccgatcgatgtgggctaggattatatagaagggctttacagacaaagtggaatccaatctgggtagaatttcatagacaggaaaaacagtctaggtggggaaacaaacaaacaggtcagaatgagcattagacagtggtcattggataccaatcaaaggtagattgaacttatggagaacctagcaagaaacggacctgttagctgatagttgaaattcaggcactgggaaatgatgctctaccaattgacaacttaaagctagtaatggtcctgtgaattccctctttcttgctaaagcttccctttgttcagttcattatgcttcagcagctcttttaatgcatgaatgtcatgaagcctggacaagagacaacacaagcaggagtctgctgcgtagacaaagtgacaaagtgctttcattcatcaatacatattcagcataagtcacttagaacatcgttatgtcatactcagtgctttctgtgtcttgtatctttttcttttagacacccatgtcttaaatgtaaagttgaaaaaaactgacttgctgtaaagattatgtaatttaaaaaacaaaccaccctagttattatagaactaaacagttcaaaccacttttttctcccacaattaatagtttgctttgatattcagcttatttaatataatgaaggtactgagaattatatcaattattggaggattgtatactaattattgaaaatatttttaaaattggtttaaacatctattagtctaatgaatgttctcattgtagttcttaacataccctgtttaagatgtttcaattttgagacaaaccatataagcaaactttattaaagctctatactactattttgtaacaaaattttagaatcatttcctaaattaccagagaacagcactttatttcctagtgaatactgcttactcttagaaaaaaagcaaatctttccatctattacctgatggtttatctttagttatattaagacataaatttaagacacaaattgaccactgttaaagaagagctttcttccctttgaggtgttttgagatagactcatgttttagactgtcttctcgctagagtggaggataactttcagttgctgatttttctgcctatacttcctaattattggttttcaggcatatgtcacgatgaccagtttcatgtggcactggagatcaaatctaggacttggtgcattctaggcaaacactctataaactgaactacatccccagcccaggagagtgggaggtaatattatatattgtccatgtttacaagctaactttattttcccaggtttcaatgaatgtgcatttttatttgtcagtggcctctataaggtagagataatagttaagaaagagtcattttggctatcgcagtaaaacaagtaaattctatattaaagtggaaatctgggcttgggtcccatgggtctccattccagtgctgactaggcagctcctaaaaccttgactcatgtttattgcaattcagtatagcatgtcagtttttgcttgatcttcatgtttcttttcacaaccatgaagagttgtggccatttgctaggttaaataatgtttcatcaacccaggatggcctctactgttttcatatatcagaattgctatgttaattttaatactttcctctcctagtctgtctccccttaaatttaatatataaatttagggagaaccttttactcttccactgcataattcctttttgttgtttcaccaatttcaagaatgagtgtccaatttcttgaatgtctaaaggcctgggagcactggaattttacagtttctatggctttaattctagcagtgcatatcctcttatatcatatggaatcttatttcctggtcttaactgtttcttccatttgcgggacctagtggagtaatgagtggaagggactctaaactttttttttttttgtttttgttttgttttgtttttttgagacagggtttctctgtatagccctggctgtcctggaactcactctgtagaccaggctgacctcaaactcagaaattcacctgcctctgtctcccaagtgctgggattaaaggtgtgcgccaccactgcccggctgggattataaacttatcactgtcaaattgtttcagacaatggatttgaatatatacagaagtgtagatacaccatttaatgggatcaattttgaatttgtgataatataattctaaaaagtttacagaatctttttcttgacagtatttaaagcaaagaatgagtgaaatgtccagtaatgcataaactttaactgtgtttaccaaactgctgaaatctactcttagatgctaagtttacctgaatatagacatattagaaaacaatgaagaatttttctaaacataagtacctatactctatttttggattctagattacaattttctctggagtataaaaaccttaagacacaatcattattaacccgaatatattgatacatatactagatacctagtagaaaataacacatgctagaaacataaatggagatacagctttctagacttaaaatttagaacacaaatttgatgttaaaataaataggtgtaaaatagattataaattcacaaaaataaagcatgagaagacaaagaaaattaaaattaccatttacaaagagctactgttattgttaggacatggcaagtttctcaaaggcaatttatccctcatcttggtgatatggagatgtggtgggacatttagggcatagacccttagagaaggaagttaggtcatttgggacttgcccttaaaaagagatattgggtccatgttccctttatttcttttctctgcttctggttgacatggggttcactcaacttttgtttatcatcacagtacagtgctgccccaggcctaaagcaacagaaagaaatgactgttgactaaagtctttaaaactgtgagccaaagtaaacctttcctctggttaagttggttatctcagctatttgtcacctaacagaagattaacccaccgctactcacagcacctctcatcaaatctgaccatttatacttttgcatcctttgtctacatcatgatacttaaatttaatagttttaaaagatttatggtatgttggcccagtgactggaccagtattactcctttgtaagaaaaaaaaaggcactgtggtagaaagctgatttctaccatatacccactttatccttatattgccacattggggatagcctacattttgtgggaaaagccaattccttttagcctgaatagacatatgtcctaattagatacacagccactaagtaaatgaaatatggtcaatatctcttaacaatcaaggaaatgcaaatcataactattcatccctactaagatggcaattataagaaagagaaaacattagcagggatagagagcaaaggaaagcttacatacttttggagttaatgtcagtcaattcttacaatcaggaaaagtagtatatagacattcttaaatatagagaacttccatatgatccagttacagcacttccaaagaacaaaaggagtaggttgaagataaatctgtatgttcatgttgttacattagcgacactaatgaccaaagtgtgtactgataaaatagataaggaaattgatacacacatagtcacaaacatactttggaatgctgtctagccataaaagaaggaaatcctgccattttaaaagcataaacaaacctggaaaagataatgctatgtgaaataaactagacacaaaaaatataccacattgcatcctttttctgttgattcaaattcatagtaaaatatatggatgtagagtagactagcagggtctgaggtcaggatgaaaggaatcttaattgaagtatataaacttagttataagctgaatcaagttttagggatcagatgtacagcatggatggtgatggatatgttcatttgattgtcattatagtataaatgtatacacaagtaatcactatataccatgaatgcataccatatatttttggcaggatctttctctgtagccttggctgtcttggaatttgctatgtagagcagtctggccttgaactcagaaatccacctgcctctgcctcctgagtagtgggattaaagacatgtactgctacatcagacttataccatatttttaattgaatgtctggagaacatctttgtttctgtagaaatttctctctctctctctctctttctctctttctttctctctctctctctctctctctctctctctctctctctctctctctctgtgtgtgtgtgtgtgtgtgtgtagagggggtgtgcacatgtatctatgtggctgtggattacagtgaacagtcttgggtcttgggtgtcatttctctgttgcatttcacctcttgttttgggaaaaggtctattgacttgaacttctgccagctctgccaagctcactgggccagcaagcttccaaggatcttgtttctgctttccatcttcccatcgctgggtttacaggcatgtaccactatctttggttttcttcttttaaagacatgggttctggggaccagtactttacctcctaaaacccacctagccttgtttacataaaaagtcctgatgtctttgttctcattttaatgtacaaaaagtgatttgactaagcctttctccaagggattataaggtgtctttgaaagcaaaaatattatttttgtatgtaatctccctcaaaaatgtttaacaaccgacctgtttattttgtgggtctgagttgaaactgtattcaatgcattagtctttaacctgtacaaaattaatcttttggctgagaagaaacaacactaatttacaactcttaaaccactctatgttaatctccagcactaggtatttgggaaaaacatcttcagaaagaaaatttcatcacatcttaaattattatataatttatgatgcaaagaaaatattcaggcctggtcacatgatacaacagactcacaaagcaacttattctcacatattagccttaaaacatatcagatttatattcttaaaattactctccctgttaagtgaaaaattatttaatgaaagaccttaatggctatccataaaagtttttactcataaatttttgcaattgcatattttagtcccacagattttcaactcttagcagtggaaatatatattgtccattgtatatgcatgctgtttcttttttaataaaatccgtatttacaaaatggaattcagcaaccaggcactgcaaatgtgacaacatcatgaacaacgggactgctattgctggttttatgagtgatttcttatattcagtaactgttcttttaaattggcttcccagaaaagggcttggattttgcaatcatttacaaattgccactgattttcaacgttttattcctgcagcagaaatctgtacactgccacatgagtccccaaactagtctcacgtataattctaggtactattttaatagggacaaaagaatgttacatatttgtctgtttttcttcttgccccatcatttcttcctttcccctcctgcctctgactgtgccctcctctctcaccttctccagatctccttctctatacatatgaatgtgcacacaattgcatacagacattattgtatttatgctgttattaattataccctgaaagctcgctaagtggagagtcacttttatattttatatctcctctcctaatctagtatcaggataatgttactgttgtcaaactttcatagcatactatgttttggcaacatcatgatgagtagttgtagtggataaaagagtatcttctgtattgaaatgaatttttaaagatttttgattgtttatgaaagtcaagacttagagctcataattactgtgttcttcatttcatcaaagaaatgcactgattcctcttttttgaaaccttttatctgttgagttacagtgttagacattgaacagtattgtataattagtctgactggctagcaacatttatttttttctcatcttcttttatataaaattggcacatgtgaatctttaaaacctaagcagaatattgataataacaaatacatttttactgtatctttcagtggaaatcacaattatttgtttgtagtcaccaaagttaaaaaaggaacaggtttcaaggccgatcatatcttttcctctgctgattttatagactttcatagagtaccttaaaatagcagtctaggtggtgatatcaccagagatcctacatatttttctgtggatttttaagagctgaagttaatttttaaaaagactccattaccagtatgattttcatgctcaaggaggggattacaggaataaagacattaaaatttttacccttctataaaattaatgtgactattgacaacagttgtcaaaatagctttttgggccatcaggaagatgacttataaggtgcatgatgcaaagtctgatgccctgagtttgattcttgggacttatgtggtagaagggaagtgccaaattccacaaactgtcctctggcctccactcatactccatggcacatatgcatgagtgtgtgtgcacacacatacacaaacacacacagtataagtaaaatattttgtggttctaaaaaaccacgaaagaaatgaaatttgaacatgaaattctatatcgaagaatatcttttataaaaataagagactaaggacatttttagctaactaaaaattaagaatttgttgcagtctgtcctttaagaaatttttaaagttgggaggaattcttcagactgaaatgaaaggaaactccatgtattgtattcctcagtttacagtagttcaacttaagttttgccttttgtttttgtttttatcaaagtgatatttactcactagattccaaaatttgagttctgaatttgtaacatttaccaggctaaggatatgagatattatgctgtctcaagataccaaatggtaatagtcccagctcccactgagccatgtggtcctgatggtaaacaactgagactctacaatgttctctgttgctaagatgtgatgtttgcggaggctaattttgttaaatatatttttgacttatgatattttttaatttatgatgagtttattggaatgtaacccccacataagtatctatagatataaacttaaatgcacacaaagaaagagcagtagtaaaattaactctaaatgtaaaactaagagagaaaagtattttgattacaactgctttctctgatttaaaagacagcagctgcataaaacaatgatcataaaacccttaatgggtttgtcatctacaaatatgttatttgaactcaggcatggtggtatacacctgtgatcccaccgtttaggaggcttaggcaagagaattatattttccagaacactctgggttacatagtgagttctaagccatcctgggctacatagagactctgtcttggtggtggtggtggggacctgaatggcaggatggcacgaataaaggaggttttaacgaacagatatagatgaagagtttttgtgcattgctgctgttgtttgtattctaaagtagatgaatttaagacagtactattcccaaggtaacccttagttatatgacttaaaagttggtatttaggattagaatctcaatgctttggcatatactcagattctcaattttgagagtaaaaataaatgatatttccaaaaataagctttatttgacagtttctttcatttagtataactaggtacaaatattttgcctaggtaggatattttaatttttttctggatgaaccttaataaaatacttaaaaattcacaacaaacaaaatctgagaacattacagtgaactatgagttcttgtaatttgaagttgataaagctctattgaagagaatttaatttttgcttgcttagaacgtacacaaacttacataatgtgattaatggcataatataataaagaaattctcgatcataagtaatattgtagtttatataacaatcttgttgatttgttcctatgggaagacagtacaatctcctttggtttgttgggttttttttgtttgttttgtttacttacggggaaaatgtgccagacaaaatgagtaaaagctgaataattttgattgttatcttgaattggtcataagtagcaccacacaaggggccttcaggatccaggacgggagcagacaaagcaagatgtcttgctggtaggatgctattgaacttgagctctcagaagggactactagcttccatctgcctccagggatcctagtctccttatttagcatttgtttaccaagtttaaagagagtagtttagcaattttgtcttaatgtttcagctgagaagcaagctctgcctagtgaatggcaagagaaaggaaacagttttctttaatgcacaaaatgccactctcccacccacgaagtcaaaataatatcctcaagggataaagccttgttagttaggaatgcctaatttctttctataatatatgtatacagtctttttcattgccttcataatagtaacagtgttctattttaagccaattagtttaagatctgtttttatagttacttaatttttaaaatttgaagtgttaattaaatgaactggtctccaagatgagtgaccagtataatatttgctgtgaggaatgctgtgacagttgtaaaggattccctgcccttaagaaggttactttctagaacaagaactaatttataagctcataaacctactaagtgccttagagacatctaaataaagcttagagaattttggctaaggtgacacatggtcacagacatagaatattaacataacaaatgtataagaaactcatttccacaagaaagtctaccttcactatataagcttacatccttttcagtattgatagttaaggttagacagttgttgattagagaatgacttatgcttgtgagagcttaagtttttaacagtgtcatctcaggcacagaaccattggtaaggaatttttctgggcctagggttctaagagtaggtcagttggaaaggtcaggctaataggttgaaggtttgtgtctgttactgtgacagtcattgtggcaggaatagctcatacaatggcacgttacacttgaatagctcatagtgtagctcagaatgttggatcagtggaaaaacctatccctaaatcctatcccatgatctccagatgttctcagttgggtgaaaggcaatatgccagatggagggacaccttaaaagtttgtaacaggaaataatgggcccatggaaagggcaaatagtatatgctcatgttataaacatagtacattccaatattatatgaaggaaatgcagtgtaacagtaccccatctctcatatatctagttcgcttctccagaggtaactagcacggctgccaattgttcgtgttttacagagactttctgtgtgtagacaggtatttatagtacatacttttttgcttttgttttgttttacacaaaagtagcatattatatgtgtaatttttctacacattctcttcagcagttaaggatttatttgagggttactttattttgggagcagttttatttcacagcaaaaagagagagcaggagacatatagagagacaccacataatcctattcactgtttcagtgtatatagtccattatcaagagcacatttttaaaaactgaagactatacattggtaaatcatcttttcaaattcacttaccaaggggtgatatagattttacagaactgaacatatataaacatcttccatcataggctcccgtagaataattttcccgcagcaagtttactatcttaaaacttctctgctttaccgatccctccacctctggaaaccattgattttttttttttttaatgtttcaggattatgttctttccccagaatgacacatagttggaatcatacactacatagcctttcagattggctcctttcacttagtaatttgtattttatttaagtctcatcatgtctttctgtggcttgatagcttgttttttattaagcgctgaatgttagtttattatctgaagtaacatactgtttttatccatttgtctattgaaagacatcttagctgtttccaggttttggcaattaggcataaaaccacttttagacatcagtgtgtgggtttttatgtagacataaaatttcaagtcattcttataaataccaagaagagtaattattgggtcccacaatacgaataacagccaaactcttccaaagttgactggagcattctccttcctcccttcctctcacctcagccagtaatgagtatgtcctgggacatacttccaccgtctgcatatttactaatatccagtttgtctctgtctacttttacttttgattttggaataattatagactcacaagatactgtcaaaaatatagatagatcctatgcactcatcacagcttcacttctggtgccaatcttacataaatataatgcattatcaataccaagatgttaattttttggaatctaatttatctattgtactgtgtcttttatcttaatgctttcaaagtatctttctatatgatatagcatagctaatttaaccaactctatattgaagggcatttagattgtggtgttgctggcacaagaaagggcaagaaacaggatacatcatgtatatactgttagaatgttatctgtgtcaattaggaaaaaaatgccctcttaatatatgtagccctataagcacatatattggaagacagaatgttatgttacaagaccaatagtgtttagcaactctacatgcatacatctgtggatctatgtaggaacctatgtctgatagtggaatgttctttgaaattctttagcatattagtgttctagtttgaatgaagctgtccatttcagactgagcacaactgttttcctcactgctacttcaggtgttgggtgttttctgttatgtatatatgtattgattacaatggattgtgggcttcttggataccagagaccttatgtcttcatctttggtttcctttccttggagaatattattttcaaataaaagtgctgaaagaatttttgttgacatttttttaagtaagccatgagcagtgaattttaaatctgcttctcaatacttcaagaaagtatcttgaaatttgaaaccaaattatctgaattaaaatacccacacataccactcttgcaagagagcaaaagaattgctataaaatcaaccagctaataatggggtactacagtctcaaaagcatgaaggattatagctttaggaagaaaatccagagtaagaacactccttgtgagtaagcaggtggttgcattttggttccactgagtattatagtattggaagaagaataatttttcaccagtgtcttaacttgatgtatatgaaagacttttatatttttataggtcaaagaaagcatattaaactctatttgtaacaagcctaaagtctattatatacattgtatgcttttgctaagtaagtgtagttctgagatagcccatacattttatgccacaaagctcccaattttaccagctcttaatttgtcattgattaggagggaaaaatgcatttttaagactgagtttatcattactgttgagctgtagaaatactttatgactttattttaaatatttcattaaaacttacctcactggaatcacatgtgatatatacatatatgtaaatatatgtatgtatatgactgctataattaaaagacaaaggaaactactgttttgttaaatatgtctgcatatactttttattagtaaataaaattagtagattggccgttcagcatgatcaagacatcttatacaagtgacaactgaaaataggtaaccatagttgtaaaagtgccatgattctaaactgagggaatgaaatgctcgacacccataatgtgtaacagttgacataatagtagaggtcgcttcaaagagactgttgagacagaacttgctctttgtctataatgttcacagtgaattatccagtgtgctttgctactagcacataaatattttaataaaggaggattattacttaaattggaaaaaaatttgtttttcttgattatttgctgtaaaaagtttttttggaaccaaagcacaaaaggattgtgggttcaatgtgagactacgcagtttagtagaagctctgttaacctgctgttaattataacaggcttttacctgttttctaagaaatacagctaattgggttcatttcagtaggtttatttttcaacattagtactaaaatcagattgtgtgcaactttgaatcatggttctataaattcttggctatacttagtaaattacagtattacttccagtataattataagaatgctttaacatgctggatgttgattttaagaatttttatggttaaatattaattttcccttgaatttgaattattcttgtcaactatcattcgaatcccatgtattcatttgacagcctattgctgaaaagtaggaatttaaagactagaacagtatcttagtttcacaagttttcatagtagtgacttggataggcacgtttatattgtgattatgtatgcttatgcacacatttcttatagtgatcttggtctctctgcacttggtatatccatcaaattaatctacttaatcttacagtatatgtaaacatgctatcttttccatggaactgaatgattgacaatttctatggctgtaaggtatgtgtaaatttctaataaaatttgatatcacatatctctatctatctatctatctatctataattgtaaacctaggtatacacaattaaattgtgagttcagttttaaatatgtatggatatgactgtcacttcccattattctggcttttgtgaatgacagccatctataatcttgcctccttttcttgatctgtccccttgtttgtgtgcctttttgatcttgctccattgctttcagtgaagtgggttgttttacaagtaggaaacacaaagactacatggtgagctgagtaaatttgatagactgtgggagcggcagtgtacacagtagtcattttatagttagtgaacgatttgttgaggaaggactcaggaaggggtttgaattatgattcaagtcacagtgattagaatgtggttgtgttgaagacaactagacattccaggcatcgaggatcatagtcacggctgaatgattaggtttgttcataggactagagggtaatgatatttgagaatttatgaactaaatgtgccccagaatattgcaatgacttgaaattaaagcatttattcattcatgtttactttgttttctgacctactggggaatgctgtaagagttatgtggatgaataagagtaaggggaagtcacatataaaaccattgcattgttaaagagatcactgttgtggttaaagagaggactctggactacataagaaccagttgtgaaattggatttgggaagaacaaatgggtgcaaataatagaccaggaaaggaagggcgtccttttgaatttaattaactactgtgggtgctagttcagaggctcctgttaggttagatctagtcttcaaaagagaagggctgtgcttacttggttaaaagagaagggttgtgcttacttggttaaaagagaagggctgtgcttacttggttaaaagagaagggctgtgcttacttggttaaaagagaagggctgtgcttacttggttaaaagagaagggctgtgcttacttggttaaaagagaagggctgtgcttacttggttaaaagagaagggctgtgcttacttggttaaaagagaagggctgtgcttacttggttaaaagagaagggctgtgcttacttggttaaaagagaagggctgtgcttacttggttaaaagcagaaggcctatcctatcaagccatctgtcttctaaaaaggtaaatactatggcctttctttttcccttctctctattgatttatgctttctgattgctttaagacatacctagagtatgcaatggtgtcatcgtttggaggctgattatgggatggatccctggatatggcagtctcttgatggtccatccttttgtctcagctccaaactttgtctctgtaactccttccatgggtgattgtttccaattctaagaaggggcaaagtgtcctcactttggtcttcgttcttcttcagtttcatgtgttttgcaaaggcctaacaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatgacctagtaggccatcagcggaaagagaggcccattggtcttgcaaactttatatgccccagtacaggggaatgccagggccaaaaaggggaagtgggtgggcaggggagtcgggggggggtgtaggaggcttttgggatagcattggaaatgtaattgaggaaaatacgtaataaaaaaaataagaggaaaaaaaagagaaaaaaaagacatacctagagatataatatcctccgtaataaccatctcttttttagtttcctgaaattgaaaattggataattggcctcctcacatttctcattcatagttatattcttaccatatatttctttcatcccaaacttctgtttagtttttcctctcatgctttactagctcctgaagctagggatgataaaacaccttttaatttttgattcctagcgtgtgacacttactagagaagatttgtaatgatatttattttttaagattaatttttacttttagttatgcatgtatgtctctgtgtatttatgtacacatgagtgcagtgcctgtggaggctagaagcagggtatcagatctcctggaactggagttagagatggttgtaaatcacctggcatgggtcctgagaactaaacctagatcctgagcaagaacagtacctgttcttaagtgccgagccatctctaacccataatgctctcttatattaaattgacccgatgaactgcagactggattctcatcttgtttgtgttaaggagttgtgtctccagtactctatccaattttgtctacagaggaaaactcaaaggcttctttggagtctctcttaatctagataacctatatctactctgacttgcctccaaataacacagtaattctccataggcataatgtccacattctccatgtacaagatgatgcatgtagattgatgtgtatgtagtgattgagacaaggaatttagagcagcagtatacacacccatgtgtatggatgaaaactcaggagaacaaggagccagccccctggatacccaacatggagtcaactgctgcaggtagaaatcagaataagccgcactagtttttgtcactatagtgactggaatcctgatatccaggtatcctttctcctacatcaacaaggcagcctttctttaccaagattggagaagaaactagaactgcttgaaacttcttagtgagctaggtctggaggagaaagagccattgctttagtgactccttataactcccagtcatattagatgactgaaatgtattcccttagtaaggggaaaagtataatacattgttatagactaggtggacaccctactggacagtatatcacagaatatttctactatctatatataactttgtattctttgaccaagaaatgtaaattccctccttccttcagcccctagtagctatcattgttattctttttttcttgtatgagtattaaatttcatatatgagatgtggtatttactgttctgtgaaaaactaatcatccatagcatgtcctccagatttatccatgttatagcaaaagacaagattccttaccaccttttaaaggttgaatggtatcccaacgtgtgttatcacattttctccatccatccatccacccatccatccacccatccatccatccatccatccatccatccatccatccatcatctgttggtgaatacttacgctgtttctgttttcttggctgttaaaaggttttgtaaggaacacgaaaaggtagatattagttcctttagttacagaaccagacataggaacatggtaagacgtggcgcttggggctcatgtactccacttattactagcttaattttgtataggtcttgtatagataacctcagctgctctgagttcatgagtgtggtaaccataccatgtctagaaggcagcatttcatggcaatctcctaatcctctggcttttacattctttttgccccttttttgtttgatgttcgctaagcattggtcaagagaatttttatatgtggcatgtggtaaagaactaatttcattcttttccacacgaatatccagttttctttaaactgtttttgaaggccactattgattcctcactgtgtactcttagactcttcgtaaaaaaataataaacaaacaatcagttgaccataaatatgtgagtttgttcttggtgttatattctcttctgttagtaatatatttatatttatgatcacagcattctacttttgttgtggttgctttataatatgttttgatttcagagagcacagtggtgctagtcttgttcttcttgttcactattgctttggctatttgtttgtttttcttccatatacatctaagaattgttttttctatttctatgaaaaatgacattacagttttgatagagattacattgaatctgcagcttccttagaatagtatggacattttctcaacctgagttctcccaggttttgaactgaagatagctttccatttctttcacctttgtctatctgtatctcatatcctctatactgaggtatataaggtctgcatgacaaatgggcctctctttccattctttttaatagctgagtagtactccattgtgtaaatgtaccacattttctgtatccattcctctgttgaggggcatctgggttctttccagcttctgactattataaataaggctgctatgaacatagtggagcatgggtccttcttaccggttggaacatcttctggatatatgcccaggagaggtattgcagaatcctccggtagtactatgtccaattttctgaggaacctccagactgatttccagagtggttgtacaagcttgcaatcccaccaacaatggaggagtgttcctctttctccacatcctcgccagcatctgttgtcacctgaatttttgatcttagccattctgactggtgtgaactggaatctcagggttgttttgatttgcatttccctgatgattaaggatgctgaacattttttcaggtgcttctcagccattcagtatttctcaggtgagaattctttgtttacctctgagccccattttttaatggggttatttgattttctggagtccaccttcttgaattctttatatatattggatattagtcccctatctgatttaggataggtaaagatcctttcccaatctgttggtggtcttattgatggtgtctttggccttacagaagctttgcaattttatgaggtcccatttatcgattctcgatcttacagcacaagccattgctgttctatttaggaatttttcccctgtgcccatatctttgaggctttcccccactttctcctctataagtttcagtgtctctggttttatgtggagctccttgatccacttagatttgaccttagtacaaggagataggaatggatcaattctcattcttctacatgataaccgccagttgtgccagcaccatttgttggaaatgctgtcttttttccactggatggttttagctcccttgtcgaagatcaagtgaccataggtgtgtgggttcatttctgggtcttcaattctattccattggtctacttgtctgtagctataccagtaccatgcagattttatcacaattgctctgtagtacagctttaggtcaggcatggtgattctaccagaggttcttttatccttgagataaaaggttttctgttattccagatgaatttggagattgccctttccaattcgttgaagaattgagttggaattttggtggggattgcattgaatctgtagattgcttttggcaagatagccatttttactatattgattctgccaatccatgagcatgggagatctttccatcttctgagagcttctttaatttcattctttagagacttgaagttcttatcatacagatctttcacttccttagttagagtcacgccaaagcattttatattatttgtgactattgagaagggtgttctttccctaatttctttctcagcctgtttatcctttgtgtagagaaaggccattgacttgtttgagttaattttatatccatatacttcattgaacctgcttatcaggtttaggagttctctggtggaatttttagggtcacttatatatactatcatatcatctgcaaaaagtgatattttgacttcttcctttccaatttgtatccccttgatctccttttgatgtcgaattgctctggctaggacttcaagtacaatgttgaataggtagggagaaagtgggcagccttttctagtccctgattttagtgggattgcttccagcttctcaccatttactctgatgttggctactggtttgctgtagattgcttttatcatggttaggtatgggccttgaattcctgatctttccaagacttttatcatgaatgggtgttggattttgtcaaatgctttctcagcatccaatgagatgatcatgtggtttttgtctttcagtttatttatatattggattacattgatggattttcgtatattaaaccatccctgcatccctggaatgaaacctacttggtcaggatggatgattgttttgatgtgttcttgaattcggttatcgagaattttattgagtatttttgcatcgattcataagggaaattggtctgaagttctccatctttgttgggtctttttgtggtttaggtattagagtaattgtggcttcatagaatgagttgggtagagtaccttctacttctattttgtggaatagtttgtgcagaactggaattagatcttctttgaaggtctgatagaactctgcactaaacccatctggtcctgggattttttttttttgttcagagactattaatgactgcttctatttctttagggggatataggactgtttagatcagtaacctgatcctgatttaactttggtacctggtatctgtgtagaaatgtgtccatttcatccaggttctccagtgttgttgagaatagccttttgtagaaggatctgatggtgttttggatttcttcaggatatgttgttatgtctcccttttcatttctgattttgttaattaggatgctttccctgtgctctttagtgagtctggctaagggtttatctatcttgttgattttctcaaagaaccagctccttgtttggtgcattaaactctaaaaagtctttaatttctttctttatttcttccttgaccaaggtatcattaagaagagtgttgtccagtttccatgagaatgttggctttctattatttatgttgttattgaagatcagccttagtccatggtgatctgataggatgcatgggacaatttcaatatttttgtatctgttgaagcctgttttgtgaccaattacatggtcaattttggagaaggtaccatgaggtgctgagaataaggtatatccttttcttttaggataaaatgttctgtagatatctgttagatccatttgtttcataacgtctgttagtttcactgtgtccctgttttgtttctgtttccacgatctgtccattgatgaaagtggtatgttgaagtctcccactattattgtgtgaggtgcaatgtgtgttttgagctttactaaagtttctttaatgaatgtggctgcccttgtatttggagcatagatattcagaattgagagttcctcttggaagattttacctttgataagtatgaagtgcccctccttgtctttttgatgagtttgggttggaagttgattttattagatattaggatggctactctagcttgtttcttcatatcgtttgcttggaaaattgttttccagcctttcattctgaggtagtttgtcttttttcctgagatgggtttcctgtaagcagcagaatgttgggtcctgtttgtgtagcctgtctgttagtctttgtctttattttggggagttgattccattgatattaagagatattaaggaaacgtaattgttgcttcctattatttttgttgttaaagttggtattctgttcttgtggctgtctttttttaggtttgttgaagtattactttcttgctttttctaggatgtggtttcagtccttgtattgttttttccctgttattatcctttgaagggctggattcgtggaaaggcaatgtgtgaatttgtattgtcgtggaatactttgttttccccatctatggtaattgaaagtttggttgggtatagtagcctgggatggcatttgtgttctcatagtgtctgtataacatctgtccaggctcttctggctttcatagtctctggtgaaaaatctggtataattctgataggcctgcctttatatgttacttgacctttttctcttactgcatttaatattctatctttatttagtgcatttgttgttctgattattatgttttgggaggaatttcttttctggtcctgtctatttggagttctgtaggcttcttttatgttcatgggcatgtctttctttaggtttgggaagttttcttctataattttgttgaagatgtttgctggtcctttaagttgaaaatcttcattctcatcaactcctattatccgtaggtttggtcttctcattgtgtcctggatttcctggatgttttgagttaggatctttttgcattttgcattttctttgattgttgtgccgatgttctctatggaatcttctgcacctgagattctctcttccatctcttgtattctgttgctgatgcttgcatctatggttccagattactttcctagggtttctatctctagcgttgcctcactttgggttttcttaattgtgtccacttccctttttaggtctagtatggttttgttcatttccatcacctgtttggatgttttttcctctttttcttgaaggacttgtaactctttagcaatgttctcctgtatttctttaagtgagttattaatgttcttcttgatgtcctttaccatcatcatgagatatgccttcaaatccgggtctagcttttcaggtgtgttggggtacccaggactggctgaggtgggagtgctgggttctggtgatggtgagtggtcttggtttctgttagtaagattcttatatttgcctttcgctatctggtaatctctggagttagttgttatagttgtctctggttagagcttgtacctctcgtgattctgttagcctctaccagcagacctgggagactagctctctcctgagttttagtggttagatcattctctgtaggcaacctctcctcttgcagagaaggtgcacagatatctgttgttcgaacttgcctcgaacagggcctgtcccagaagctgttagcttcagtagttcatactctcacctgtgcagactagtcttggcaggatccaggaacgaagatggctccagcagatgctctggcaaagccctcctgggcggggtggacacctctcctctggcagggaaggtgcccggatgtctggagtccaaaaaggggtctgccacagaagctgtgtggctctcgcctgtcccagaagctgttagcttctgtagtccaccctctcacttgtgcagactagtcttggggggattcacgaaagaagatggctcctgaagatgctacagccttgccaatagttttttgaagaattttacgcttatatttaatagaaacaatgccttatgattttcttgtggtttcttggactatggtgatatacacccatcttttactaatttttcagttgataatttttattattgtgcttaatctttttactttataatttttacttatgttcagattttctattccttcacagtttgttcttggtttggtttatgtctttaaggattaattttcttctacgctatcacttttgttaaactagtattatccatggatagctcttctgatcctttgtgttttggtgatatcagttgtgtaatgtttttaatttctgatcttatttaatagcctttctattcattagttgaggtagtggtttgtctattttttctcttcaaaacccaaatcttttcattgccttttctctattttatttttattttttataacattccatttgtttatgatctgatctttattcttctactatgttgcttttatgtgcttttgttctttttgatatgttgatatactgctaataaattactgatgggattggatttttggaatggttgatttcccattttttgtccctgtagtttttcccctgtagttggactctcttagagagtctaggctgtccttgaattcatgtcggtcctccagcctcagccttctacgtgctgggattgtaggtgtgaatggcaccatgcctgactcccattttcttctgactaaagcatttttatttctttttaaatttcttctgtggtccatttgctgtttaataatatttgtttaatgccccactatttgtgtgttttccaagattctgttaataatttttagtttcatcacattatgatctaatttaaaaatactttctacctacctgctcttatcttttgatgttagatttttttagcctgatgtttgataacttattcttttttcccctgctctggaccttccgttctttgatttaactggcttttgtttagaacattctgtctctgaaactattttcttgctgtccagttttattttggtttgattaaagtttctttggtattctggtcttaggcaggaaaaggacctcttaacaagcactatgatataaatatttatttcctccaaacttcatatgccaaatcgtaattctacagttgacaaacttaagcagtaggttcctgggaggtaactggaactttatcatgtgcacttcatgagtaggacttagaacccttatagaaagaaggcccagggagaagttgttgtctatgagcaactgacacttaccagacaaacttatctgctggtacctttatctgaaaattcatagtgaacagagttatgagaaatcagtttgtcttgccattatgtgtattgttatcttgtttattattgcttattattacctactttatgatatcttatagtaaggaatccaaatgaactaagatagtaggcatttctttggtatttctgggaagaactcttacttagaatcacctatctatatgctcctaagtcagagaatatttgtcagatggataatactggaatggacatttctagttgacaaagatatgtcaggtttgagaaatggtttgaaaagtcattccaggcatagttaatagactttcctattcacctgtactaaggggctggacttcactactgtccccaaattgagatgtgagttttaccatgaattcagagttttctccttaaaatctgagtcctggtggcacagagtgtacccatgtatttgaacccatgtattaaccaaatttttgagtgaaataacagaagaggaaatgatatacaagctttcttctatctggacatgagaacccttttctgtgtctttgaaggcaaacagccgtggttggtcatattccgtctgctctatatagtgtctttggcaagtaaacttgtctctttaaattcagaactaaacttactttactatttatataaaaattcaatagttgtgcataggtaaaacaatcttgctgtgaaagtaaccaatagtacttaacacctagtgtgctctcactagatgcttatcttattttccttcttgatgttcttaactctgaaccatttgacagatcaaggtacaatctcttatgacccatattcgctccagaagtttacagtttctagatatggaatcatttcatgaactacctgctaaatgactgtcattgtaattaataatagtacttaggaatgtcaatattctctcaggtatctaaggaaggaaattgagaggctgcctacttagtagatgtcacattgactgaaaatgatgagaacatttagagtcatacctttattcatagggacacactacatgggcagtttgcaaaattccttttatcagcaatgtccttgggttatgtattagttatttttcacactcttgtgacaaaaataccaacttaagggagagaggaagggcttcttttcaatcatggtttcaagtgatgtaagttatgacaatggagccagcccagctgtggaggtagtatagaaccagctcatctgtagaggtaggaacttgagttttttgtttgtttgttttcccacatctctgaggaccaggaagcagggagaaaaggaagtaggatttgactataaatatcaaagcctgtcccagtgacctatttcctacatgtacgctttaagaggcagaggttttacagcctcataaaacagtgccactagctaggactcaagtgttgagattacatgagtttacaggacacattttacatccaaacaattctagatctctaaaacaagtcatcaaatgtgtggccttcatcttgagtaaccatgtctgaagaagaagagacttggatggttccttgtgttaaatattgtgcctgaggcacatatcttctgaaaaccctctccttcctgtcctgttccatcgcctttgtcttactaagccccagtgatttgaactccgaggttctggtacctgatatatgtagttactggatttgtaagaagaaagcatttctttgctttctcccaattttatctttgggatgtttctttccctacgatagtcaaaagtgtgtgacttagaatctcaagaaacacgagctatgtctttggtatacatgctgtgcactgtacatccaaaagcagtattcattggtcttagattttggagagaaataatttttaatatgatagattcttgttagaactattagattaaattattccatttatttttcttcaacaaacatatttcatccttgttatgttcttgggctatgcttatgtccatttgaagtttgactctctgtcctcttatgattcataatctagtgagatagatgataaaaatgatagttattgtaaagaaaaatgaagtacttcaaaatttgcctatgttaggatataactttgacaaagttagtactgggaaggtggccttaggaaaggagctctttgcaccttcatttccattatttgtgctatttcttgtgtggctgtggcagccttgatcgagctggagcttaagggagtggccaaatgagtgggagtgaaaggaagttagaaatgaaaccattgtggagagtcagcctcatatgatttcagagtgattttaccttttattcgttcaaatggtgcaacgtgtagtgtcttaatactaagagcaatgaggattgacatattaaaaatatatattaactctgctatgttgatgaaaattgtatgaaaagcattctacttggacgcttttagttctgtggcattaggaccatagaataaattctttttgacatcagttttgaagaaggagctgataagttggaaggaagcagtttttacaatggagtaaatatacttgagtttgaattttaaactataactgtggtttgaccataaattaagacagcctccttaacaacaagaaaaacatttaaagcagctttcatcgattcaactgattcataagtgctggccataaataaatattcttggaggtttaacttgttgaagccagcttctttagccagtgtcttcctggaaagcattttgataaaatgcatattgtgataaaatattttcagactttgatctggtaatcctgtttctttagcagtgtgtactgagtaaataaatctaaaatctcgataaatcatagtgcaccaccactttgtccaacagtttaacaagaagaaaatgattagctaaggtttggaatacttgtgtaatgaaatatcatggagcctttcaaacattgttaaagaatattaaccatgcaggaatagatttctacagttcaactgaaaaggaataacaaacaaacaaacaacaccaagctgtgctgggaatgaacacaagccagtgctgggaatgaaccctaggtcttcacatgtgctcagcaagcaatttcccaccctgacctagacctccagcctgcttctgtagacagcatctccattataagtctttctgttctttgtgttggaagatttatattttcttctctctagttttctgtatgacagaatatatgtagccaacatgaattaaattcatactgaataaacatgttctataagcatttcagcctttgcctcagtgagacaattttgactactatccaatccatttccattagtatgatatatacctttttcagatttttatctttaaaacattttttctttgtagtgaatttttaatcttctaatatttattttgattttttggcatgattttatctttgttggttctggtttcaaggtattcttaaaatactgacagttttattccccattgcaagagtattttttcaggggtaaagtgcttacctagcacatcgcaaggccttcgattcagtgcctagtaccacctcctccatccagagttcatgggctcattaccagctatgctaatctattatttgccgtatgcatgaaaattctatgttagtgggaaaagggagtagggaaggtgtcagtagatcccaaaattaagatctatatttgtttcttctaaaactttacgatctagatttctctaactgaatcttatcttcccaaacatattcatgatgagaagagagctaactttcactgaatttgtctttgagccagatacttttatgtattgtacagttttgcagtctattacaaaaattcttttaaataaaaccatcatttggaaattgtacttacattagaaaattacaaatgtgttcaacagaaagcaatttgaatttaacttaattctaatggcttatttctaatgaaatagttctttatagctaattaattttgccattgctcccattccttccacccaagaaaagatacttttgtggtctctactccctcctttctttcttgcttgcctccttgctgtgatagtggatgccagcactctgctacagagttgtactcccagctcgctttcttactttatgttttctgaaggttttcactaagttagccaagctgttcttgaacttactatagccaaggcaggccttgagcttacagtccttcttccttagccttctgagtagctgaaatgatagataatgcttgtgacaccagaactgacaaatcatgcttttctctgtagtgcctatgattaagtaggctcctctcattccttactatatcctagtctctagtctaccatcggcctagcaggttagttgtagactcttttaaaaaattttttattaggtattttcttcatttatatttccaatgctatcccaaaagtccccccatatcccccccactctcctacccacccactcccactttttggccctgacgttcccctgtactggggcatataaagtttgcaagaccaaggggcctctcttcccaatgatggccaactagcccatcttctgatacatatgcagctagagtccagagctccggggtactggttagttcataatgttgttctacctatagggttgcagatccctttagctccttggatactttctctagctcctccattgggggccctgtgctccatccaatagctgactgtgagcctccacttctgtgtttgctaggcccgggcatagtctcacaagagacagctatatcagggtcctttcagcaaaatcttgctagtgtatgcaatggtgtcagattttttaaacccaagcatttaaatacacgtagaaagttgtattagagattgttggtacagctgtgtgtgtgtgtgtgtgtgtgtgtgtgtgtgtgtgtgtgttttcctcctcctttctcttatcttcctggggtccctttgtttggcttctatttgatttgtttacagagatgtaggctttgaagtaacagctatataggactattaaagagaagggtagagcaagtggactgctttataggtaaacatgtacctgggttgcagccactgtcattcataggttgtactttcctctcacatgtctgcattgactttcttgttgctgtcctaatttcctgtagaaatttactttgttctttgtctcctaaattagaaagtagttcacattactctataaatattgaactatcatagtgttgcctgatgtgttagtgggtacttttaaaatacatttttggatataatcatttaatggtattatcttattcttttttttttctgtttcgtgataaagggctttgtgtatctgttttccttcatatggaatttctgtccttaggtaaatgctcctttatagatatgccattgccattgcaaggtttgtagtagtaaaactgatatattttgtgttgttgtgatcatagtgagataagtagctgcgaggtaaaactgtataaatagtcacaactaaaatatcccctataaaaatagaaataaagacatatacatcatatacagttcatgattactgagaacatcctcaagtatgtcaggtcttgtaaatatggcttttcagattgtttttattttttaactcatggagggggaataagagtgatctatttttggcagggactcaagggaatatcagtgtgactgttacctgccacttttgtcacggtcaatttctacctgagttctttgggtttttttttctctttctttctctcattattttggacagtgacatctctaaccttttggtctgagcaatgtgttgcccctgaaattggttgagtcacttaatattttccccacctgtcaaagctgtagagatctgtaccttttgccttctgcttcctgagccattttcctgctagtagtaatcttctattgtgtctggcaagttttcccacatgtttgatatgaaacctaccagagtttgatccttaaagttactcaaggttaagaggctttgagacttctgttcacgaaagagtaactggtacatgattggttactttcaagttaagaactgggaaccacacaaaatatgtgaagaaaaaaatgtattctgacattgggcaccaggcatacaggctgcaatctctgaaacggaacaaatgaacaacatgaatgttacagacatcctgactttttgtttgcaatcagtttcaagatctgtgagcctgtgatcttgctgaacttaagagacaaagaggtgccgggcgtggtggcgcacgcctttattcccagcacttgggaggcagaggcagtcggatttctgagttcgaggccagcctggtgtacaaagtgagctccaggacagccagggctatacagagaaaccctgtttcaaaaaaccaaaaaaaaaaaaaaaagacaaagaggtgccgatagcaggaattggtggaagatgttattagagatggggagctatggacagaagtaactcccaaattctgcatggatgtaattctgtgtaggtatcgtcataaacatctgagtttctacaccaggatctaggaaacactgcctaattaccatgtgcatacagtagagcctcacaaaccttcaactatagtagtagagttaaattaaccctagagtaaaaggctactctgatcacaagtgaacaaacaaaaccacaccttgaaaaatgactaacagaagttttactgcatacaaaacttgaatgctccctaagggaatagagcaaagcccagatcctcagcagtgtaattgttaaaaaagatctagcccccccccccatattagatcttccaagaagcagtaaaatgtgagctgtaactaggagaaagtcagtcaacagaaacagaaccaaagattaatagagggagacttaaacgactctgaaaatacattgaaggattaaatggaaagcataaatattacaaataaagaaatagaagagtatagagaaccaaaaggaacttctggaagggaaaagtgtaccatatgaaatcaacatttattggatgagataaatagcaaggtaaacattacagaaaaaagtactgatgaatttgaatatgtaagagtagaaattgtccaatctcagacacaatgagaatagccaagttggggaaaagtcactgaagtctgaggaactattaagcagatttatatgctatgtaactagagtcaaggaaagagaataggtagaaaatagttgaagtaatgagtataaaatttccaaatatgttgaacactttggacctctctctccatagatctaagaaactaaataacagaaaatttagaagcaaaaaaactacaagtaagagtaattgtaatcaacctgttaaaaccagtgattgcatttcaaatgctaatggagaaaaaaaaaacattaagtgcagagagggtcatttccttctcatcagaaacactgatagtcagaggacaatacactggcaactttcaagtacttaaagtgagaaaatgtacttctgattttaaagtctataggtaataaaagcatctataaaacgaagaagaaatagaaatgagggtgaaattcatggtttgagatgaaaatagaaataataggctccatcacaccccagctgtaagaaatattcctggcagttttgagacagaaggcaagtaatggctgatgggggcagagagaggtatgaccttgggctggctggccagtcagtcagtctaagcaaaacagtgagctccagatttagggacacggagtttcaatctctagccaacagataagcgggcactcatacttctcacacatacatgaaaacaatgtatacacatacatgcacacacaaatatagatattgtagatgtaaatgtaaccatacaatagttagttagaagtaatgtaatcactgctattaaaagttacaaaaaatgtaagacctaaatggatactgtagataagagctaactttaaaaataaacactgcttaaaagcatgaatgtggaaaaagatatgtgaacaataaaccaagaggaagccagaatgctcatattagtataaaatgtagtctttaggaagagtggtgttaccaggaataaggctagccatttcataaagataaagtgaccaattcactaagaaatcaatgactggaaatatgtccctaacagaacttggaaagtaaatggaaacatgcatattctgataagataaatagacaaaactatcatcagaattgggtattttaactatattaacttggtgcttcatagaaccagaactagtagggaaaacttcattgaggagatagaaggcaaatagcacaaccaactaaatctaattgacatttataaagtattggaaacaagactaccagaatacattttcttctccaatttatgttacattcactgtgagccataaaacatactttcaacatatttaacaaggaactcagataatgtatattctttgaggaaaatgaaattaaaaacaacaaaaggatatctggaaattccccaaatattgggctattatacagtatatttgtttgttgtgattattgttattttgaggtagtcttgtagtgtaatacaggccagcctagaatttactttgtaaccaaagctggcctcaaacttacaatgattttcctgccttaccgtctcatgtgctgggattacaatcatgagctgccatgcctggcttttagtatgcaattcatgtaacatgaattggagaagaaaatgtgaataatgagccaaaatcataagagacattaggagatattttagatataataatgaaaatacagcatatgcaaatttatgggatacaagtaccacagtgcttgaacagaaataactttaaaataaactaaattcaacacacttctactgtaagcaacgagggaacaagtgcagatcctttcaggtaaatgagagaaatgaagaaaaggaaagattagcaaatggaaaataagtaatacaggaaaaatacaaggcagatgtcagctcctagtaagagcaataaacttgctgagctgatagctagacttacaaagattaaaagggaaaaaacatgcttgcaaatactcaatgttggagacaatataatagatccctttacaacttttggagtcacaggaagaataagagactgttgtgaatattatgctagatatttttacaatgtagataaatgaaagattccttgaaaggcacagttgatcaaaatgaactcagaaggagctaagaaatctgaagagcttaacatctgtcaaagaaattaattaagaatcatccctcagttaaaaatctagctactgacatatttcatggtaaatcctataagatgtttaaagaacaaataaggtaaattcagaatagagaggacagtagaacacttctgaattcatgccacaaggccgatgagattgggacctgttggtgagaatgtacaggagccatggagaacagtgtagaaattgctgagaaatattaattcaggactgccacagtgctccaacagttcacatttgagtacatattcaaaagaattgaaaacagcttaggggtttcgcaggtctaatatacactgtgtcattattcacaatagccaaggtatggaagtaacacataatagtcaataaataaataaataaataaataaaggaattgttatactgccttttaaatggaaaacattcctggtatttgcaacaatgtggattcatgtagagactattttgctaagtgagataaagcagccacaggagaacaaacactgcatgattacaaatgctgtggcgatgcttctatgagaactctgtagaagtgattactagaagcttaagacagagctgggggattgttcattgttatgttaggttacagttacacttgatttaagctgtaaaaaatctcctatgtgacagagtcctatagttaatatagtacggttatatcaaaatccatgaaggtggtttcatgttaagtatccctaaacaaaaggatgcaactttgggtaagctgacagataggtcttttaccttgcttgtgatgatagtgtcatagttgtttgtaaccatacaaactcattaaattgtgtataatacatttagctaactaaagctgttaaaacttgaagaaaaatatcagtgtcctcatttgtaatagtctcaaacaagaagccacctgcagatctttcaccaaacttgaacaacctacacatctatcactaaactagaggcaacctatatagctatcacagtttactggataactctttgttgtattcattcaatggaatgctaaacaatagtaatgatcattcaagacgtttcaatatccagagcactgttgctaggtgcaagaatactgacacagtagaagctagatagaatgatcctatttatatggaattctagaaaagacgaaactttagtgatagaaagtaggttagtatttaccaagatccaggattgcaaggaaggaagctataactaaagggcatgaaggaactctttgggataataagagttccagaccttgattgaggttcaacttacatgcatgtgtacatttgctacagtttttggaattttacatttgattctggtgcttttttgtataaaaattatgtttaggtaaagggatgtttaagaagcagtttggaagaaataccactgcaggctaaaccaattgtagctgagtggtagaatgcttgcctaacttgtatgagggtattggttcagtcctcaacaccacacacgcacacactctcatacacacagagacacacaatcctatatagttcatggtagaggaccttggaagtttcaggtgttttctgaaagtgaaaagaaggaatgagggagaggaaaactagatcatcagttgtttgcatagtccctggagtctgattttcttccttgcttgcagccaaagaaggaccttaaaaatcaaaagagtcagccttgttaactaaatgcagaaagcacgtgaaaaacaaatccatcacttttattatgggtcttatttattaggctgacacattccatcagatctccatggaatgagaaaggagataaaatctagaacaaagaagctaaaatgattttccagctcattttacattagtgcttaaattaatcagcgtgtttatttcctatctactccattcctcctgagtgggctccacagcaaaggcaagaaggtaaagaatagatcattaactgagaagatagaacataggtacaaaatctaaccacttgcttgtttctgttgttttatttaaagtattgtgatttccctggttgtgctatatattcagtcacaggaaaataccaaagcaaagccccttaaaaatctttaatggtagaaaaaaactaagaggagaccgtacccactaattgtgtccattgctattcattctaaaacttctggacctaattttgttttcttaattttgttcatgctgaggaatcttcagatgtcaacaataaagcctctttttgctcggtctgtttcatattaaaataacccttttcataggaaaagctgagttgcaaggtttaaagctctttgagaaaaacgattttggaataggaaattcaaatggaaattgtttcatttttgaaatttgtagtaaattgtcacctaaaattagtgagttagatactcaaggaataaaaatttgtggtgtgtttctcttatcagggaagaaaccatagctagtccattttcagaatgttgccatgtattaaatccaatgcttattgcagtataaattaggaaaagaaaatgtgtacagatacattacttttcccggccaggtaatcatgcttatctaaattggactgtaataaaataagacagcctgtcgacctgaaactggattttaaagaagtttgctgaaaatggttgatttagtctttctaagggtaagaaatggttccttccgttcgaaaatggacagaatcatagtaatggcctaaaagtccacttctgattggggtcactgcgcgtcgggggtgattagtcttgatttataaagagaatccattttcctagacttcactcctctccttcctttgccatttaccaactaaattagaaatataaaagtaggaggaaagcatatagtgctgctattcttttatttctgttacaaccaaaccaaaaaaactattagaatatggtaattcttgattctcaaaatgtagatatttatgatcttctatactagtcatgctggctgacctcagtgccttagtttcccaggagccatgaggtacaggctccatggttgaagggaggggtatagtataaagctatggttttttgtgtgtttttattaggatatttttatctataataaacaatggtgtgtaaagccgggcgtggtggtacacgcctttaatcccagcactcgaaaggcagaagcaggcggatttctgagttcgaggccagcctggtctacagagtgagttccaggacagccagggctatacagagaaaccctgtctcgaaaaaccaaagaacccccccaaaaaaaaatggtgtggatgaaaaagtgtccaatgcatttagccaccccttcactctcttgatccctccagtttagcctattttctcatttccagttgatgtgagatacagattacccagagcttaaacattatacagtccataatataaattgtataattaatgatcagattccatacagagataaataatcactaaacaaaggcagtgggatttttttatttggaggacagttggtagagaaaaagacagaagaagacttgcatttcccaactgctgtcaaataacaggacagcgtgcaatgagaaagcggggaggaggctctaaagggtgttggtaatagaggatgaaatggtaggctttgatgtgcatttctaataggaactgtgtaagaatttgtaaattggtgctggtctttctagatcagtagttctcaacccgtgggggtcaaatgaccctttttatagggatcccttaagaccatcagaaagcatagatatttaaattatgattcctaacagtagcaaaattacacttattcagtagcaatgaaaataattttatggctggggtcaccacaacatgaggaagtgtattaaagggctgcagctttagagaagtcctgtctcaacctctgatgcacttctggagggggaggaggaggacagggaggaagaggaggggaagaggaatgcgagaagactcgtccctctgcttatctagagagttaacagtttggtatccatagaaatgttcctattctgtggtcatttacacgacagctgtacttactcccctgaagataccacctcaccatgctcacaggaagtggcatgtgaggaccaagtagctttctataagacctgaactctactatatcctggatcatgggatttgtagctcctaaagtataagaaaagtttctttaagcaattattgataattattgatatagtttctgttgcagtcctgctgacaaattcaggatgtaatgatattggcatattttatattcatgaaacctgcaatttatgtggcttggaaaggaaatatacaacttcttttcatcgaagtaggaagagaagtgttttcactcggtggtggaaggaaggcaccatcatttttggtttttatttaagcttcctagatcccagtgtgtaattacatggtatgagaaatataattggatttttgagctaagaaacaaagatacaaggcttctctcttttctcttttatctacctttaaaataaataatcttgcctgagtgcccacagcaaaatataggtatgatttatattatttgtgctaatattgttatctgaaaacttcattcaaaatgagaagtgagagctcgccatggactgtgttctttttttttttttttaacttctcactttacgttgttgtggaaggagaggtaggccttgagctacactattgttaagtaaatacatctgtttcattgtctcatgtgattgtactccaggccgacaaacacatttctaatgcattgtcgcttaaatcaatagactgtctcagaagaggacattggaaatggcatgaaatttgtactgggacaatcctgtacagatttatattgttctttgtgtcattattgttctataacagctatgttttggagagctacttttgatctgacaggaactggctgccacttggcagcgaggattcacctagattaggtagttgcttcctgtttctatatatgggcttgggaaaatagcgtttactttcctccaaagatttctcagaacatactggtacggaatgttcagacgtaggataattcctttaaaagctacatctggttaccctcagaaaaataattccattaatatttcaactcattttgatccttttgtagtttgtagtatttttttttcaatgtatgtaggtggccttaaaccatatggcaaaagcatttccccaaaacatacaatccttgtcttactatgaactattttccatatttccttgttatttgaatagctcctctcagcaggctccaaacccccttttcccctttgatccagttctgcttatgctgatggctaagcttacatacactgacaaacttatacgtgttttaataacgtgtttaagaatgaaatcacctattcctttcctgtgtttggagtgaaaatatgttgttactatttttaggtaaaacgcatcgaatgtctgtgcagtcattgccctgtacagggtcattattattcatacgatgctgtattttgggctcagtgatttgttttgtatcagtctactttaaaatactcaactgcctagattctttttttccattaaatggtgcttttagatgctttacttttaagcctgtgaatactttttttcaagataaaaggtactggatgtgcatttatacatgaaaaatcagagactcagacatttaaggaaaaacttttttctgtctactaaaagtctgaattcttacatcttcaaacatctgtcttaaacttagtaaggctgtcattccctccccttcttgacagctgctttacttcagtcttaactcccaaagtggatgttgcctagggcatgtaagaaataggaaataacatagataatttacctgctatgaggactcttaacaacacatattcaataatgtcaaaaattcaaagaatgttaaatctggcttccagtcctctgcagctttacatccccatgccctgagttactgtgacgtgcctttgcttcctaggctgctttgcaaagatataatcctggagcacccttagccatatattaacaattcctcaaagaatgaccatagcattataagaaaccacatgtaattctctcgactatgtggtcaaattccttttaacatatttcatagttcagtatagtgttagtatgtgtagctctatttatccttatattttaagtatttactggagaagatgtagttatattattagaagaatgacttgtatgtgttctagtggtgtaaataattgaaggtgtagcacttctaagtggcttccatttcaagtgttttggtaagaaatgaattcactcccacttttatgtttcttaattcactggtgatgaaagtatacaatataggtctgtattattgaaaaaccctcaaggtactttgaaagcatggctttatacagatcatagaatgactttcttcattctgtagctgtcagtgctgtcaaaggacctgtcttgtgtagggatgttgtctagtcaatgtaacaagagagtattgatgatcttgctgtccataggagtggttgcagaggtggactacaccaagatggaaaatggaaaaaataaagaggtgaaatttatctatatttagcacatggaagctagaaaacagaaaagttggactttccctttggattttcttttaatacctttggtataggtcacacccagtgcctgaatgtcacctttgccttgatagtgctgtcatagatttcagtactattgagcattgagttcatggaggaagggaccttttcatagtgcaccctggtttgtctgcagtgcttgtttgggacccagtctgccattgtgcctgtcagaacttgccataatttaaatgtttaaggtgggtgggtgattaacctgtttagcagactgtcttactgcccaagaactttttgtttttacctttttattgattctttgtgaattttacactgtgcatctcagtcctgcttgtctccccagcccttcatatcagccctctgcccttgcaagtcccacaaaagaaaacaaaaagaaaagcaagcaaacaagcaaaaacctagtcatggaagctgcagtgtgtcagtgtgccccactacatccccttctgtgcacacatcttcacttgcaaatgttcactgcaatgagtcattggtgtggtttgaggcctcaggcttctgctgcactgggtcctcaccaggactcctcttagttatcatattgttgccctgggtcatggagatactgcaggctttcttgttctttttctaaatttggtttttattttttcaagacagggtttctctatgtacccttggctgtccttgaacttaactctgtagacaagcctggtcttgaactcacagcgatctgtgtgcctcgccatttcagtgctaagattaaaggcatgtaactagggactaatgagaaatacataaaatatggtatatcatcctaaatttaaatattttagaaagcagaagtaagttataccactattattatgaatattcatagtaatacagaccatgctacctgtgatatatttctatttttgcaaaatgtcctaaagcataattggaacataattgttcaactgagtcatgaatcgaggctgttactggcttgctgcagaacccaagtgtctaccatattcagctccattttgtgtaccacatagtatataaaaccttttgtgtaaaactaaaaacttctggagtaagggtatttgctggttaatgtttgcagccactcttcacctatctgaaccatcctgattttactcgggcaaactaaagacgcatcggatctgatgaaatgtctttgtatccctttagcttaattgatggtattttgggcttggtttatagtgcgtgttttcacctgccttgtgagtaagctgtgactgtttgcctcttgctggcttcctatgaaccaatggctgcctttttaatctttcataaggaaaggtttttgctgaagttgttgattatctgttcccagttttttagatgtgacttacaaatgaggcagtgatcctaggtttaaacagaatcctgcagacacctgtgctgatttacggctctagactcaacattaccaggtctgagtgtttattttactatgtttgatctgcaaacaggaaattaatagcggtctgcaagaattgttgatgaagattaacatatagactttgttaaaaccttaattttgtatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtttggagctgagatgaaaggatggaccatgtagagactgccatatccagggatccaccccataatcagcatccaaacgctgacaccattgcatatactagcaagattttatcgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacaccagggccaaagggggggagtgggtgggtaggggagtgggggtgggtgggtaagggggacttttggtatagcattggaaatgtaaatgagctaaatacctaataaaaaatggaaaaaaaaaaaaaaaaaaaaaaaaaaaaaaaaaaaaaccttaattttggtgtctaatgtctcaacccaatgcactagccttgagctccttcaggccttgtcttttggtctttatgtcttaggcactgaacctagcatatgggaaagactcagtagatgctgtcttgttgaattgactggtttaccctattttatcttctgttacagcccactgtttgtaacatggaagattggtcgagacaaaagactgcgtggatgcataggtaccttttctgccatgaatttgcattcaggactcagggagtacacacttaccaggtgaagacccatttctgttttcatgtacttctacttacaaaaaactcttccgctccttgaaagtgatgctttgactccttttcatttgttcaatggttgacattactctctcatttcttgttagcttttttctttttggtgtccaggtaccttatcttataaagtattattgctatgtatcattctataaatgctatggtgacatttatcttgccactgatttttagagtgacttttttttcttccattgggcagcttattttgtataacttgaaaatgagtgactaaatatccatgagttaccaaaagtctgatttctaccttaacagcctagatttgatcacctttaagacctttaaaaaatacttgttggttttttccccttcattttatacattttgcccaacttttatgtgctttaaaacttgaaaagaagtcctaggaagaaagtgctgtcacagcctgacagcatacccgttctcattcccattttgccctcaactgtagcttgcttaagtgctttcctctaacacaatgggaaagtcacaagtgcctccttacatttcataaggctcagccttcaacttctccactaacagaaagctatctaccatgccatctgattttgataaatacaacttgtagcaaattatgttccataattatttcagagaagaagaaaatgtcttaaataatgacctattagtaaaggcatttcctagttttgttcatgttttagtgtggctaccgacacatagttgtaatccatacagtattagtataataagagattggtctttgctaactgttgttacttggggcaagttgcatgacttccataggtaaagtgataattctagtattttcttctatatactcaatatcagtgttaggaggatgttaggagaatgaaataattagttactactttgttacatgattggtgtgaaaatctatcttactgtagagttgtgtaaagccagacttagagcaccaatatttaaaaagccgtaccattaatgttctcatgttctaaatctagaaaactctataaagcagcattttagactccagtttatctgagtgcagacccttttgtccctctagtctggtgtcttgtgtcacgacgattccaaggaacttaactttgtaaactcaagcctgttaagaacttttacaagtgtaaaattttatgtttatgtatacactatttctagtgtagagtttcttggtgctttcaagtgaaattgtgggaaacattccattatgaaatattccatactttacaaatctttggtagcaatggtaactggtaacaacttgcttttgtttagagaaattcttttgcctaggaagtgagaatatccaactttttttttttaagcttgtggtttttttcctgagaataatgtgaactgagtaaatttttcacacaattgaaaattgcctgtatttgtgtacttttaactctgattgcattgtggtctgtgcctgggaacttcctggttacttttcaaccctttccttgtatttctatacagcttccttaaattgtatatagtacattcaaaggaatgcatatatatatatatatatgtatatgtatatgtatatacacacacacacatattttgtgttttatatgcacacatataagcatcctgtttgcctctcaggtttgtgtcaataatttacatataaatcttgatatttagaagagataaacaaaagaaatcttaaaaatttaattactattttaattcattttggaatcataagctgtatagagtcattctttttagaagttttaatgtaataatgcttttcagtcccaaaaacatacttatgttcctctacctgtgtgtttctatgtgtgagtatcttgagaaatgtattttgaattaagagtttttaaagacaagtaattttggattagttacaattattatttgacagcctcataaaatgcattcttcttatccttatcccaccttcttttctcatcactgtcatgctcatcgtccttagaagaccctttctcacagccatgcctctgtttggtttatgacagtgagtttagcatgggttgcttgtatgactagaaggttggaaatatatactgaagcttggtggtctcaccagtgggcaaacaagggaatacagtgactcccctttccctagtgtttatcttccagcagcagtagttcagcagtgaggtactggggcccatgagcccttctctcctccttgtctgactccgtgtacttatttcctacatgtgatgctgttgggaggagctttgttcattctttgtactaacttgtagatattagtaactacatctttacagcgaggaaacagagattaaagaatttaattaatttacttagtcttgcatctagttagtaagtggtagaactcaaatgcatgttcaggccacggactgcaagaacatactttgcactgtgacataaacacagaattctatgtcatgtctatgttctcttaatgggaagtttgattaagttagttaaaatagatgtcataaacagaaataaaattgttattcttattttattttgtagcttcaccatgaaaataacaaactcaaaagattactttaaatttaacaagtcaatgatcagtaattcttcaaaagttctaatgaagagttatgattaaagtttacttgaattattattgtataaaagaaaatgcttatatcaaaatactactctcagataggaaactataatttttggttgtatagcctagatttcaagaggaatttagaatttctaaacatagcaagttagtggttgtttttgaagtctagtcttcctatcataaagtttataactcacaaatgaacagacacaaagagatgaacttaggggcctggctttagccggggagtaaggagagcaggagaatcaaacagttttcagtgatggggtaataataaggacatctagttattggtgggcttcatcagcgattaggtagacattccattttccagaatgctattcacacccattcatattttggtaaaatattagtaaaattatgttttatcattttacaatgtacacttctgtgatcttaactacattcatgttgttgcatgaccatccccacttcttatctcaagaactttttaatcctccctgattggaactttttaccctttaaatgttcattccattcattcctcataagccctaacaactacttttctaccttctgtctctatgaattgacccctccaggtccccaattgctatcacatggctgacttactttactaagcataatgtcttcaaaatttcttcaagtgctaggatatgccattttctttcccttttaagactgaataataatcttgtgtcaattatttatgatggtttgtgtatccatttgttcatctgtggacccttggtcagtgtctacctttgggctattgtgaatagtgctacaatgaagatgggtctccaaatacctgaatagtctctctataaaatagttatctcaaatgacaatcatgtagcttgtttatagtccattaatcttttaaaatagttcttcaaattttccatgtattttttaaatgaaatatctagccttggtttaagttttgattcataaatgaagtctttaattgaaattttgtcatagtcaatgtttacttaattgaaattttgatttattttggattgaaagaagactttataagttgcccgaagatgttctcccaaccaattttaaaaatccatagttagaaggtatgaacactgtgtgataattacagtatgaaactctacagaagctattgcccctctcttcggcttaaagacaaaagcagggaagtttatagtgaacatgaagctggatgcatagctgagggtcacagagacatactcaaaacacagtttggcggtgaagtacatgggttactgtccttttcattgcctagactttgaagtagaaatagtcttttgtctcattgaataagaagtttctagtatttatcattttgttttacccataacttatagtatttatgtggatttatagcttttctaggctggacaatagaaaggcttatctttttttgtacttaaaagcatacttgtaagtaggagatgaggattaagagaggagtgtagtcatctccgtcaatgaaggggtctttaaaatgtcttataaattgatcttgaaagcacagctctaactctatgtgaattcatggcaataacatgttattctagaatacaggagtgactgatacttagtaaagacagggatgtggccagtcaccacacttacaaaatgattatcttttttcccatctgtttcttgtacatagatgtctgctgagcagtggagtaattatgtaggttacagcgggacctggagctccagtcttcactatgctgcctttgttgtgctctgcattctgagaaatttgcagtgggggtttagttctttctaagaaatggagtaaccatataaaaagaagagattgttttgattttgagttttcttttattcggtgtgcacaagtggtgggtatatgtatgtgtgtatgtgctgaaatggaataaccagaaaagcaagcaagggattgtttgcacattgcaaatgttggcttgctgttaggttgtttgagatactgaaaattacaaacagctttgctttttttttctttgaaagggcttattcagattgagtatgtctgggtgactacttgcattgtaaactgatttttttggtgtgtgtttgataacataatctttcatttttggtagagtggtatgggtttacaaccattgtatacagcgtaattatgttttcccactcagaacaggctattctgtgctaattcttgtgattgattattttagtaatacacatggctcattgtgaataattaaattaaacgagttcttccctttttgtgtaatattggttcttacattagcatctgccagattgattgttcttatgaaaactcactgagtcacttctgactgtacattattgtcatggcagcttattctgagatgttaaggacagacagcttttggtaagtgtctatggcaagtgtatgctttgggggaaatacatttatcaaaaaatataatgcaaaactaataacaaatctatgctttactgtttgaaaagggggaaatggctgagttctaaaatgtataccttccatggttatttcaattgaattaccaagtgaaaacttgctagattttgtaaactatttaacttaagaaacaatttggaacctagattgccatacgttttattcaatattacccttatgtaagcatgatgaagatacttatctgtagaaatctgggatcttcgttttagctgctgggttaatgcattcttttcattatcccaagattgtgctaatgtgcagagatgtggctaaaaaaattggccagctgaatgtagaaagagaagcgaaagagcgtggaccattcccagtatggctaatgggtcccgaatcatggagaattgtctgaacccatcttgcacctcttgccatagaaattaaatgcactgagtgtatcagattctaatttcctatcccatctttcagatctccagtctgtacttggaattcccctgctgctttgattaagtgccacaggcacaatgccttggggcagaaaagcagaaagagccatctgcaaaaagctgtgagagaagctgcaaatggagcgtcttcagtgtcaggcctcctgattcttgagtttgacaggcagagagtaaactacaaaaacctgactgcattcttacatacatttatgaccttaaccttcttgctcccatgatgttgctatttcgcctttctaattgtggacacttttaccacattttgagaatgggggtgggggtggtggtagtggtggtggtggtagtgctagtgatctgaatagtttaaaataatgaatgttgaggtttgggtgtggcaatttcatattaaatttttcgctatggtatttttgagcataagaaaatgcttttgaaaagatttccttaaaaggcaaaaagaaagcctttctctgtgatctgtgccctgctcttagacacatgtatattcaaagtagcagtcactagaagaaaattcttttttttttattactgataaccatttgttgcccttctaaggccaaacactgtgttatgctttaatgttgcatcaagaatatatttttcttagaaacaacttccagatgtctttacataattttgtgctttttaaacaaatcacaaatattgagtataaaatgaggtttgaaaggactacattgtttgaactgcttctagttaacaaaattaattatatacacacatatgtcatatgtggaaagagattatgtagcatgtttttcagtatatttaaattttttaagatgaagaatgtaaaaatacagcctaataattggtgccatgatcagaaaatatttgtattactttttaagatttttaaaattttattttatgtgcatatatctatatgcactgtgtgtgttcctggtgccgcattggatcttctggaatttgagttacaggcagttgtgtggggattctgggagcagaaccaggtctgttgcaagagcaacaagtactcttaaccactaagccatctctccagacttattggttttattgattttacaaccttactttagctcacaaaattcacctgtatatgcacattcaaactgcagggacttcatttaaatgagattagcatattggagtccccatttcctcccaaccccctttttaacattttcacattgaaatacgaacttggtgtccttccttatggtaaaagggaaaataagaaaaagccatatagaaaattctacggaagctttaattacagggattgctgagagcgcaacttcctcttgttatacccagctaccctaggcctgctttatatgttctacaaagtcagtttgaaaggttccaactgtggccacttcattggcagtggcaggcaagagaatttctttttgtttgtttttcaggttgcttttaacctaagtcattctagtaagaatttgttgcttcctaaatagggggagttgctagctagatatcaagcactattctaaggttttgaaatagggatcaaggtcgtatatgaaaagtagtgaatttttcactgatggttagtcttatactactaaaaggatcattgctttaagccccaatttaaactatttgctttgttgtgttccacatcccataccccaggctccagttggttgacaggcagagtatatgcatgatcaattatgaaactcaaacacggtatcagtatcaggcaggttacattaagacttctaacagtgagctgtcataagaagagttaataattgctttgactctaagaaaaagtgcagattttaaaaaactgctgatttattttcaaaagctctcttaagagagccaatatggctttgggggaaaggttttcagctctttggaatggaaggaaaactgagaacataggttggccttcaagaagcctgaaagtactatggaaaaaagaaaatctggactcacaacatcctggagaactcgtttattacttcctctttcctgcatttccacctctaacgcaggactagaattagggagagtcattgcagataatactagatttaagctgctgccactattaaatatttcagtgggaaaggctgactagattaaatttaacagtgtgaaaaatccatcaggtacaattgcttctcgttcaaaagtacatcttaaaaggctacattttaaagtactcatctgttgtgggtggagatgttcccatgcctcaggtagcagctcactaaagtgagattctgtggtctcaaactgtgtgccctcctgtgcaatcgcctcttccactccatagattttattattgcctagagcagcacacttaccccattagcccatgtggccacagacactcattggcacagctgaactctacctacgcgcccccttcttttgcctagagtaaaaggcaacatcattacaaaatctccatttcactcagaataaaattatcacaaggctctgcctacttcccctttctttataatcttctgcttcggtctccacgttccacgttcctcagttagccacagcttggctagcttctttgttttcctttgaacatgttgagcgaggttcctcctcagggcttttgtgcatgccatcttctcaacctggactaatcttcgtccagaaacctatacacttggctcatttcttccctttatgtctcagtccaaatgcctttgaatagtatgtctgtctttttgataacagcaacatttgcctcttaatttaccttgcatctttttgatacttagtttttaagaatagaggctctgttgagactgtttcaagagcccaagccttagagctagcagtggccaccttcctgtgccagttacctcaaccctttgtgaaatcagagaagctaaagaatttctatgcactttggtgtctttggttgtaagagagatgataccaatgtgatatgtttcttgtgaaagctaagaggcatatttatgtaaaaatatcagcacattctggttatgtcatatttctgcttttgaagttaaatagtaaacatagtaaacaagtaaactttaaatatgcttgtaggaatttgaattttcctttatcccttacacatgtaaattaacaggcgttcatatagtatgaaaagacacaacccatcgttaaaaataaatcagtgacaatgtgctctgtcaccacacacacacacacacacacacacacacacacacacacacaatgtgacccttgaacaaagtgccactagtcgatattgtctgttgattgtacactaccaagtaagtatgtccttagttcatctcttcagtttaagccttaatgccactcctttattcaagtctctgattttgactcacagggtacacattcccatccaaaccatttcagaccaggctccagtgttgttttaacaaaattcatatcattgcttaaatgagctactcttttctgtttgcacagagggaggcccatcctcctaagctgcttcccctaccaagccccaacctcacaatccaacatgtgtgcttaggtaccattttctgtgtatattctttcatgcctttctggctttgaacatgtttttcctctgccagctttgcctcaccccatttccatccagtcaactcctactcattattcaagacttggcttgcttgttacttcctctatgaaatttctttgacactccccagcaaagctggttagtcttttgtgttcccacagcacttcgttcaggcctctgttgtaaatatttaacccactggattatcattattgactttatatgtttgtctctccagtatgaaattgcccttactgttagtttaccaagccacgtcaaagcaaataaacacaagccagtctcattgcttggtagcagctttacttgatcctgatagccatgtctgcattcttcctttccatttgcctctgttggcttttgtgacctttcgtatttgagcttataagagatgctgaagctgattgatagtgatgagttgctttaaggccagttgcagttttattgagttgtaggacagaactgggtacagaagactttacagagcagattcacacaagattaatcccttgtctaaatagtcataagagattgatgaagctccacaggaactgatgcttgctgtagagttggaagagacccttagaagtcttctaggcaacctgcctttaaatcttccaggaaatgagcgtttagcttctgtcttagttatttccattgacctggaacgcactactagctaaggagaccctttcattttcagatacctctaacctcactaccttgaccccagttactcttttactaggcgccagtgagtttgaatgccggaagccacagactgcctgtatttagcacattattctttatgaaagccacattaaccagcagtggtaaaaaattactctctgagtaattctttgtcttcagatgtttagtagtggtaagatgcagagttgtacagttgacttccatccacccagccataagatttttaactgactcttattttttaaagctttgaagctactgccatcactgtctatactgtggccctgggggccatagaatctagagatttcaagctagaactagaattagatctttcagttgtctcaatactttatgacatagaattggagctagagttagaacatagacactgtcttgggctatcactcaatttatgtgatagaaggtatacaagtatgcaaatttctatatttttgttttatattaatatatacatcattttaatgaatcctacaataaaagaatcattttataatgtaaagactaatttttaaactacatgcctgacatcatatttttatattaattccatcaaatatagactagtattagagcttttcaatctaaagaagaagactgggccaggaggatggctcagtgagtaaaagcatttgcttccaagccaggtgacctggatttgattcctgggacccaattggtataagaagagaactgactgccacaaattatcctctgacctctacacccatgtgtattcacacactcaataaatgtgatagtcatttaaacctgtagcagtggaagctgttttaggaatgtgaagcaaaacctttagtctattgtgttaggtctctctctctctctctttttttttaatgaaaaaatgtcttcagtgtgaaaacaaacctctactcatgactgaggagctcttgacaattgctggcttctgggggaggctagccagaggctgctaatgctgttcccctgctgggtcagcttcactctagcaggtggccccccactcacagatagatggggggaggattgggagcatggctaagattagtgttcattgaagttcttaaatagttaaaaatacataataaaagtaacaatgtctcaaacatagtagtagttatgttttctaataataattatcatatcaataatcataaactttattttctgtgtactggacctgtactgattgtgttatatgttgcctcatttaatctcttcagcacctacatcaacttgaagtcatttgatttatattctacatagttagggaaatccaaggcttaggaaaattcagttttactgaatgacaattacaatagcacctggatttgactctgatccaacctctaaaacttgtatttcaaagcacaatatcacactgttcttccctcatgagctttattccctcttctttatagagatacttgcttcattcaatcagctaatcttctagtgttatcttcaattgaaaaaaaaaaattgagtgagcatccttatccttcaggcattcagtttctccactctttgttttgcacaatttcccggtacatggaagtttgtttgttccagttctatttatctccccggccctccagttctcttctctgttaaaatcccaaggcactatcttccttaacaataactgactttcactgcctgagaagccagcaactgtcagtagctcctcagttagaagtggaggtttggtcccaccgttgaaaatatttttcaaaacaaaaggaaacctaatacaataaactacaggctttcttcacagcagtcttcttactccagttcagccttatgcactcccatattccaacacgagcctctcattcaggggacatagaggctgaaagctttgatttccctttctgtgtaatgtgggtacccagcctctaatacatttacatggaatactagttcaattctcaggttctaggaaggaacaactctctgaaacctatgactttgggggcttggggaaagattgaccataagggacaggagaatcatcctgactctgctcatccctacaactggtcagatggaaggcatcatttgagcagtaagaagttagtctactctttagaattacattgaagtaagtacccagatttctaggtcatttaggtcaagcattgctttcattttcttttcttcttcctttttttcctttgtaacttaagactcttaaaacttagcataaaagaagaaagttatataagcagaacataaatgtacctatgactgaattttcctcatagaagaaaaacagattttaggaaggaaatgtgtatgtgtggtaacaggctatacctcttctaccagttttagatttacaagaatcaggcttttaaaaaaaataataaaatcatccagaatttgtcatttttttactgtagtggagatttgaggaataatggaaaaaaggaaatacttttaaatttatagtaatatttttatagatattatctttatatttttgagttaaagaataatgaaaactttagaaatataggcattattgaatgtcttatgggttttctcctgatccaagtaagagcttttctttgtctgatccagataaaacatcatcaagaatcctggtatcaggataggtatttttaaatttgacagtgaaaacaactttctatttttattcacatattgcctgttaattataatgaaatgggtagcagtatttggaacattatccatgttacatgtctcttagaatttaagagaattttactaatgtaagatattgtcatatcacatatttagggcctacatatttgctcttagcaacactgcaaattaatgctggcatggatgagaaaccagcaagcggctagaggtgctagcccagaaattagtagcattttgttcctttaggatgtcagggagactaagcagtattcatgtcacttttttataaagagaaatggaaaactgaatttatttacaatgttagccagaaccagagtgaaagaaattcttaatttgtctgtaccttgcctgtagcaaagttacaatttatagaaaagatgaagcaaaaagcaagacttttcatctgtggatatagttttgagaacagcctatagaactgagagatgagtctttctctgtgagaaaatcctccctctggcaccaaggttctcttgagtgacctatactcatgaccattatgaaatttcctggaatagagataatctttggactctctttgctttgctcattattttagtcttgagggattaggggtgctgtggcatctactgctggattactgtgtaggtaccattggtggcttctgaaacatagaggtataaaagagccatgtacctgccacgtgaaggaacccccctgagcagaatccaagtagtagcctaggttagaagacagccaactaggtatcagcagcaggcagttgcatataaaacctttttctccattgcctgctatctggttacattaggaaggtctagcacaagtgattcacgtttgtgtagtcagcttttgagacagggtctcactgtgtagtgcaggcgggcctcggatacgtgacccttctgcttcaacgtcctgactcaaatgctggggttacagacagtgcaccagtacagtcagtgcgacttcattttgtgttttgatagctttccctcttgtctctgagtcatttcttttttcagaagccatcgctgattaatcatcctgtggcttgttctcagttgtcctttcttgccagaatgagatgtgttcctgttatctgattgggagtctactctaaattttaatttcgttttcatgtaggccctatcctacctagcatttcagggtattttgctagaagatgtatttctcaataagcagtcaaactatctttaagttactagaaggatgagtgtctgaatgaagatcagacttcttactgggctcttctgtaggagcaagtcctaggaggcacacctcaaccatcccctggtcttccagcagcaaatgcatacatttgacctatatctacacttggagcctcaagaagagttagttcaccagagtaatggcaatattaaacatggtggcatctgaacccttcataaaacggaacctgtaggttcaattctgtggattttgaggccgatgtggctgaatgagagcagatgtcagcatctggtgtcaagggtcataaaacccagctttgtaggagtttttgttcaaagcagtagatcagtgtatgtctgatgaatcccagttcactcagtcatgactcagaacaaagtcttccgaagtatgaatttagggttccggttaaaaagtctccagaacctaggaggaatctcgtcctgtctgacttagagcaccatcagtgcagttctgcccagtgaatctgttacctagtgtatggattcagcaggagtcttagttctctagtccagaataccttgcttatttcattgtccacagctccccacagcctctcgttgcttcaccggaagtgctagcccagtgcagacacataacctcctcccaccactgaactggtatgtgctccaagccacaactttaagtgtcatttgtagcctgaagtcatagttgctaaagaagtaggaggaaagggtgatgggtcttggtacagtggtaattttgccaaatagttgagtgtcagagttggtttttgctattctgttctcgtgtaaggcatatgctattttcagttcacaattcccagaaagaaacttaaactttttcaaagcacataaatgggtacatacttgtggctttatccttttaaaactgtagattttcttttctgtttcccaaaggagtcatttagaaatttcccccaagttcccagagttcctgttccttcctctgtgtgctcacatcacactgcatacggctgtgtggcagtgcttgtttctttgcttgtacacttgtgtgccctacttaggttgatgatcccctccccaacctcgttccgatatttcaccattgctttcccttggtaattgctagaagttaggtatagaccaaaataagagtttgactaagagacaggtctctcggtatacagaatatacagaagtatctgtttataagataattaaggtaatgaaagcactggcaactgtaatcctatatgtgagatgcaaggaaacttctgaaaattgtgttaagtcataagaagatgaatcactttgtaatagtggactgttttcatttgtagcaatttactttggaattgaggacctatattttttgttttctgcttacaattttaaatcacagaccttctgcctcattgtgttataacagtatcagtcatcctttaataaaggatggggttactcagttcctacatttagatattctaggtatagtgatgaagttgtgatagtctaaagatgtggcaattaaaatacaaatgtggaatttgttcccaaactggaaggggggcgaccctatatacagtctaaatatgaggtgaatgagaaagagcaggagccggaagaaaagtggtaagtacattatgtgtgtgttcatgtgtacattattgcacaaagttatagctcacaaacatttgtaagacaaggtacagtgaagcctttgtaattgtttttgcagaaaacattttattcatagaagcactactacttgtgtaaatttgaatcctcatgaaagagagatggccatttctgtgaagtgttgcttatagttccttgttttgcaaaggctgagtgggtaggcaagggtggcttcacagaatggtctttctgtggtagcggaacaatttggaagcaccaaagtaataggtaagcaaccggaggtcatgggtccatattgtaccatttattagtagctaactaattatgcttaattttgctaatggataaaggcacttaggttctgttggtacagaaataaaacttgaattcaacaaattgaacgaatcgacagaagatattacttaatgactttttcccagggaagaagagttgagctagcgacttagtcattttcatcattaaatgtagccagtacaaagtgctttggaaatccagcctctaagagctgctgtttacagtcattaattgtggtactatccattcccaaaaggatgccacccctttctgaacttgactttcttctcccattccctgtggaataaatatcgcacagtaaatgtctctgtgaggaataaacagtttggaggttaaatggaggactcagtgtaataaagctgacatgctctaaggagaatgtccttttgatatgcatttggtagggatgtattaatttcaacaaaacatctgatacaaaaagttatgaatgtaggccattgaatgtgtgggtgggggtgaggggcaattctagaaagagaagggatttactgtgtttaacagttgccaacagtcaggtacttggaagttgtgacttttgccagacttggaaatcaagttggatcagctctactgagtccttcagtgggagaagatccaaaccaagctacaagatgaaccagtgtatgaattagaaatatgcttaaaacatgtctccccgttagttttcattagtgtgcttactgttgccctttctgtattctgggctcttaaaaaaaggagctctttgtgacttattggttgcccatgtacagctggatttactgtaaaggtctttagtttgcagcgggtgtcatgttactagagtgcagtgtgtttgctctcttgcttcattcctttctacttatttccttactgtggtcattccaactcagaatagttaccatagttccaaagcttgattgaaagattcattcagttttctccaaatatgtaacaattataacaacacagctgtagttaaagttagaatttttcataaatcctcatggttttgcttcttaatcacatcaggctgaattaaggttttatttatttcagtgcggttattgaatacttaattctggaaaaagtcacagtactaagtactatacagcactactgatgaccatcagggtacatccaccttcaaggcgcttacaattttgtaagaaatacttgtctgtacacaaaagatctatgattaagaatgtaaaaaacagccaggtttggtggagatacaatgtcactggagtgggaagaattagttgaggctcaatagattggcactttgaaggaatggacttaaagctgactctctatggacattttaaaattcaatttcaacattcatgggtggagatatagaaagggtagatatgcgttctctatctaaaacacaccttgcactaaatttaagaaggtatgtgttatttagggaagaagtgttaagtatagtacagcttggcctctagagaccaggagatacagtgatagattgtaaaggcatcgagctgccattggaagatgtcaacagaagagcagggttatctgggatgactctggttatctacatttaagatttggaagggacagatattagtaacaaagatgggcacagtgacaagaatctaataccttctaatgacaaagcaattttgaatttgtcttaagctgtcttttcctctcaactttaagcatggatgatttgttttttatttgtgtgtatatgtgtgttcatgcatatgtgcaggtgcccataagaccaagctgttggaccctctggagttgccattatagacagttgtgagcctcctggtgtcagtgctgggactgaactcagctcatctacatgagtagaaagaactctaaattgctgagccatctctctgagtcctcaacatttattattttttttcctgtgtgggggatttattttttaaaaaaataaatattagtctcttaatatcaattatccagtatcaaataaaaaaatacaaccctgaaaaatgcatatgagcatcattatacagactgagcaggttgggtacatgtatctagtaatacatacatgcatgtttgtagcaataattaatgaaaggagaagctgggaatttggaagagagcaaggaggagtatatgagcaggtttggagagaaagggaaagggaaatgatgtattataatctaaaagtggaattagtttctcagttatagacaaaattatttttgtaaatgcggtggggctgatgagatgacccattgggtaaaatcatttgccatgcaaacctgacaagtcaaggctgatgtccagaaccaatgtcaaggtggaaggagagaaagggttccacaaagttgaacctaacaaagttcctcctatgttagaacatttgttaaaatacagcagaatcctgaaaaaaattatttctaaccaaaaatacatttgtggatgacaagtatgcaaggaaataaatgtttgtaaacactgcatggttgttaggtaatttaatatctgtacttattacttagttttgaggcggtattaaaatagatcctaggttttcttaaaggtaaagagtacatcctttgagtagtacaatgggaactaaagtctgagtgttacaaaaggctgtgttttctactccactcatgtagcaatacttttgagtaatctgttctctcttagggagttttccagatttttttttgtaaatatggttccaatttataagatgcagctttattttgtagctgagtgatgtcctaactaggaaacttttagatggagtaaaattctatccaaagaactgggcatgcatggtggccttgactttgattttctgatcttcttggggaggaagctgaggagagtttcctgttcattgcagtaatacacagtaacaaagaaaacatttccagcagttagctagggtcactaagttttgaataatgttcatataatacaaatgaatagctggttctacaaaaaaaaatttagatggctcattgggtgcaaatattgacacacattctcaagggaaattcctgaaataaagcagaacgagaggatggctgtactatacacaatgttgaagcagaaggattttcaagtaacagattgcatcatttaatgcagatgtgttgtagtagattagcactgaatagtaaaacaacttcagacaagtgcccaaattattttatagctatttttgtttttaatatttatgtgtagtctctatttagttttgctgattttgatagggctccatagaaaagcaatcctcatgtggaacaactcagtagctggtgtgtgccccgtgcttgttggctatcttagaaatattgtcctgagaaaactctcatttctaaggtcccaagcatatgatgtcctgtggtagatgatttttggactgacaatacagaattgacctgaacgattaactcaaaacataaacattcatccttccgtttaaaacagagactctttatggctctccttcccaaaaccattttgacttttcccctgtataaaatgtactggttagcatttcacttttgttggaacattgacctgtgattattttatccagtattcctatgtaggcctgtgaaaggatacctatcaattttagtgtcccaagttttcttaagcaaacacatttggtggttctggtgttttcaaggtttccatagaaacaggatagcttgttgcctttttgttttcttcctaatcgttgtggtttacaattctatttatgaaaaggaggcatcttatcctggccaaccaaagcaaaactaggagaaaatccatggtgtgctactttaatatgtcttgtgctttagggaaacctgtataaatccaggagctagcaatagagttagagtggccagatgtagatttttgacaggataacagagcttcctaggcagtgagccatgcttgcaggggaaatggttgtagggagctggcaagacttccctgtgctcgtgaagtgagagccaatgtagatgcatgcggagtaacaacttccaggaatgcttcctcgggacagtaatgatgctttgttgggtttttacctggtatttatttcacaatgtctagatgcgtagtacttaacgtacagtgttccaaaagattttattagttgttgtagctttatatttttgttgggttaggtgtgtaaatctctaacttcaagaacataagcatttcttaacctcctttctccctcttttatggatagagctatctcgcatagtaaacttaattgggtcagatggtgagcaagcaattgagcttggtgcagatgttttcgttttattttctgttttagttattagtggccattgtcacagtaagcaagtggctagtaataccaccatgtgaataaaagcttccaaattcaaaacagttgcaggaagaccagaatcagcaataaaaatgaatgaaatatttattttaaaattaattgtacttggtttagtgacacagatgtatcaaaataggttgtgttatagtgacagttcactggaaacctgcattttacctgacacagtagctttgtaactaggatgttatactgcctgtagatgagtaaagtcaggaaaataatttgttctttttgagcaagctctttatttcccttacaatcttaattacaaacttgatttgcttagcagatccttattttccagactcgctaaaggaaaccttcagccaaggtctgtttgaattaggccaaattttttgaaatagtagagtttaaattaatgagcctttattctgtttggagagtttgttttccatcattgataattatttccaggaaagttaagtccacagaaaatattcactcagtttccttaatgttgtttaccaaagtcttaagaagtagcttttcctttcacagggctacagagaggacaaggcagtggctgaggaaaatgaggtactataacctggtctcatccctctggagcaggctctgagaagccttctaagctaatactattccatgtaaaaagcaaagcagaccttggaatttgaaagtctaatgtgattgatagagtgcatgctagtacttcaacccccatgagccatgagactaggaccttccaagttgacagacattggacagccctgcccagtgtgcactgctcccacatgtctttcagagaatctaccttttcctataagtaagcctcctggtttccctttgtgtctgtctgtctgtttgtctgtttatttattttaaattcttctctcatatattacagcccatccacaatttcccctccctataagggtctttctctcctatctctcctttcccccagatccacctccccacacacactccacctcgcctcacaaaagaggagagcagaggcttgattttcatcaaggcccctttctccctttcgacattggacacttactaacctaaaatctaacagagaacagaaagtggccagaggtttttttttttcgtattctctctctctctctctctctctctctctctctctctgtgtgtgtgtgtgtgtgtgtgagagagagagagagagagagagagagaattggtagctgattccccaggtatatgttcacttaaggagactattatgctgcctttttcatctatgcctacctttgatgtcttgtgattcatccagtttataatatgtctttttataagatgatgtgaaaagcataaaataggttagtaatatgggcccctatatgtttcatgctacaacaaaatggtaataataacagcataaacattaagatgctgttaaactcgtcaggatgcgagcattcatgttttcctcagggggaaaaggcttgtgagatcaaagctactctatgattctatcatggaatattattacctatttatagcactatgtgagtttcagataaaaatattgccaacacttgcacagtaatctaaataaaaactagaaagaccagttaccacttactaaatgaatatcatttaatggctataaagaaaggaagatatattttaatggcatagtttttaagctgagcaataaaagatatgcataaaatataaggataaaagaatttaagggagcatttaccatttaataaagtatatgtagcagaattattttaatgcctattatattaccaataaatgtgtattgaatgagactttctatattttttacttcattcactatagccctacttaccagctactctgtattatatagtagatgtacagaactgtaaaaaaataatagctattcacctttagtgtaattaaattataatatatacatggatacaaatagtcagaattccttttaaatttgggttcctatagagttttgcctagcctaatagatatctccatagacagattagtatccataaaagttatgatgtcataagaccttgagtttaagtatcattctgtttcttttttattattttattctttcagaagcaacttagtttataagatttgtacttggtattaggtgttatgggtagcacatatgaagtctagtcatgttactgaagtgtagtaaaacttccatgaagcaaagtgttccacaaagcagagtagaacattgaatgaccctagatacattcttgttctttccctgtagcaggcactcataagtatctgctaaaatacatcatgttcattgatactccctgatgcccagagtcattacagctgctaccttgtcatggcaagttctgctcccatgggtgatagtactactatcatatgactatgatttaacttgcatggcttttatctatcgcatttcccatcctcaaatgatgctgtcagccttttcagtatcacttgtgggtttttactattgtacatcataggctggaattagcaactgctatttcagctgcatattatgaagcttctccagtgtgttttatcaccccatgttcttttctcatggaggcccttttcattgagctattccatttttgatggtaaaagaatggaaaactatactggtgaaaatgttgtttgactttgaaaattaggtttctttaaataagaaacagagttaaattatgtccttttctatttatcaaggtcagtttaaacatattgaagggagtaaagtaagatctggtctagtttaggagactaggggtggattaaagtccgagagagccttagtacatcaagcaccacacatatctccatgtactaaatctgcatgtggcattgtgctgtttacctgaaaatgagcactgaggttatcttgccctgaccagcttatagtctgacatatttgtacatacacaatcagaacatacagtggctttttaccatggggacaagactctccagttgttagactttaataaaagggaattaaatgtcttattttaaaaatatgtaacttttgccgttgaatgatcctttatgtaaccaagtaactaaggagaaaggatgcatgtgaatagatggaaatcagaataaggaaagcaggaaagggagagaacctcactgtagaagacagtataagtactgtatatgagcaggggagactgtgtatggactatttaagattaaataaataaatgagcaagaaggagatggtaagaaatgcaggagggctgctctcatgcccttatctattcagtttcttagttgcccttggccttaataggctgacaattgccaggcacccaacattgttaaattatgctgagcagtagctcactgttttgcttcttaaacatctgctttcaagtgttattggatcaggatggagctgatcaagtagtaggtggcagaatgatggaatgttcagtggaaacaggaagaagtcagaagatgtggtagcatctccgtcctgctgcctggtagctgagtaactctggatacatggagtccgctgtcctatgaagagtacatgttctctaaggattttcagcagtgccacttggttgaacccatgactacaggggacttgctcttggaggacttctattatagtttctaagactaagggactatttgctttgtctacttcatgaggttttttgaggttcagctatgatgaaaagaggtaaatgtactttggaaacagtgaaataccatgggaaatggaaatattctccccaaagttaccatgtagcggtcatcatgaaaatagttcagtgtaaatgaatggatgacaaattacaatggtcttaggaagtcaccagtacttatatatatatagtagagaaataggtatgtaaaaagtacagacgaactgtgtagtagacacaacctaacactggatggttaagcagggaggctgtagagatgaggtatgctactttctttcccaaccccctctctgttcattcctggtttctctaaaatccttagggagaagtagacagtgggtcactcacttttctctgtcaccatcacctatctccagaaagaatgaactggaacatggaaacctgttcagcagggaaaaggtcatcttgacccagtgggaaaatgtaggaccacaaacccgcctcacaggtgcctctttcacctgtattcactggcatgtgtaatgttgtaggtggccactgtgtacctttgtctgatagtcacctcgtctcccatcgctaatattttctttcatgtcttccctctagcatattactgtcctttcttccttatcttactaaggtaaacagcaagagaggaaaccatctacaaaggcacaaaggaagaggactgaagggaaactatgaagtaggaagggttcacttccttctattgctttctttcttagttatagagaacagaagctcactttgtatctgatatttctggttagctttacttcttcccttagttacctttagtcctctgccagtgataagtagaaaaattatcaacaaatcacacaatatgaaccatcatatcctctgtcacctgtcctagcctcaaggactgatggtaatgttagaaaggacagtaaatcagtaggtaagactggatggctctaacagggcacacaagttagagtaataacacatgtcttacagtttataaaattcaaattatagatttgattgtcatggaaaaggggaaagaaaaataatatgacatttgtggcagacatgagacaacttattcaggtccaaaaagcagataaaaaatcagaaacaggcccatcagcctagatatgtccaaatcctagtactttggtaactttattatgacttccagcagattaaatttcaagctgtggaaaggcttcaggataagggaatgcttagaatcccactaataagacttattaagtttagacaaaacagatgtctttcaatggcaacagctctgaatcaccaagatgaaaatgggagaagagaaggagggaaaggagcgagtgctttcgctgcagcagtctgcagcctgctcatccttgtacgtcaagctacaagttaaactccccaaaaggaagcaccattaagagggaattcttgaaactgactgaatgtatgtgtatttgtggttattggctacattctgggatatgacaaaggcaatagacaccaggttttgaagtgggcattgtcaacttcaagttttctcacctattttgtgaccatagacaagttgcttaaatctcaacttcattttcttcacatacatcatagcatttatgtactttgaggactgaacttctagaagagtccatgcataacacctggatcacagtaagtgctcactaaattttgattctttagtggctaaagctgcttttgctcgaagtattgtgtctaagtaggttaagaccagtcttctagaacttggtaggaagagttggttagcagctccaaagtggggtgtgtccaagtgggaagaaatattagaaattctttccaggattattttatctagactatgtgaagatatttaagccctactaatatatggcatttgggttgccttttgtaccgttctgttttacacattggcgagtttccctaacattaaatgaggagttctaagggcagctctgattcactatttggtgtgctgtggtcatggagcctgctgtttcattcacacttagcacactccagtgtatttcagtttacacatggctggttaagtcgattctttcggcttgcagtttctttgtagcaatcttcttaagctgttcaaccagttcacccaaagctagataaagcaacctaagcaaaattgacatagcttaaggtttcagtaacagaatgagggcgaggactggcgtgtcaccgcttttcttgccaacagaaggcttcaacccaaggagtttggaaaggaaggaaggaagctactgcctttgggggtctctgagtcctcctccacccgtccatgcttctctctctgcctcttttggtctctgcctttgcccctcatgccctcacccctccactgggccactctgccaccccgtctcccctagctctttagggagttgtctttttccttctgatcattttgttagaatgtaaccagtaggatagaaaataatacacagtgattataatttcatgagcagtttctttatattagtgtatgttaattgtacaaaattggtttcattgtacaaactaaattgcttgataacatctcttggacagaagtaaaatttgccctagagagttaggaaaaaaactagttcaggaaatccaagaaaatattacataacatatgactgcactcttctgtgttgatgtaattattgaagaagcccacagcttacttggcgaaacaggttcctttctgtaaagttacctacaatcctaggtcatttggcacctaacaaactagtagttagatcttccccaaaagggaattaacctatctgatcattcctcttggcgttttataatttattattttaacaggcagtttacacttgttcatgtgttatttagtaatcgacttactgcaagctgaacatcctttatctgaactgcttaggatcagaatgtgcttcggatgtcagatgatgttccagtgctgggggatttgccatacctaatctgattctgcaatctgaaatgctctaaggtctaaaacattttgagtcttctgttgatactcgaaaagttttggattttggagcattttggcttttaggttttcccagtaggatgctcagccattcctattattagtctctgttttccctctcataaataacagaccttaagtgcttcatagatcctttgaaaatgaaagaaaatgaaacaaaggtttttcaaagatgcttgttaaaatcttcctgtggtgggacagaaagccaagcttagtcctgtagctcccttccttttatcaaaccagtccctgggtgtaaacttagtaaatatacccactatcagagttcttcaacaggcactacttaagtatctagtgtatgcaagtcacttctgcagttgtgattcattattttattatttattctgcagttattatttatttacttttattaccgtagtagcactgtgagaccagggactgttctggtgaaaggaagggagctagagcttgactttgtagtcgcactatgggaagattttaacaagcatctttgaggggcctctgtttcattttcaaaatacttagcaagcacttaggacctgtcatttgtgagagggagtgcagaggtactattattttcttcattttacaaatgaaacttccacagattaagatatcacaaggctagtatgcggtgaagccaatatccacatgcaaggatttctcattccacaatacatttgattctatacaactataaaatgtttcttatgtgttaactacaacttcaggtttgcatttgaggtgctctgtctagtggctccaccattaagacatgctttcagtgattgcaaagagatattcagcctggaatataaactaagttttaaaattctaagtattttaagaagtaattcattgagagacaagtgtaaaggtgcttgcctgtaatcccagcatttggacggctcaagcaggaatattgtgaattggtagtcagcctgagctgcagagtaataccttgtctcaagaaatttaacaaattgggtggggtgatgcatgccttcaatcccagcacacctttaatcctaggcagaggcacatggacctttaaaattcaaagccagcattatctacataggcctagctaaatagccctatctacatagttccaggctagctggggctacatagtgagaccccgtttcaaaaccaaaaccaaacaagaaccaaaacaacaacagcaacggagagcttacaactaaagtgaaaccatagtgccctcatttagatgagggagagctccatggaagattctagtctgcgtcagctcattattagattgcagccacttgaaatcagaaataatctcgttttcagttttgccaaaatggaaattgttcgtggccatatcatagtctgttttccaaacccacacagtctttccttcccaatgtgatgagagtactgttcttactgtgtgtagtaatggatgactcaaactcatactgagtcttaaagatgaacctgactcatgcagtgaaaaataaattatcatttgctctggtaggatgtagtttaaagactttcatcagaaaaaaaaagaagcaaaatttaaaacacgatttcatgttgtttgtttccaaaagcagagtagagtaatccagcagcaactctacagagaatgtgttatgtggacgttgcacaggaagaaatgaggtatatttgccatgtgcacatttagccatctgcttctttaggtagcatacatttggcactcttcatcttgctcgactaaatcaaatttgcagccagttcctctagtttgcagcatacagagacagattctgatgatactcttgccccaggaggagatttctgatggacggctatgactgtctcaaagaacataggcttttacaacagtatttcctcttttattttttgagattataatttaaatatatgtaggtgttttaagaatccaagaaccccaataaaagaccaattgggtgatagcactcttgaaggctaaatgaatttcacaggagccaaacaatacctagcaactggtacagaagttcctaggaggttccttgtttgtacctttgcatgtaggtctctactggagacttttctcggtgtcctccgtgtgtactctcccacccatttcctcatttcttttcttttccctcctttcagccctctttggatcccagacctgtgttcttttctccattcctcatgaattgcccattatcatataacactaaaatgggcatcagagttcaccaatagaaacgtctgttaaacagccagtaagttatctgtaaaactgttaaggaaagaaagaactgtggccaggcaacagtagacatatggcatagagttggaaatgtcctttccctgcataggcagtcaaggtcactttcatctcgcttgttggcagtgtgcttaggtttgagcattacttccatgtttgcattttggtttgtgtcccattgtttcttggttttgaaaaactaaaacacactactcagtgaggaagagaagctctgtgtaaattttcagatgggggtttaggattctagttctctacgtttctgaggtgcaaaggtgttgcatatgcattctgttctcagggtcctagtgctgcctgggaatggcaaaacaaggaatttcctaatggtctaaacctctcagaaagaaatggaaaaagctagttcatacacacttcacttgcttctcttttacccaatagcagtgcttagttgcgggtttaataacttgtgctgcaatatgactgtcagtaataggaagcccctgtcactttggtaacttccgactgcttaagttattagccaactgactctgtttcaggaagcgaatggctgccttgccaggtgcgtcccagtcattcctgttgtaagtaagaatgttatttaggatgagccttgcaatatctaatgttgtgcccttttcagcagtgctttatttcgtttttagcaaacaccctcacaaacctcttgattccttgatagctaaagtcccattttcttaactttttcgttgaagtgctgcttaacattagcttctaactgacagacattaacactgcttctcacttaggtgaaatgtgaccgtggcaaggtgccaggtccaactgaatacattcaaatttggtgtttgaactaaattgtgttttaaattcatcaccatcatatggttaatggggcaaccagctgattttgttcataaacatttggttattttccctaggactatttaaacattagagaatggcttcctatcatttcaaagagaatttcattatcagtttactaggaaatcctcctgttgaattcttaagcgccctccaatttaagttggcagatacttgttgggtataaaatgtttttagtgagccaggcgtggtggcgcacgcctttaatcccagcacttgggaggcagaggcaggcagatttctgagttcaaggccagcctggtctacagagtgagttccaggacagccagggctacacagagaaaccctgtctggaaaaacaaaaacaaaaaaatgttttcagtggacactattcatcatttatttttgtggaattccagtggccaagaagtctaggaatatttgccatttggctactaatgaatgcaactgaattgattgtttatatttttttaggcagagacagtacaggtttcagatcagaattgccaagtaagacaattgttttgtgttccagttaaaatgtataatctattcaaaggtgaagactaacgtgtggttagtaaagggaatttttggacttgagcctaaaaatctgggttagagacttacctccgtctttggcttagctggatcatctcagctaagtcattgcccaactttagaatgcagcatcttctccaaagccctagctttaacagtgtgtacagagtattctgaaaggagcctggctgagggaagctgaattctctcgtgtgtaagctatccacaccagcttggcagcttggcagctcggaatttgcattgagagccattgatgtttctttgctcacaagtttaatgaaaagttacttggagttgggaaacaacgtgactactaacatttccgtttgaatttttgatacaatcagatggtccccccccccccccgtgcctaacatccctttacttctcatgtcggagctttgcagcactgtgcttgagccctaggacagtgacgtaccatgtcatcttctatccgttctcacctcactcttgttctagagcttttctcttcagctctagagtgactgagcagcaagcgcccacagcatgagaacaacttgttccagtttaggtacttgaaaatactaatccatttgaaataggttgaattttactggccttgaattactcttttgttggtcagtttaggaaataacacacactacaaagtattgagaaaatagctatgtaatgacttcatcccatgtattcttttagtgaaaaaaaaaaaaagatctggatgcaaaaagtttatgttcttaaaacagacccagagttattatacaaaatggtgattcccatggtgggaaccatctgattatattaaaaattcaaacggaaatgttagcagtcacattttttttcacccatctccaagtaacttttcattaaacttgtgagcaaagaaacatcaatggctctcaatgcaaattcctggagaaatacagtggcagtgaaagcctagcagggctctaagggatcccaaagagatcaacaaacaagcaaagcaggcccagagttcttagagaaaacaacaaacaaagcagtagatgagcacagtcttggtgaggatgttaaaatcagggacctccatatgtcggagatgggaatacacagttatgcaggtctttgtgggaactcttagtccctcacaaagttaaagacagcattaccttttttattttaaaggtttgcttatttgatttaggtgttttccttgtcctctaggctactgagccatctttccagctcaacagaattaccttaattaccttaatgactagtctttactagtatttaccttaaatgctagtaggtatgtacccaagagaagtgaaaaactcatgtcttgattaaagctgatgtagatattcaagcagcatatttcatttctctgtatttttctctgttgtaagtctaattctacatacatatgtggccaggaactggaggggcgagggggctgggaagttgtggttaatggggatagtttttcagttgaggaatctgtgcatttctggagctaggtgatagtgaatgctacatgaaaccgtgaagatacttaattctacagagacatagatatgtacaaatggtgaaaacattaagtttcgtgcatactttaccacaataaaactccctccctaattcccaaaaatacattttatgatgctaagtatagagggtttgttcctttccttatgtcctttttaatgagaaaactgaaaaatgtgattggccttttaattagctggggatacttctgcacaatgtgttagcattttattccagcatttgtgtgtaaaaggtggttaaaaatatgtcttcaacttgcctttggatgagaacttgagaacatttttaagatctttattgtcagtaggaaaataaagggagccaaaccatagggcatttatgttgttaaactgtaaaacagtgaaatgctgctttcagagtaagactttgcaatttcctggttttcttggttgattttggcttcttgagtgacatggccatttctactgtataaatatgtaacatctctgcatcttcctcagagaatcttcttttgtatagttagatgggaggagcaccagagtgcactgaaaatacaaatgcagtgagtttcagaatgccaagaagggttagaaagtgggggaaaggtgcaaagcgagagcccatttaaaatacaaaatgtacaaggagtctgcattttggctgagtcagttaaaagggaatgaagttctttctgaaggctgtgggacttccttatgtttctgagtttgtaatctatgagaaagaaacaatgaaaaggttttctaagatactgggtcaatagtttgatccatatgttagataatcagaggtgtgttttgcttgaccaggaagtggtttcgtataaaagcacagggcatatggtgtgtgtgacaggcagggagacagtaagagggggtggggacggtactgttgatttagctcttctactcttggaagaaaaccattttcatcctttacaagggtctttctggagtttggcacagtggcacttgattaaagggtctaatcagagttgatgtactcagaactccactgatggggttaatggcctcactagctcctcctaatcagacctccgtcgcacacacgggcccttttccttgtccttccagagcttttgagtcctgtcttccgttgccctttgtagggcacatgagatccttgtattttgaagagactctgatttgaatgattattttcttttactttgattttttttctgtgatgaaaaaaatcatctttttgagttatttaatgctctgtggtagccgttgcaagttgtattaatgtttctctgttttacaatgtgatttcctctatggaagaaaatcatgtgtgaccagtcattgactcggaggtcttccagcatgttcccactactctagtttttattttcctctaatggaaaagacagcatgttctgcatttacagatgatccagagaaacagagaaagtgctcttgaggaggttgacttgaaccttcactctttccagctgaagtggccacgggattggccagtaaacagactctggtaaatgaagaatactgacttctaaaatggcccttgatgaccacttgtgcacctttgatacagttctgctgcttcttagttatttacctgattcaaatgattgccagtatttgaactgaacgtaggaactgtcatatccagtgatggctttaatctccgctctcttcaacagtgcccttaaagacagccgttttccaccaatgacaagggatgagctgccaaggcttttctgctcggtgtctctgctcactaactttgaagatgtttgcgactatttggactgggaggtaagattatagacacgttacatgaaggtgactcctgagtagatgttaacaacttggaccataaagtgaagctttccatccattcttacccagaaataaagctccccgcggaacaatgagatatgattggcttttttcttttttaaggcaactataccctgtgctgttagaatctcgaaactgaatttggtcttcacttttatgctagctcacctaagcacccaataaaggctgttaataagtagtgagaaggagtgcctgcaatctgtttctccctgcatttccattccattctagtgcactgtactgtatgtaactgctactgagcatttagacagtctgagtatacatgttagaaaggagcagcaaaagttagcataattattatcatttgggggaaagaagtttgtgacaatggcagtaaactagaatgaaataatgtgagtttattcctggctacattaatatagacatttgaaattacagcaacaatactgttctatctagggtatgtctgtgcattgctattatcagagaaacctaccttaatcatatctttatttgactttactgtgtgggaactttactaagctctcatggcgatttactttggaggttaaaattgctgagtggaggtcttgcctgtattcctgaataccagctgtgttctcggctttgttgtacatgtacagaggggcgagataggctctttaccttgattcagagagaaatttatatataaggtatgaagaaacgtgtgggggaagattgaaaacaagggaaagatgctgataaatagcatcctctcacataccacttagaaaccgaactactgtacccttccaagagcctttcagtctactgctgttttcgaagaatcattcctattgttactgagacagccttgtaaccagatcattgtcttcatagttaattggacttgaattttatttttgtttttttttatgacttcttggactacagatagttgacttcaccatagtttacttcttctgggtacagaataatattctggagatctgtctcagaagatctctgatctgaattatttttgtgacaccagagctattttatagctttttgtatccgaagatgatgaaagcagcccctctgggttttctcattggctttttgtgtccttatcagaaaatgaaaccatcctaggatctttataaaggaagaaataaaataatttaataacagttatactagaaagtttgaaaagtgtcaacccctttatagaacggaaattccctactttctttttgttaagtctgacattccaatttgatccccctttcctccttcttttccccttatctttcaacctttttgtttgtttgcttgagataggctgtcaccatgttgtccaggctgcccttgaactcaagatcctcttaccctctgccttcctagcagcaggaccacaggtgtgcttcacaccatgagtgctgttgttgttttgttttgatttaatggttccaattgacgtccctatttatgaacatttactatgctctgtatggctatacttttactggtttggaactgttgctttttttttctctagccagagtttaatttttgctctgtagagtagaaaatgcagtgtatatagtggtggtgtggggggcgagaagcagggaaggcctcagatggaggggatgaccaagctacagaagcacttctaccctcattgcagccactgagttgaaaatacagtgcagcatgggtgaacacattcagatgtcttattcacacgtgcttgttcagtagtgtgtgtatgtttcatgggaaagaaaaaaattgcgactccaacaactgataagtaggtaggtaagaataagcacagaattagcaacagcacctgacatcacatcacaggttctcatcagcaaaagctcacctcgctatgtggctttgatgttcgtaaaatgtatctgttttctactgggtggatgggaagtacagcaattgaaatattagcactatgtattttgtcaagtattatttatcttttgtggtcactatctgtcagcttgaatttctacaagagtcaatattctttcgacttcgtgtttgggaacatacattttttaacatttttttaaaaaaatgtatttatatgagcacactgtagctgtctcaaacacaccagaagagggcatcagatctcattacagggggttgctgggaattgaactcagaacctctggaaaggcaggcactactcttaaccactgggccatctccagccctcaatatttgtcttattatgtaaccttctcttgttaatttaaaacaatacacatggcttggtatcagcatttgaaagtgaattacacactgctagaatggtggtactaggaggaacagactgtctctttctgtgatttcatcagtgtttcaaagaagacactggaaactcacaagaagtatattctcaaagagtaacaattgcatttgtaattataagaatgtgagttagttttaggtgtactgttgtagttgaaaatggaatactgttcttctaggaaggatagtctaaaggttgcctttggtaattaatgaaaaccattgctatttaaacagagtgtcaaaatggaagtaaacattttttttatttataaactgatacagttccacccttagatatctgcccaaattaattcaaggctgatatggaaacaaaatcctgaacaagaatgctcatagcagtacttttcacagtaatcacaaactgaaaacccaagcgtttattaatacctatgtcgatatcagccataacccatgctttagcatggataaacctaggaaacatcatgttaaatgaaagaagccagacatgaaatctcacatactgtatgatgctacttatatgaactatccagaatagacaaatctctacaaagattgagggatgggaaaagcatgaaagggaagtgactgcttagtgggtacagcatttccatttgcagtggtcaagtgatccaattagtgggtgttaaattttacaaatgcacacacacatacacatacattcgctctctctctctcaccctctctctctttctctctctctctttctctctctctctttttctctctctctctttctctctctcactctctctctctctcacacacacacacagagacacatagagttctttcttagtaattttgacttatttaagagaacttaactttaaagtataagaaggaaacataagtccctcataatcttcacccttttgcttctgagaacagtcaggtccttggtaccatctatggcctgtacaggcacatatttaagcagatgcagactgaaaaaggttggaaaacattatttctatagcaaaaatatacacttctgttattgcatttagatgctctaaactgtttctttacatcctttgtctatcaatacatttgcacgcttagttacatgtggttattaggtaaaagatggctttgtatattatttaattatatatttttgatctttcattgtgaaaaatctattatgaaagttataaccttctctttgaaaaatttcccactgtcaaatattagacctctttcccctgaatacaataccctattttctgtatttagttttaacataaaacacagagtccttatggcatatgcttatgccataaggaaaaacaaaattattttcaaatttttaaagaaaaaataagatagtacacttgttataagcagaagttgggataactgatgacatgtgttacttcagcagaatccctaattagagggatcctttaaaggtatgaaaagtgagtgatttagggaaaatcgtcattaactgatatgttgtcatatccacctgcaaagctaaaatgattgttcagtgaggaaaattccaacacaatctccttctcaccaccaccgttctgtgttcttccactgacagcgttatgctaattctaaatgacaggatgattgacagacatggcactttacaaagaaagcaaacctcatgtagcatgttggaaccttccaaaatgacacatagcctgcaagttccactgtttgggagttgtgtttctccttgaaccactatgaaaggatgtaagacaaatggcaatcagcagagcttggtggcttgctctaggtccagtcacctcagctgctcattttcaggctattatcaaggaatcagatttgtgtttgtagcactgctgtggcatgcgtgctaccaatgattttgttgggatctaatgtaccacagagctgacaggagtcaacatagtttctaacttataaccaagcatcttttacttctgagctttagagggaagatcatttcaaggcatgaagaacagatgttttctaatgtatcctaaagtaaaagcttagatcatatttagataagttaatgacagttgcatgaactagaagactttttcttctttatctgactttgaagacagctttttgtgtgtgttgtgttggggggggggtcacttttagtataccacacttacatagatagaatcatcccatgcttaatggagctggccagcaggatacttgcatggttctaaactctgtccctggactattaaagctagaccttgtgtctctagtctctcgctgtccccacctaatgtaacaaagcatctgtcattgtatgtgagccttgaggactcctgctactcagcgagctgtacttcattttcaaaagaacctctaatgcacacctctccagcgatcacagttccatttctgatgtatctggctgcagttaataatagggcgctttgtaatagccttcgtgagaataaacagatgagatgaacaaattggctactgtcattatccccccccccatattttaaatgctaatattttccttttcactctccttccccccataaaggtttccattttttttagatcctcttaatgtacaactgaaaaacagagtccccattcatacacagatggctagcatgactcacagagtcaccaagcaaaatgacttctagttgcatatatacagtctgtttccccccttgcttatttttcgtcaactatgatgtacattatgttctgttttatttctgccttaaattcctgcctttgtgaacacgagacaacaacaaataaaacagtctacctagatgaggaaatttctctcattgatatttagaaggaccttgagatggagtgggagatgccactgtggttatggaaatgcagtccttgtcctgaagccctgctctgagtgctctatggagtgctaggggccattggggagggaatgctttgcactccctggccatcagcagaggatttgttaggaatcatcaaggcctcggagggagcaagaagcctaacagggaagcaagcagtaaagcaacttcttagaagtggatttatcccataaatatatgcattatccatttggatccttagtgaatgaacaacagagtctgttctcaggtttcctgccttcctgtctgtattgtttggtggaggaagtgtttctgttatttttttttttcctcttagaatctagactgtcttccttctccttccctggaggttcagttacagttttttcatatgcactttgcatgtgtcccagcatttaatttttttcaaagtgctgcattctgaggaaaaggagacttgggttctgtgacctttctggtccgcagtttctatactaggaagttgaaagggttggactaaagtctcttgacagagtgtagttctgtgtcagagtcccttttaaaaaatggcttctgttttattttatatgcagagaatgaatcagccatttagaaatcataaaaagagttccctaacttttgaaatggccattgtcaatgtaaatgttggccaaaaactgtcaaaagaatccagttttttaaaattatgcattctccatttcattttcacaaagaattctctttggtaacaatgaaatagagctatcaaagcctctatttcattactgcaccatttcctcccttaagtcagtattttacatgtaaatgtaagtgcaacagttgcggtagggagatattattccttttataaatggtattttgctttacagaaggacacagtatactttctttattgccttcctcataatttcaagattaatctattttcataaatcccagccccttataactgttcagaatcaaatctcttttgtaaactaagctaactcgtattgagtcacatactcaatgtacatttagaacttggataagatttttcttagcttatcaggcagacattccctacagaaacttgtttaaccagagatgccctctccacccagcatttgaagagtaaactaagctcaaaaatataaattacttgacttccctcctatttaaattcatctcctttgtcatttcttttttaaaaatggtaggaacgcatttctataacatttgatgataagcaggctttttattaaatgccacctatgttgtctgaactttgcatggtaagcttcagtgtgttcaatttttctgaatgcgtattataattagtctatatgaagtgtttttcccataattacactctgagctgtcatttgctcactgtaaacttttgagtaagaacattttctattattgcaaatgatacattaatatatttggcttcagagctttttaatgtactacttcattaatactgctttatttcaaatcttaactgattattcacaagttcatgggggttattgttagttcaggtactttagtggcaagctactaggtaaaaataaatgttatatctgatttttgttagtgaacttttatggctaaattgacatgctcatgttccttatagataagaggtctaagtttcctgcatgaagcaaaactactacaaaagctaagaactggtcctaagagactgaactaatttattgctaagctaaagtgactaatttacagagatttgagaccagagcagcatatatatattttattcaagggaacacttgcagttattgttacataacaagaaaaagtaatccattaactgaggtagatgatgaaggcaggtttttatattcagctacattaaaatattactaatgcccgagtgatgaatatgtaatcagctatctcttttgatttatattctacaaaacttctcaagaggtattcagagtgcttgaagaccccggtgtgtgatagataaaggcagcctaatatgcacaccttattgactcagttcaggagaaaaatgtttttaatcactaaattactaagtcactaagttacatgataatcatactaggaattacaggacaatcacactaccttttccttctttatattcttctaaagagaagttccatatgtgcagctcttcttatattcatggtcacagttagttgttaaaatttacaacttaaaagttactaatggtgggggaggatatccaaatttcagaaagactttagaaatttgtaaattagccagtttgttaaccagatagatagctgcagaacttcagaatttctacttaaactggtgggcaaagaaacgcagccaaccatatgaccgagaatgtaaatggaggatctagagcatatgtagtctaaacaatgctttcaggagtactgaatttgggggtaagaacacaaaatcttacaacagaattaatctagattacaaacttgaaataggcggacccaggtttgagatattgtcatctcttacgttcaatttgcttttactaggaaaagtcaccattgtggaagggagctggagtcaggtagaatctcctgtgatgggaggagtttgagagggcagtatagagcactgtgggtttgtagtatttttagagaaaagaagcatcaagtttttccacctagaaatctgagagatgcagacgctgggtcacatctgtggactgtcctgtgcagcatttatttctggtcacacagccctaggcttctttctgggtgcatgtgtatatcatcagtggtgcaagccttgaaagagttggtagtgtgccaaacatccctgcttctctcattaagaactgagtcctttcatttacttcaatggtactggtatattacgcctggcaggtcagtcttttgtgaatggccagtaactggctgtgttgttaattacaaagcatattttgccaaatgatttcatccaaaaaagcatgccaaacaacttttaattctctgacctcctgctatatatttctgtatattattcaagatgaactcactggaaaggagtgtggtgagccatggccataccgttaaaaaaaaaaaaaaaaaaaagcacgaggctccaaaaatgggaattaatggaactggccctgccaacagactgagataagatagcacctaaggaaactgattgatattcttggcccaaatattatcaggtgcagatttaatttcaaagtcaggactttggacataattttagaccctaatggtcaaaggtttcatggaacccattcaacttagctggcacacattttatagacaattatactcttgcctagacgactttctctttcttccatcatgttttaacctattcagattgtctgctcactgattaggctcaccagtaaaagcaggatccctttgtaatgctgctaacgtattataggactagcacttgccttacagatagacgagggtttattaagctttgactatgcagctgtagagtgcataacatggactatgtattataatagagtgggagagggcacttttttaatgctcttaggttgagggccactgcattagagactaataattttaagcgaagccacatttctaacaaggggccagataatgaggataaatgaaatctgtactcagtctcagggttcatttcagccattagttataatctcttccaccaaacctttttttttttttttttttttttttttttttttttttaatttcaactgtttcttttttttttttttttttttttatattcttttttttttttcatttttttttattaggtatttagctcatttacatttccaatgctataccaaaagtcccccttacccacccacccccactcccctacccacccactccccccctttggccctggcgttcccctgtaccagggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacatctgggtcctttcgataaaatcttgctagtatatgcaatggtgtcagcgtttggatgctgattatggggtggatccctggatatggcagtctctacatggtccatcctttcatctcagctccaaactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttggctcccttgtcaaagatcaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatggggattgcattgaatctgtagattgcttttggcaagatagccatttttacaatgttggtcctgccaatccatgagcatgggagatctttccatcttctgagatcttctttaatttctttcttcagggacttgaagtttttatcatacagatctttcacttccttcgttagagtcacgccgagatattttatattatttgtggctattgagaagggtgttgtttccctaatttctttctcagcctgtttattctttgtgtagagaaaggccattgacttgtttgagttaattttatatccagctacttcaccgaagctgtttatcaggtttaggagttctctgttggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaagaatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccgtctggtcctgggctttttttggctgggagactattaataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgattgtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgttttttcttgaaggcactcatagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccatgtgaatgttggctttctgttatttattttgttattgaagatcagccttagtgcatggtgatctgataggatacatgggacaatttcaatatttttgaatctgttgaggcctgatttgtgacctattatgtggtcaattttggagaaggtaccatgaggtgctgagaagaaggtatatccttttgttttaggataaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggcgcaatgtgtgctttgagctttactaaagtttctttagtgaatgtggctgctcttgtatttggagcatagatattcagaattgagagttcctcttggaggattttacctttgatgagaatgaagtgtccctccttgtcttttttgatgactttgggttggaagtcaatcttatcagatattaggatggctactcctgcttgtttcttcataccatttgcttggaaaattgttttccagcctttcattctgaggtagtgtctatctttttctctgagatgagtttcctgtaagcagcaaaatgttgggtcttgtttgtgtagccagtttgttagtctatgtctttttattggcgagttgagaccattgatgttaagagatattaaggaaaagtaattgttgcttcctgttattttagttgttaaaggtggcattctgttcttgtggctgtcttcttttaggtttgttgagggattaccttcttgttttttctagggcgttgttcccgttcttgtattggtttttttctgttattatcctttgaagggctggattcgtggagagataatgcgtgaatttggttttgtcgtggaatactttggtttctccctctatgataattgagagtttggctgggtatagtagcctgggctgcagtttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatatgcatctcattctttagatttgggaagttttcttcaataattttgttgaagatgtttgctggacctttgagttgaaaatcttcattctcatccactcctattatccgtacgtttggtcttcttattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactgggcgaagtgggtgtgctgggttctggtgatggtgagtggtcttggttcctgttagtaagattcctccgtttacctttcgccatctggtaatctctggagttagtagttatagttgactctgtttagagattgttcttctggtgattctgttaccgtctatcagcagacctgggagacagattctctcctctgagtttcagtgctcagagcactctctgctggcaagctctcttacagggaaggtgcgcagatagcttgtatttggacctcctcctggccgaagaagaaggcccaaaacaggacctttctcagacagtgtgttgctttggcagttcccaggtggtacagactctcacctaagcagactaaattcctaagttccttggagtcccgggaccaagatggcgaccgctgctgctgtggcttaggccgcctccccagccgggtgggcacctgtcctccggtccggaaggtggccggctgtccccggcccacacagggtgctgcctcagcgcctctgtgcttctgcctgttccagaagctgtcaggttctctggcgcaccctctcacctgttcagactaatttcctaagttcggcgggtcccggaccaagatggcgaccgctgctgctccaccaaaccttttactatgaagcaaaattgattaatttgcatctatctcttttccctgcacccacatgcttgctgatagaatgaacaaatagagaaatggatgagagaccaaagatgatgggggctgagacccagtagactcggggacacataatccctaaactggagaatcatgataatacatctgaggggtcaacattaatcttgacatgtaatcattcagaacaatgttaaaaacaaaagattgtatagtatcattagtaaaaattacttgcaatggaagggctcagaataaacatgactttctctttagcatgaaatagaaatttgttgaactggtcttaatgttctctcagcacacatagatataggtccctttaattccatatcctcttatctataagtcttgcatttaatttactacaactctagttgatttatagttctacatagcaaaagtacactcttgattaaaacaatattatagtagctgatagaccttgaaagcattttttttcacagacattctaattattttaaaactgacctgcagagcttctagttgaagctagatttgtaagcctccagtttttgcccacttggccatatttctgaagactggtacagtccattagggatatattgccattcttttcctagatgcgttctctttctccatcctaagtagttactaaggtaattatagagcagacttaacttcagggaataccaattctctttgtaactgatcaatatctcattgataaatacaacaatagctgtgataacacaggccagcaaagcaatgcaagggagaacacatatatttttgcttacaattccatggggcatatagtccattgtagtgaggaaggtaaagttgcaagaggatggggttagcacctcacattgcatcagaggttgggaagcagggcagaaaatgatcaagaactgtgggacgaagctataaaacctcaccctgcctgtaaggctctaccttctaaaggtccccgactggagaccaattgttcatacacaggagcggggatgctttccacattcacatcacaacagtgatttttttcagtcgagaagacttagtttgcaaagctggtgatttccataagtggatcagaattggttgtgttccacagagtaccaatttccactctcctgctttgactcttcaatgtatctgtttgttggcagccatggtccaaacatgatttaaaaattaaaaaaagctatttctaaaagagtaccaaagaaaacattactcccattctccgggttctgctagttgaaaaatgagtcaccctagtttgggcttcctagctttgtggcctatcttcctgacctattaaaacttgcttcacaccaagccgttactttgaaatcaccatatttataggagcttttccttgttcaaatcagaggaacccagaaaagtgtttttcttttaaatcaaagtggttgcctgggccttttcacaatacaaaagtaaatcaacagtcttggtaagttttattttgttcaacatgtccttcattttgatctcatataaacaggtttctcgagaaacaatttattttttatttttttaggaaacgattattttaattactaaattactaggatttaaaatctcaagagatttctatagaagagaattgtgttcttatttttaaaaaaaggatttatatatctaatctactcctccatctgattaattatttttctccaatatgtaggcgtgtggtttgtcccacttgcatggttggttagtagagattatctggtttaactagggtagtagtcaccgtcaggagttgacccttttccaaaccatacttgctgaaacgtgatctaccctgtaattctaatcaagttttcacccccttcctcacccaaagacagttaaatattgctcaacgtgcagataagaaacctgtctcagagttttgactagacatcttaataacaccaaaattatcttcaattttaacatgacagatttttgataaatagagttaaagattcaaaattgactccggtgaatgatagaggataaattacatgtgctgtgtattttgaagaaccaaattatgaagcatctgatattgtcactgatcaggaagttagtatagagaaagtatcaaatttgtcattgccttagtgctaagtcagatattggggtggttggtaaatgcccttcatcctagaaatatctgggaactagacactcatatttcctctcagcagtccacagtcacagcccatggggtctgagaggccttactgtggtggtttttaaacagctgtcctattgcatttttagcaagaggagatttgtaagaatattgatatcaaatagatagaatagccacagggatacactttaataaaaaaaaatgcagtaatcgctcaaaagatctgacaggctcaaggggtatttgtatgaagacaggatggaatccatttatcagtggacattgccttccctgaaaacctagaaaacttgtgcctaagggcagaaatagcaaaagcggttctcgctgacatgtttctcctctaaaccttaacgtgtttgcacacagagaacgcataaaagactctgtctccattcatgtgctctagaagaagcctgtgtcccaggaatagtgtgtacctgcctttgcactcaccctccagtatgttagacagccttacactcctcttgggaagtcctgatccaaggcaactagagatatgggagaatggaataggatcgttgtccatttaatttttcatttttattatcagtgttttcaaagaagttaagagcttagaatcttttttcttcagctttgtgcactattctatgaggggatggtcagcttccttttgattgtatgctaattgaagggaaagcatgttggttttgcttacaaacaaaaaaaataaaacaaaaaatatactagtagcatatcttcctacagccaatacacttcctttttgggtttcaacaaaagtttcatactttaaaatgtcacagtggtacctgagctaggataataaactatagaattgccttgtccgaggctaattcgaagtccttattgctgttacattgaagatactatgcaacatacagtctggtcgttttcattcctttttagactttccttctaagcagggtctcactatgtagtccatgctatggaactcactgtgtaacatggatacaacactccatatttttttagacttatccgtgttggtttgcctacatgtgagttacgggtttttttcttttattggatattttctttatttacatttcaaatgttatcccctttcctagtttcctctccagaaaccccctatcccatcccaggttttaaaggcactagagcttgcaagagtcagcgtaggaagtttcagaatacaatcttaaattgtgaatgtagctacttgggttttcctctagtttccttattccaggctgggaggtgtggccatcaactatcctactgtatgctactgtatcctactgtatgtatgtttgttgcagatttctaaacaaatagtgtgacatatattggacacacacaaatcagtgtttttgcaggctctatggatagcatactagccttccaatccaaaatcaaagccttggaaaacagaaaatgaatatctactcctaaagacaaggggaacgggttggggacttagcccagtggtagagtgcttatcttagcaagcacaagtccctgggtttggtcctgagctctagaaaaagtaaaaatgaaaggaggggggaattgcattggaagttaaatgataaccttttctttctgtttctatgaagaagtctgtactaataaaactgccaatttctttcaggtgggtgtgcatggcattagaatagaattcatcaatgaaaaaggatcaaaacgcaccgccacctacctaccggaggttgcaaaggagcaaggtcattgttgtcctttatttcataccatctagtgactagtttaaacacgctgcagtgcagtcactgaccttgcagttatgtctgataattgatcaacatcaaattataagaactgactcttccatcactgcctctgcaatgtctgcctcaaattggttaattactcacatggaatctgcacctttcactgatgtctgacagcatcctcataagtgcaaacttttaaaatggcacacatttgtagaagttaggggtttattttaggcagctgtttgttactgctttgtaacacagttttccaggcaccagtgtgcagtaattttgatggcgttaagaggccttaggtttagaaactacatcaaatgtagtttgatgtcattcattgtcagtatctaacaattcttatgtgactgccataactcattcagctaatagtgaaactataagctttccattaagattgggggtgttgtgaaaacatgaagttttttatgtttactctacacttcgtaatcaaaaataattttatttcacagatatgccacacatctttatgaaccaatatggtgacaccaaacaacttcactatagtagtttgtccttcctagccactactgaattctaagtttacattagtttaaatgctttttaaaaattctatcgcacttatcttttcagaaggcacttaaatgtgcttttctcatgtatgctcatataaatatgagagatataacaatagattttaatgttaaacctcaaataaaaatgttaatctttaaggcagttatgtgaagatttatttggattgctttagaaaatgtgttaatactgcaggattaccaactccataaagatattagaatagcattcatattagaaacaatggtattcattgaatatttcacacaaatgtagattatcaagcatagaagataccattaagaccagcaatcaccatgaaatagggattggagccccaactagtaagttgacacaagtcatgttttatttatttaggctttcccttctttttgaaggtaggaccattagagaagagtacctggttgtgatttgtgacagagacatgactgagtagtttcttagacaatttaaggcatgttgtgatggacctgattctatacaaggataaaatgttagctcttctatctgactggtttttaggaccaaaggaattgatggcatttggtgacagggatagctgacctctaccaagtcatttctgtatttaaccaaaggtgcttttgtgacactgcttaactgatattttatctggcttcttctgcacaggatgggaccatattcagaccatagactcattactgagaaaaggaggatacaaagctccaattactaatgaattcagaaaaaccataaagctgaccaggtactgggatggctgggatggcagtttgtaactaaccagtggactttgaaggatatgcctatacctgattttcttttttaagactctcgaactatccttgcttctcttgtctaaaatagtggaaacaaatggcagagtgtcctgagagtggctacaccggaagtctgctgtgcagtaaagcctgcatgatacccgaagtcatcctctccatctctagctccatacgatgacttgggctttgtacagcaagccctgtgagacttgaaactaccttgctggagaaagtactagaattagctattcacaagcttttgacgtcgcctagcagaaccccaggattccaataagcagtccgaaaatttaaatttaaccttagaattttggcagtgataggagtctactatgaaagcttattgaaaaacaaaattgagctgaatgtgaatgctaaataaatgtcaacatggaataatagggattcttacttaaggaaagtattgaacattttagaagaatggggtactgtttccatttatttcagttccagaaaattgtattacatgcctgtagtttcaaaaaatggattgttctcagctctgcacagttacaaatttgagaatgtccccatttctgttcttctcaagcttatagttgaaggagaatggaagggcatgaataaaaagaatcactactacaaggcagactattacagatgtgtaggatcatagtgctagggacggggaactccaggaagtcagtgggtaacagacaacttcaaagtggaggtggacttagggctggctttaaagaacgagtagactatttggcaggtagagagcaagggaggaaagggattcctgaagatgtgctgtgaatcaaagcacgtaagtggtgcagtacaaagccagttctaagaaatataaagcactatgatttggcaggtctttcagcgcacgtaggaaatgtcactaaagggaaatatagtctagaaggttcatgatagagctgatagcctggaataatctgtgagcaggtcaaagtcaaagctgtggggatcccagtgcatggaggagggcagagtgtaaagtttaaactgcgaatggtggaaccaaggaaaatcctgcaaggtaggaatagaagcagctgtcaaagagatgagaagcagggacagcatcagggaaaggtggaggtgtaaaatccatgagcctacagaacaagtggattgtgggagtatcatggaaagttccaaagagaatcctaaggagcctctgacagccatgaaaggacagtggcagaaccaagggacactgagcacctgctaggaaaagaaagaacctgaggggagaaactgtgcttactctcctgaaaagttgggtagtggacaagtaactagatagagacaaagtgagagggcttcagtactgacgtgtagcatagagcagacccaagatgtgtgaacaaaggaagagtaaagggggaagtgatggaaggtctctgctataaaaggagcccaatgaatgagatgtgtctatgatggcgatagagacatgatggtaaaagatagcctcttccttgttccttcctgatagcaaagtgggtaaaagggacaatgtcattcctggagtagaagggcagaaagagcactaagatcagtgttctgatctcagctttgctgcttaccaagtctgtgactttgggctactaattgcttctctcatggcttcttgtttcccactatataaaatgatctcatagagtccctctggctctgataatagcataccatgtgtttctcaatgttaacttttctcttccccgccttccccttcaggtaccgtagtgaaaagatgaccttgagttatgctgaataccttgctcatcgccagcatcatcatttccaaaatggcatcgggcatccccttccgccatacaaccattattcctgacactgagccgcacaaccagtcactgggcctctctgcagacctcttcccaggagaccctacaccttcttggtctagctatctcttttactgtaccattttatgatgatagtttccgttgccatggtgaagcttcgacattgttagttaagagcatcatggtaacgggtaggacaatggcatttgttaagaagatcctgttttattattttagatcactgaatttttttttcagcacatacagcttttgaagttttctttccttacaatattaggtatctttttttgctttgctatctcagacaggtttctgtctttctttgttcctttttttcttcctccttccttcttttgactgtggatggaagaaagtatgctgtttctgagggtttattagatttgtctttagtattcttcggtaagattgtcattttttgatagctgagttggggattaattcttaacaaattcaggtatttgtatattactcatgaatttgcctaaaattctatttgctatgacagcttagtatttgggtcaagtacacattttttcccatggttgaaatgagtgagctttagagtaagtaatgaacattcagaggtccatgataggacttgtcacagagagcaaggaactgtttacgccttctgtgcttctgtgttactgtagaagagactgcctcatgttatagaacaatttacaacctacaacactgttttagaaaagcataagctacctttcaaatgggccgcggaaatcattgtgaaaggcagcatatattgggaagagattagatgcagaacttagtgcctttgagaagactataattaagtcaaattaagaggggtttaaaaaggcaatttagagaatattcttataaaattttattgtttctatataagaaacaacagattacacaaattccttactccaaagtatttttttagctgaaaaaaattattttgagcaaataaccaaaaagacatttgtctattttgtattcatttaaatttgttagctttaggtttcaatgagtcataattggccagagacaactttagctactaagacatgataaagataatctagtgaaacaaaagttcatacatactatgatttcaaatttgtctatcacagagacaatgctgagtttcagagatactacaaagagtttgaatctctttctgcactacagccttttgatagaaacacatttctgtgttgacagataatatggtagacctgtaaagatggcattcagatatgttaattagagcctagctcatttgcagggctatacttcccatggcacaaagaaaacttactgatgtcaatgggaaacccttttgtttatccccaggaaaactcatgatgattctggcaaaagatgacctttgttttatggtagtatatatataggtatatagagatatatatatttgggaaatatataattttttcaaacaggaagtcattagaacaagtggtgagtgaaatgctgcagaatgtatattctacaactatgacataccgctaattattgaaatagtcaagcttatacatttaattgctgtgacaagtgacagactggtagttcagaaaatccttgtctagtttgtaattggctgaattcattgtccttgccatcagggcaaagtacacagcttcagtttttgagagttctttgaagtttggtatttcttcatccacagaatccattgttgacgtatccattttcagttatgatgccttaactaagaagctacttgctagcctgaaagacagtctcagtagccagttccattgaatacagagaaaacataagctgctgagctttagcatgggcttctaagtcccgttgtttctccttggacacactttgtgggtggattagtctttcagtatagaagcaagctgctacctgacattttcttgcccttatagggaaagtgagcacaagctgaatgatattgtctgctaggaaaagagagagcgagcgagagagagagacagagagagagagagacagaaagacagagacagagagagagaagaaaggaaaggggagaaagaaaagaaaaggaaagagaaacggaaaaaagagaagtaaagataacatagaaactgaagagagacagactagaccaatcttgttgtgaaatccatctactccatcatctcatcatttcagagctcctcagcccgggggagcgtacggctagttttttgttgttgttgttgtttttaaagaaaagatctatcacatacatatatgcgtgtatgtctccatatacttacacatgcatacatgcatatgtgtgtgtttatgtatttaacggtgctaatcaatcttgagcaggtcacgtgactggtcatgcggactctaaaatcatatcagattttttaaaaaatccttgatatatgcagatattatacagattttcttaccggtgtaataatgttctactgaagaataaccatcctgcaggcttcaaaggacgaggtcagcaatatttcccaccatggcttggggggaaaggatagttttgtctccttttgtattcaagttgatgcatagtgcatttttgtgtctaagtagctgttgactaaaagactttgtagtgtaaagggtgttatacaaactataatggtgtgcttcaaacaaaccaatgctaggccctttcactcttgttgtatatgacaaagttgttaaatatgtggtttgaaataactttgaacatgtggaaatatgtagcatgtgtctttaactcagacaaagattctaattgcacaagttgtgttctagccagttgtggtttatttgttcagaaacacaaatgtgaattgtactctttatcaccagaatattgtatgagttccgtgatctttaaacagctcagaagtaatacttgaacttcatttgaatagcacaaagtttacagagccccttttaaatgttaattagttccagttaagttttcctttaattttttcttttttttttttttttcttttttcaaatgcaactgggtattttcttggaaaacaatgtgtagtttatttttggtatgtagcaaaaggcttccaattctggaaggttttattgttcttaaacaaggtcagccaggtaccagattctaaaaagaacaattgccccccccctcaagtggccttctgattgcacgaatgtgctactcccctctccaatcccccctcccttgaggaggtcagtgaaagtgatggaggaagtgcaaggcttgctctcccctcccctcccctcccctcccccccacacctcacctaggatgtccactccaatgcaaatggttccattgcacacacagcacaccgcacaccgggaagtttgtatactggcctcttttcctgtcttcaaatgtgcaagaatttgaaagtgtcatctggaataggttccatctcttatgtgtgttagagcaaaccaaagaagcccccagccatgcccaaatgctgctccaaaagcctgccttccagtccttacaaaaaccttgcaggattaaatgtgttaacttttttatttttgtacagtttctaagtgattttttgctagtgatgttaaactgaattaagtttatttgaggagtgtgagcacctcctccatttaaataaactggtgactttccttttcttttttacaagtggaaacccattgtgtgcctctcgatttaagggtttctgattacatttattcttaagaccagcattgatcctttatatacaaagatatgttttccttgttttttattactgtttcagaagaaaatgaaccttttattttgctccagacccagtaactgcgctggtacttagacgcactgagaaaaaaaaaaaaacaaaataaaacaaacaaacaaaaaatacttttgtaagcacctctgaccgcttttgtatatcaaagttgattacttttgagatatttggatctagtttctaagttattttagtgttttatatgtttcccaaaattcctttgaatcggtcaccagcataaagagtttttggtgatgcaatggtgagacttgtaacaagcaaaaagctacctggagtagctctctcctcccttcttagtaacctggtgttttgattacagtgagacatcacaggttatctaaaagcccttcgttataaccagctcctccctccctccttccacactgaattgcttactagtttgaagaagttattggaagtgggcattttatatgacatgtatggctttaaaatattaaaaatgaacaaaaaaagagaaaaatatgaaaaggtttatgtgggtctgtaaggtatggctgtggaaagacattgtagtagctttgacactattgttattacccaataaaatgttaaaaatgaa

SEQ ID NO: 689 - DNA, 58846 bp, mus musculus
cggcctcccgccctgctggctccgccctcggccctgcccattccatcatccacccccctccttgtgggcggtcctagctgctcccggccagaagaaaagccaccgtgcctcccctgcttctacctctcacccttctcttaggagctgccttcatcgcagtcacgccccttccttccgaggagctttctggctgcgttcgctggtagacccctgaattacccctccgtctcccttctctttcgtcccttcccttagttctcatcgccttcccccactaccaccacctccagcctatctcgcctctcaccatccgctgctccaccctctggcccggtatcctgctcgtccactgccaccaaggagagacccgagggagcagcgaggttgggagtagccgggacctggggcttcctccctacccatccctggcctccggcccgggacccaaaccgcttgagcttgcagagagagtcctcaccttgtcctgattgctttcagaggtaggagaagcgtccttacttttgcggggaactggggcagtaatctgtggtgttgtaaacttgatcatgcccgtatttgtgagtaggttgttgtagcctgtggggttgcctgtatgttcttctctttttgccggtggccttgagttttctgagatgtgcgagaagtttatttaacgcagtttaaaagtatgtgttcctgtcctactttaaggaggagatgctggaaggggttccattgcttggtgctgctttacttcctccctaggttcttgtaggttcctactgatttgatcgcttaaggaactaagttagggagtccgaggtctacctttagtctccccacttatttagggacgccgaggtctaccttcagtcccgcaactgagttagggaatttgaggtctaccttcagtcctgcaactgagttagggagtccgaggtctaccttcagtccctcctaagttagggaccccgaggtctacctttagtcccgcaattaagttggagactccgtggtctaccttcagtccctccactaagttagggactcggagatctaccttgagttcagcttgaggaattgcccttatctcagatagctagattgctttctcctaagtgcttaggcttgggtttggtgctcacccttcctgaccccaaggccatgaattcttcaagttttaaaatgtggaagtaatgaaccacacaactgctcgctttatgtatgcatgcatgtgtggtggtggtggtgagactcccgaggcggagattgccgttatttgcttcataaggtcagaagattttaataagtagttgtgcaacatcaggaaggtggttgatttaaggtctgagccccggccacagaacttcttgttcatcaacagcaagaccatcttcatagatagatgatgagaagaaggagaaggaggagtgagaatgacagattttgtagaccacgggcagtccctgatgattgctgctaataaatcataatatgcgaataatttgcagcagggggctgaatacaaattaatgaaagatgaaagggaaagatttggaaaagcctccagacagccccttgcctccagacgtggggaaacaatttataaattacactataacttttttccctctcatttagaaagataatcaaccataatctttagtgatgaagggctaaggatatatgtaactcttcttgagtttggccttgtgaaactctctctttctcaggccagctttggaaaactacctcagactttcagtaccttccttcaatagctaaggaaggtccaaaatgctattttggacacagggtaaattcctacctgtctcctacctctcttcatttgtgcaagtgccacaggctttagactaattgggttgaaagacttgttcctgagatgtgcctgaaagccattgcttattctttagggaacaaataattgacatatttacataaaatctttggttggttttaacaggggtttgcggaagatgcaggaagcgggttgggggtggtcaggaaggtagagcaggaatgctacaatgttacatagtgacaattttaaaggctatcaggtttcagatcagctgggaggaaaaagctggcctgaccaaactacattttcaaacgggcctgggacattttaatagccaggtggttgtggaggagcctcatctatttacagaagataactcaggtcccagctattctgtacgggtttgcctggtgtcgtttatgggccctttctggtgctacatcatacttcattttaagtcccgtcatactttgaaaaagtttgtgtctctgtaaaattgaaacttaattttctttctaattcacagcctaggtataaagtaatcctgtaactccacctgaatgtacagtaagttttacatggatatcctgagtccctttacttgaccagcaacaacaacaacaacaaaaatttagagattcatatttgtcattgagatttggagagtcaaatgtaatttttaatttgtgaattaaggtttaatagactaatgcataactaaggcattttcggaggtcaattttcctctacttttgctatagaatgaagcggaccttcggatgccgttgagaatggaatagtaggaagatagagggatggatactttgactttgaggtcccattgagtgccagcattctaagtgggtacatctgcttctgggcctctcctaagagctctctcccagggcctgtgccttctttaaaagggtgtctttgtaattaagcagcccttccccccaactcccttcttcttttgatccagttttttaggcttattttccatttggagacaagaggagtttctcacaccctcccgcctcccctcttaaggtgtcttttcctttatcccagaaaatcacacatacccccactaagttctcaggatggttagcagttttgttttgtttctccgacagaggcagtgttaccagttggaggagtagaagatatattcccccttgggaaatgcttgtggccaggtagcctcctccatggagactgaacctttggaatgcatgagaagaatctattcttcaggactgtctggtagaaattgtcctttgcacccattaagcccagcttaaacccactgaaaggggtggagagaggtgtgtgtggtcggggcctagccttttaggatggtaaatgtttccaaatctcctattacatcacctctttctcccatggattcagtgggtttagagatctgcgtgacaagttaattagctggggactaaaccaatttgtttagaatcgtgatctattgatttcctgtcctcaggaatttttgtcagtgttttactatgatgtgttgtctttagcattacttacttttcgttccttctcgccttttgtggactttggtccaaaatctaggtttccacccccaagtcaaaggttagaatttagctgcaggaactaagggggtattaaacaggctgggatagcaaagcactcgcctccatggtgggcttctgaccctttttaaggaagctgccccttccacgtacaacacacacaatctgaacaaaaaagaaaaaagaaagaaaagaacatagaaggtcatttgccttataaaagcaaaacttcttgaacagaactagctttcttagtgtctttaaaccattgcttgataggttttaaaaaaaaaaaaaacctcactatatctggactttctcgggaacatatttattgcataaaagactacattagcatttgctgtgttgattctttcttgaactaaatgaggctgttattgggcttttgaagccttttgttataggggatggagttaattgtatatatcattccggcttgtactaatgctggccacgttagatttagcccacacatgcttgtagaaaggatttagcattattgtctagagacaactcgaactttgtagattttatccacctcattttggtaaagttttttatttccacttattttttgactaataccaggacctagattattttttagtttagcaaataatggccactgataccatttctgggtgaacccactggtgggaggagcctggcctttgggtacatttcctcactgtaaactgtggagactgggcagagtgatattgatagtcaattttcaaaagtttatgcttgccttctgaggcctcatttatctggtgtgcccttgaaggattgctatcagagtgaagcaaacagttatgacaaacacaatcctgtactcatcctgtatgcaggggtggattgggggatgagtctgtaataacacatcgacagaaatgtgttttatattttagcagtatcaaataataagcccaagagtctccacgaaacttcaagaatcctggtccctctacgaatggaaatcttccatactttgggtcataagagtaggtaatgttgcttttcaacaagagttcgttgaggacaaagcgttgtaaactgctatagagtaaaggagtatgaaccaatgaggacatgtcaagagtctcataagtattgttcctggtgggcctgggggtacagataggtttcattgagctctaatcattgcctgatttagaggtggtttatgtatgtagcaagcctattcttgtggcctccctcctctgccactcttccccacaaagaaaaaccaaaccagaacccagtgtttacttatctaattgattggaaattatttttaaattgctgcaccattgatatttcattaagatagtatacatttgggtggactgtgtaggatccagaatgaagaagggggatcaggaaggcctagatatgcttgattgatagcctcaaaaataatgtttgccagactgaggaaaaaaaccgtgaggagacgattttgtaggcaacggaatacacagtatataggtgaagtcacgtggtctgcacacaaagggttcttttatctgagaacttttgtacatagtgaatcttaagtttcatggacctctaactttccttcagtaaataaaatataatctctgtgttatgtctaatttttgctatctggtaaactaatattatttctccacaaattcaatgaaatttctccagctaaaatgtaaatactaaaatcttaaatctgtagcatgtataaatctccaagtgaaatacaggaatatgcttcatactttgtgttcctgggggtaaaattcaggtgggtatatttggatctctctctctctctctctctgtgtgtgtgtctctctctctctgtagatttgtggagtcactttcactctttctctggctgcctgaaatggcattagtctgtgtgacttgaagccaggatctgggattctctacccagcccctcactgacttgccatgtgaccaagggtagctgaattagctgctctaagcttcagttacccttctgggaagcgaggatattaatacttcacagaggtgtttaggcatgcttcatattgggcacatgctttgaggtcattggatgaaaggtgtttgtatgatggcagaacaagcttattatagggtcctgagcaggtgttcatgtttaatgagcttttgctctcttataacatacagtgccctttggtgccctattgccttactgactataattaagattgaccctatatttctgttattgaccctctcaaccttttccaaaaaataaatattttcatattctgtcataggttgaagtaaaaatttaatggactgtagtgactgtcagagtgaggaagcgacattagttggaatgcacccaagtgaccaatgagttcttgaaagtcccttcaaatgttagagtaaagcaaatgtggctgcatctgtgttttcagggagaaaagttttgaggaatatttgcctgtgacaaatactactgatagccagtgactgaaacccagctcttgtgctgttttgtgcacagctggtttttattaatgatggaatatttatgcttgctgtacaattcgtggctcatttccatgtgtatgtcagaatttaaatacccctaaaggcaacattaagataacattaaatataaatgtggccaagcgagaaagagtggacttgggggggtatatctcccttatatttattggtgttgctttagattacaataactgatcacctttccacattgatgctgatcttataatatcccttagtaaacttcacattttcatacctttgataggaacaagtgattggatcccccctatgtatgatgcagatgaaactgatgtatgtatttttttaggaccttccccccccccccccaacacatgcttctcattatccaagaggcctggtctcaatcaggaaaagagcagagaaaccacataattgaaaggagaaggacggcggtgcatacttggaatatttgcgggaaggggattgctgacatcagaaaatgcagtggcctgagtgttaacagcattggagagaaatcagctttctgtttctgtgtattgagaattattttaaggcgatacaaatatgggccagacttgacatcttttatgaagttatcctggaaactttgatgagtgttgttatagaaaagttcaattaaaaccttccttattaggaagctaattagtgcatcctttactcgtttttagttgttttcaagggagtacccatttgcattgaattagtgacatgcttcctcgtgtgatagcaaactaagattaaaaaaatatcacacaggaggaaaagcatttagattgccagtcctgaaaacatagaatttcctttgttccatttgggttttcagttcagatctttgtttttactcccaaatgggtagtgaactggggaatagttgtgaattggggaactatagtggcttatgataacacaccattttatttcatttttcccttcttgtatgattgtcttctgtctgtatccctcccccctctgtgtgcgtgtgcatgtacatgcttgtgtctgccttaatacatgcatgtgttgggagcaggagagaggggggtacagattgttttccaaagcaaatagtatttggaactaagaaaaatagtgatgacctgtttcaccccctagggggttctttctgcccgagggttctgattgggattgtgtagggaagtgtggcaaattttctgacctggttgtttctgtgaccaggctgagcacacttttggtaccgtgaagaggttatggtgcactaaccttaagaacatatgcctcctaataggttctagtttgcttcacctcttttagggaaatcaacattggtttctgagatttcaggaccatctgcagaagactagatgttctatagagggatgcaatatattttgagcttcacttccctccataacttgtaggagatagtcattctttatacatagtccctggtgctgccccccccccatgggccatgcctgccttaatgtccattactggggcaattactttggccacatggcatgtggcataactgatcgtactcaagtactttgagaaggcaaggtctaaattcagctctgtcaagcaacgcagtcacactgggtttctggtgcttgcaggtcagcagccggaggaggggcagtgtctcgggagagtgactcaggttctttggcatgctgataggaaacattggctcttgtccatgcacctgctgaatgatgccacacctgccgtgagcacctgagccacacgcactcagacacaaaacctcaactccaggcaaatggggctcctttccaaagtcatatcacaaaatgggggactctgaactatgtcagtagaacactcctaagagagttagatgaagccagtcatccccgcgttagcgtggggaaaggtcttaaaacctttctcgtaggtagaacacacttagacatactgttgaagtgctgagtgaggagtttctctctctctctctctctctctctccctctctctctctctttacactaaaatttaaatttaatgaaaacaattctgttgtgaattttcttcttgaaaaccagacagggaaagtatggaaggctttgtctttacctacataggacaggaagtcacgagatttggttctgatcccaaccctacttactggtggacaacgacgaaacattggtcaagttaattaacattagctatctgttctggactcaggtttctctggttataaagtcgagttaattagatccgcctttatttatttccatccacagctgctgagaaaaccaggaggagtgaaagaaccacagactccttagaaggctgagaagccaaaggtaagaatcatgttaactaacattctatggcctccaatcctcttctattttagcttctatccaagtctttggaaagccatcattcactctttatgcacataccgagtataaagagggctagaaataatatatacccatcccatggcctccaagatctcatagcctaggaagttgcacttgtcttctgtttctgggtcaatttgctgtgatttctgcttggacacttagaagcacaaaagaggagaattaccttcttttatgtctccacattacttctggggacttcatccctgaagcaagatcttcttcattgaagttatatagcagagaggacttgagagtttactttatttataaaggaattaatttcacatttacaatgtacctgattctcgaatgatcattttctcctggggtccatcattctatcagccctggtgaactctgctctttcctctgtatgccccaactctctctatgacgttatcacttaaccatataccaatgacttccaaagatatatttctgtatgtctttgaaatcatgtcgatccacaaattcagggccttctacagagctcagagatttctttccccttccgcattatcagagatatagaccacagctctgtgttctgcagaagtattgtattagactcacctgactttctcaggagctcctgattatttgttgttgagttttttccctaccccaatgtctacttagtataagctaaagctaaacacttagctatagtaaacactcactaaatgttggtgaaaaacatgctgtggttggtgctaaaattaagctatatccaacatacaatagcaaaataaagggatcagaatttattgtctattgagcagaattcaagacaggaaagaaatggagaagaattagttaaaatctttgaaggaggagatagaaagctgaactgcatttttctgagggttctggaaaagaactgaagaaaagaaatgaccatcgcgtgcctattcttgtgaagccagggacatctgtggctgctgctttcactacctaaaacctctgtcacagtgaccatttaaacaggtggcacttactcatattttattaaatcaggtcacccttttaaagtgctttcactgtgtctccctatagaggcatgcacacagactccttgcttctgtacgttcagttttacacagcaacgtgcccattagagtagattgaagacggggaatctcgaaactaacaaattccattctcagaatgtaacaggctgggtcactagaactgaatgtcttcaagctgactgtcagacctttccaagggcaaaaatgaaagatgatataagccattacaggccatgaacctgttctcacccatctgatgtttttgctaattagcttcttggccaagtggcaatttggggcaagtgcatgcaagctagattcctaggggagcccacattccactctctgccatttcaaaagccactgaggtcctacactgattctcttggctgtagcttcccagtgtccccagagccgtgctctgacccggtaaagaaacaggagccatcactgggaagagaggcccattggacttgcaaactttatatgccccagtacaggggaacaccagggccaaaaagggggagtgggtgggcaggggagtgggggtgggtggatatgggggacttttggtatagcattggaaatgtaaatgagttaaatacctaataaaaaatggaaaaaaaatgaaaaaaaaaaaaaaagaaacaggagcacaaggacattatattaagtgaaagtaagatgccgtggggcttttgatgttttgctacttgttgtttgtttatttattttaatggattgtctacaaatgtgtgctcctcgacccatttatttcatttgtgggattatatcttaagaaacaatgttttattaagattaagatttaattaatatcattaggaaaacattttccaaaatatggcaaaaggttaaatcccaaaggcatttttataacatgatttaaagtagcataagactggaccagttgactatcttaataattgaaactgggtaagtgcgcattaatacactactagagtatttgttatgacatccatgccaaaacattgctaaaaggcttgcaataaagtgaagtgtaagaacctatattatgggcatattagtaccttattgtgctgctttgtggctcacacctataatcccagcactgtttgacctgagcaggattgccaaaagtttgaaaccatcatggactacatagtgagttccaggttagtccaggctacagaggaagaccctgtctctaaaacccaagacaggtttttgtttcattgctttgcagagacctaaataatatgttcagtaattttaacaatgttgaagtactgaatttataagtgacttgtcttctgtattataaatatttgaatgtcatgtttatgttgtttatgaaagtaaacatagccgggcatggtggtacatgcctttaatcccaacactctggaggcagaggcaggcggatttctgagtccaaggccagcctggtctacaaagtgagttccaggacagccagggatacacagagaaaccctgtctcaagaaacgaaaaaaataaaaagaaagtaaacataatgagaggagattgttaaggcaacaggtatccaggtacacactcttttccttttatgttcatgctggttttatggatcccttatatacttttttgaggcagtaagcagtgagatgtggggaaatggtttaatcatccttttttgaaatggatatatatcagaagatagattggtggcaacagaattcaccccactaatctgcattttgccgacccctatgtgatacattttgtggctatcaatgtttgggctagttgcttcagcacaagattaactaaagtgtaagtagaataagaaatgaccaactctggtctgggtatgatggctcaatgggctaaagcaggtacccctgggaagaccagagttccatctcctggagctgcatgatggaaagagaggtgactcctgcaagtttgacctctgatctgtacatgcacaacatggtatatacatgcccacatactgttgtacatgcacaggaacacgcgtgcgcgcacacacacacacacacacacacattaaacaaattagaatgtaataaaacatttgtaaattaattagtgttttatttatttatttttattacatattttcctcaattacatttcccatgctatcccaaaagtcccccacaccctcccgcccacttccctacacacccattcccatttttttggccctggcgttcccctgtactggggcatataaagtttgcctgtccaatgggcctctctttccagtgatggccgactaggccatcttttgatacattagtgttttagaaacagctctatcacgagatgcttggtaagccttgaaaatttcaaggcctttcaactattttccaacgtgatctaagcaatgaatgacacaggtgaaaaggattgatgctcattcttccgttacgaattttctaagcaagtgaggagttaagccagagcaaatggcagtctgttgcaagaggctccagagggtggggcattaagtggtctcccacgagccttcccaaatttgacagtggatagcttaagaaaccctgcaccaataactgagatgcaaatagggactttaaaataaaacagctataaaatttttaaagcatactaaaaaccaaaaacacaaaaaaacctgaaattgacatgataattagagtaatagttaactttggagtctttactgtgtgtcaggctccgtgcccaacattctacgtggaacacctctaacccatcttagtgtttagtattataaacactatgtctatgctatgcgtggtatacagcatcgttcctaatttgtgagtcatgccactgaactccatgagcataaagaaacatggatgagggcaattaataaccacctggattggagctttgaagttgaacagtaagattgtcgaacccttacctttctggtggttttactgcttctccattacctgttaaactcatgatatcctacacaaggaatcgaatgtgtgtcttgtgtcacaagatttcttgagaaagattatgtctattaaagatcaggccagtaagcagcccaacttgacagcacatgaggatatactggggcttcttggctttttgctgttgttagattcatctatttacttgaatggatatttggcctgggtgtgtttgtgcgtaatctgtatgcagtgcttatggtggccaggagaaggcatatttatactgtgggattgaagttccagacagttgtcagctgtgtgcgtgctgagaactgactgaaccctggtcctctggaagagcagtcagtactcgtaaccactaaggaatctctccagcccatgcttctagctttcagtgagggtgtgcatgtgtctgtgtgatgttttattcacaatggcgtggtcacagaaaatttgacctggatcttttccatttatctggaaataaagtatgaggtagattgacccaaatgtaacagaggaagaaggtttcctagacgaggttttccatccttgtttgtagtaaagtggaggctgaaaggagaggaagtagagcaagagttggaaagacctaataggcttattgaaaattcatttaaagggcaaaagtatgttttttctggctacctggtaatgttcatttgctgtgtcttggcttgggagatacctgagcgctcactaatgtgctaagctcaacctctagttattcgggggagagaatagtggctgcaaatggagtaagaattgaccttcaccttgctgccttgctgttacagaggagctgaatatatggatttatatttgcacttttaaagacagagctaggtatttccttttgtctcccatccaatatcctcaaaggcactctgtgcgtccaagagcaacacggttattttattgattgaagatgatgtcagatccctggcagtggcaagattcaaagtggaggcaaattaaaggttgcagggttcatactattttagttgttgtgcatatggcaaggaactgtgtctttaatagtgtcttgtttttccttaccatcccagatgggcataaggtctctaagaacagagccatagctgagcaggaactaggtatagtgtttatctgtttgtttgtttcctgaagtgatttgttttgctgttaaacagaaaccaaaaggatctggtgtgggggtggaagagcacagtgggtactataaactgattaggactttcaaaagaatacaggaaagcggaaaagaaattttggggaaaagagatttgagacaagtaaggttttctccagtgaagatcagggtgtctgaagaaagccagtctcaatcagcatgaagaatctaagcagttctggagataaaacctgtggcacttttctctccagaggctcccactttgaaagccttgggctgttttcttgtgtttcagttgaaacagacaattgctttgctcagaataggacaaagaagcatggtggttcttttccaaagttctgcgcacagtctgatttttgattccaattaaaagttgcttctctgctatgaaatgagggggagacaccctaacataattaccttgcagattggaagcagttttgcctttgatcatgatcataactttggaccaaaacaagatggaaagacaaatttccgggtttgttcactctttatctgctcagtttatttttggcaacattgcaaggaaataatgttaaattaatcactgtgtggtttttcggattctttaaaaaaaaaaaaaaacttgaaaattttgggcaagctcccaaaataagatgctcatgtgtttcttctgcattgctgtgctgcttacagagcctctggtgtggattaaagttttcttttcttttttttttccttccttcaaagtgatatgaatgagtcatggttaggccaagatgtggttcatgtgcaaccttatggaaacacacactcttacattttataacagcattggttggacttgggagggatttttagagagattcaaagcagaaattgtaaatgaagatgacctcaaatccatatctgtgggatgtttgaacctcatctccaattgtaattgcacttagcttcatttaaaacgtagaatcctttggcagagacacagggtcagaggaagtgctgagaaagcaaaccaaggcatgttctgctgcatggagaagggctgctgttttgaactgggtaggatggtcagttttcctccttgtgcaagagtgattaaccattgatcagaatgtaagctccaccgggagcagggactatactgtgtgtatctttgtatgactcactgtgtctagcacgaggatggcaaatgtctggaatggtcaatattttcaataaatattaaatgacttggctgaagttttgtttttcttctgcccacctgaggctgaggcagtagaatcaggagtttggtattcagtgacttttgtttttttttaacctcagatctatttcatgatgtctgtcttcccttctagcttgtaagacagttaaaaactcatgaactttttcctgctactggcaccaactaaacattgttcccaaaggtaacattggttgtggctctttaccgtcctccatggtttccattggcatgtcgttccaaggctatgagacttgaacacagcagtactttcaagggtcacactttagcctttgtctcttagagactggaatgacctcctgtatacccctgataaacagtgaggtttgctttctgccctagtgtagatagcccttgccactgacttaaaaagccaagccacacgagacaacactttcccttggaaggagcagtttggttaactgctggctcttggtggcgatttagaaacgacatttttatttctcctccccacccctcctgaacatttcagactgaccagtggttggactcttgccggcgcttaccctgaacctgagtgttaggggagagggaatctgcctctgcggtctctggagctgctcataagcaagagttccctatcctgatcaaggctttaagcctaaaagaaagcagaaataggtacgaaccattggtgtgtgcgtgtatgggtgtgtgcatgcctgcttgcataagtgtgtatatttgtgtgcctgcgtgcacgggccctacatttgtgtgtgatggcccacatttccacatgaccgggtgcttacgtgtgtatgtgtgtatgttctggatgggcgggtgtggcctgggagggggtggcatacctctgaaggtatggggtctgggatagctcaatgtctgcattctcctgctttgcaggagaggggtggaagtggtatttgctttaactacaaacattcttgtttccatctttttttttttttctagaagaaaagaatttggtagtcatctgtccaatttcaggcaacagaagaggtttttatatttgactcttgagtccaaatctaacaaccccagagtgtcactggagtggagagaaatgcagttatgggctaagttaattagccttttggtggttggtttccacttttcaaaagaatatgggtgggaattgagagagagagagagagagagaacacttctagggagggcttggactgtagctcagaagtagcatgtttacctagcatgcctaagaccctgagtttcatttcaaacagcacaaaacaaatccatcaataagataattacttacctgaataaataaaaaaaatactaaaacatgcttttgcaagggtaactgttgggtcagattatctcctagaacagttggaaggcaactggtgataaccatcaccgactaagaaaagccagaggctgagtacgtccatctgctgaggtgcaccttttggatgccctgcagtacaaaagaaagggagttgcagagagcttggaagtggcataatatcgtagagataaagagtagagataaagagcacctggtagatagagtctagaattttcctttggaaacctaagactcaggaggttgagttttacagtgactttgtgtgtgatgtgtgcatccacactgagttctttcagatatttgcaatgaaaagtgcattgtttaacattagtgattacttatagtacttaacgtgattttttttttctcaaaagaatctttcgatgcctgataaattgatccgagtagggtagtgttgagggagatggggtgttacatgtgccttcccattctgtttctcagatgagaaaatggaagtcatgaaaagaagagtactgggtatggctcccctgtgtgccatagtatgactaggacttgaatcatcatttgggcctctattatctatctgtttgagaacatccattgtagttctttagaagaacgtgatggttgtcagtggcgtggtcatcattcttgattccgaagcatggactttgatttttttttcagttttttaaacattgtcagagaaatatttcaaatcaacttgtcctacccaaacatcagcatcaaaccattttcgtgtctatcctttggcctaaggagaagagtgtcagtgccatttgttcaatgccattttctgatcaaatcatggagcatccaaaatgaatactaaaaagttgttttgttttgtttttaaagattatattctggagttctaggcaatctgagaaaaactaagactgaggcagggttcctttatgcctgatgccagctaagctcttctttacccattatttatttaagttcttattttgtattttatttctctggtcacatgctgaaactgcttgataaatgctgtttagggggtagctttgtccacttttctgtttgcacctccaaggccctagggtttgcaatttttaatttaaacagtacagagagatgagccttttgagtgagggcctgagaaaactggcccctctcatcaccctacttgattgacccttgtttgcctactcctttatgaagttaagtcaggattgtttaaatcaaagagagaaaacagttgctgggctaactgttcctctacatatcagtggtaaagacgataatcatggaattcatctatgatttatgaatacagtcctctgttttgtttctgtaatggatccctcaccttcaaagaacacgtgttcttcccccttagaggactgatttatccatcctctggatgttaagcttcctgtttccccttcccaggtcaagggcagcccaagtgcccaatttctctctctcttcacaaagcaccgccagctctagagatgagaagttctgacgatcagccaagtggaggaacgacggtactgcaacggctgcttcaagagcagcttcgctatggcaatcccagtgagaatcgcagtctgcttgccatacaccagcaagccacagggaatagctctccattttccacgggcagtgggaaccaaggccctcagaatgatgtattgagttcccaggatcaccaccagcagcagcttgtggcacaccctgctcgccaagagccccagggtcaggaaatccagtcagaaaacggcgtcatggagaagcagctgtcccctcgaatgcagaataacgaagaactcccaacctatgaagaggccaaggtccagtcccagtacttcaggggccagcagcatgctagtgttggggctgctttctatgtcacaggagtcaccaaccagaagatgagaaccgagggacgcccgtcagtccagcgcctcacgcccgggaagatgcaccaagatgaaggccttcgagatcttaagcaagggcatgtccgatccttgagtgaaagactgatgcagatgtcattggctaccagtggagttaaagcccacccacctgttaccagtgctcctctctccccaccacaacccaatgatctctacaagaatgccaccagttccagtgaattctacaaggcccaagggccacctccaagccaacatagtctgaagggcatggaacaccgaggtcccccgccagaataccctttcaagggcgtgccatcccagtctgtagtgtgcaagtcccaagagccagggcacttctatagtgagcatcgcctgaaccagccagggagaacagaggggcaactgatgaggtatcagcacccccctgagtatggggcagccaggtaagagttccctttctgtcatctcctggcctcatccccaatcagcctttcctactgtctgctgggaatattaagggaaggaatgggcaggtgcttgatacaacaaatggcctagtggctgaagggaagagctttaatttcctactgattcgctctcttgcctcctagacctgtggaaaagggctcaatgcttctcatcttctgagcgagctcttaaggccttccttaaggagcagaagcaagcaaatcttcttggctttgaataagtctgcaacattgtatcactcccatgattccaaagtccccttttgtttgtgtgtaccaatctatctgtttcctgttgcttgtactctctcgggattattggggtgcattttgatactaaacagttggggggatacggttttggtggaagaaggatgctagagggatgtgtgcaggttccgaatgtttcttgccttgaacttcaactttgaatgtttcttgccttgaacttcatgtccaactttgggaaatgtctgagctgcttcttgatttttcttgacagagtttgttaggtagctgcctgccatttgtgtgtgtgtgtgtgtgtgtgtgtgtgtgtgtgtgtgtgtgtgtgttttaaggatctaggttaaattcacgctatctccttagaagttcctccagatgctcaaacggacatggaacgctcttgtttctgttccatgtctttcactcttcctaagtagacttatttcttcatcattcaacacccattgtcccttgcatgacccatcagatcctatcattctttatattatttgtatttttactgtttggtagacttgcaggacatggtgtggggaaagggttaaattcatgacagaaatggcaacggttatgcatggtatcctggcctcttcccaggggtaggtaatgatgggtgaccagaagggttaaagatccaggtggctcgaagtcccaagacagtgatatcactggtatcttcctctttgcctcctgtgtccactcactcatttggggaagaacctcctgacttgcaggtggtggtgactcaggagataaggcacttggggtggggtagggcggaggtaagagaagttacctagagtttcctggtatttctttttctccccccaggtcctgatttttttttgttgtttttatccagaggcaattcattttaagctcctccccttgctttaccggtttaggactgtctgtttttttttttttttttttttttttcccttcttaactcaaggtgatttcttaaccctctgcaaggtcctctgaagcttctagaagatagaagcctaatttttcataattttctcaaaacagggataaaaacaggcccattttcagctttcaactagtgtgagaaccctattcccatgtgcccggtgaaatggaagatcctgggagagcccacagcaacctttgactgcatagcttagtgaaaatccattcaagctaggaaaatgtcaaggaagcccggggctttttttttttgtttgttttgcttttctcatcagtatggaagcatctgagacactgcctctcctccattctggcctatagatgggctgacgtctgatctgctgtctgatcggctgccttgtggaagagtctgttggctatggtgtggagctgaagccaaagccccctgctcagcacatggcccgccttcccaggaaagctattttcagaactcattcactagtattgtttgtgatctgaaatgactcccacagtgtttgaagctagatggaaaagctctttgatctgcctaaataaataatgagacaaagaggggtttttccttcctatactgattaaacaaccaaagaaattaagctgcatacactttataggaagataggtctattttctccttccttctaaattagctgtggatctcactatttcagtgccttgaaactacaaagcccatgctgacctgcctttgtttttgtttttgtcttgtttgtttgtttttggggttggccatggtgctaggcatgtaatctatccagggcctccagcatgctaagcatatgccctctctgaactcctcccaccgccgttgggaagtattttgacacagtgatatttgccaacagttgtttctctatgggacaggaacagtgggattgatattctgaagggataataaagttgtctaagctagtggtgttccatgtgaagtttgggtatacatcagacaaactctgtctctaagcgtttacatgcactgggtcgaggggagtggcacctattgacagatctttggcaaaaggaggcagtccaacagctttccttaagtctactgcttttaggtagatatatattttttcctccttaatttcctatatggcttgtggatatcttcccaagtatctgtagcttacagaaatatggatggagggagggagggagagagagagaaagagaatgagagagatgaacctacattttaaattctaaacccacaaatgacagatcagggaaagtaagttttgctttgttttttattttaacaaactgctgttaaaagaaaatgtcattttcatttgccttcggagagtcaatgaaatgttgagattttgctgttaaaatgaacaaaatgttataaacaatcctttgattacttcatcatccccatgccctcctccctacttaagaaaaaaaaaactaaataaatagcataagtgctcagaactccagatgggaaatgaggccaaaccatgtgaaaaaaaaaataatgtctaaatctttgtctttctaagtgcagaaccttttttgcatcctgggtttagacactgataaagtgcttgtaaaaaattaaattatttctgtttataaagcagccacctcctttcaattgttgaaatcatgcccagctctgtggtttcttgaaatgctctttgaatagaatctcagggtgacctaaatctgtagatcagaacagagctccctgtgcgattggaatggccggacttattcacaagctgctccacgattcacattcgctgtcacagaacctgggaggggcactatttcggtggtgagaagttggctgtaggctggtggtggcacctgctctgatgagagtgtatgttgggaggagggggggagattgcatgtttgtgggtttgcactcgtgttggcaggtgtgtgagagagagaatgacagaagaggagggggaccctagtcatggaggtagcagggtggacaggtctatgttacttgccagtgtgtgtgtgtggccgggggaggtcgttttactttttgtctttttgtctttataagttctctttgagaatatgtcctctcttttcatgcagcttttcggaggagtgatctctggcatagacagccagctcctctctttggtaggccgtgaatattaggaaggagcactgagttggggagaacaggccaagaagcagatcatgtgattctattgtctcctggtggtggcttcttgttcccagatagctatgtcagtggggagggattctagcctctgtgtggtgggagaacctgtagagaacaaggcctttctgccttgttcctctctgcccctttattactttactgtcattactctttcttttattatttactcttcaggttttgtttgtttgtttttgttttttacttttttttttttttttttttttttgagtcagggtttctctgtgtagccctggctgtcctggaactcactttgtagaccaggctggccttgaactcagaaatccgcctgcctctgcctcccgagtgctgggattaaaggcgtgcgccaccacgcccggcttttcagtgtgtttttgtttcccctgacatactgccatagttctccccaacctgtgttcttcttcccagagtcccctgttctcacagggaacctcattccagggttaacatagtcctgccttttgatggtgggcagatgttggagcccaggtgaagctctttctacttcccccaccccctaactacccaagccattgcttgtttgcaaatctgcctgtgaagggctaactgaaggtttttttcaacaccacagtattctgtttccttttgtggcctgaggagtcaagggtcagctgctttgtttttccttatcttcatcctgggcttatctgaccctagagaccttccggaaaccttgcgtgcagtatccttccctagacccctgagaagctgtgcactgtccaggccttgacaagccattcagcactcagggaggagggaggtagatgcctccctgttggagagaaaggccccttttgcttgataacgggagctatcgggaggcgggaggaagtccagtttgaaagtgtgttcaatttgaaaatgtgtgttcagtctttcagagaaaacatctcccagacagtaggtttccaaatcccaagaacaggggcaaaagatagcaaagtgatttctcctcttaaaatttgaaagcaggattggagaatatgaaatttaagaccctttttctgctcaagagattcaaagttccccccctcccaaatcccaggacattttaactctgcattgaaatttaattaaaacagctcttggaaagaacacatagttgtttgacctgtatggaaattgaaggtccacagaatagaaaatgggaacccttcacctagtaagtccataagcccctccctggctttagaacaactgagtgttttcagctcttggaaagaaaagttatgtatggcatcaactctccaggtcctagtctttaatagcttgtcaagtcttctatacgtaagttgtacgcatgacttcttcaatagtaaacaattatttccagtgacgtatgtagaaaattggataaatgtgtgtatgctagagccacatatgggacttcaggatagaccctagggtctaaacaggtttgaatactttcctgagtatcaaggtcattggatgagtccgagagccaatatttgcaatgatttggttgttgtaaagagcctgtgcagggaggagctcttggggatgctggtatatggaagaacagtgtgttagagtgtatggattggtggggagaagtaattgctcctggccctttgtccaacttctctcaagaattttatgcaaactagcacaaagataaacaggtgattccatcttgaagatactaacaaggcaaacatctcactggtagataagcagctgtaattcttatagagtcaaaacatgggaaggtcccagtatttttgcaattcatttgtagccctgcctctctgtgacttactatgtagaccaggttgctcttgacctcttgcctctgctttttcatgagtattaaagccatgcgccactgtgcccagaagaaaatgtaatttaaaaaatagatttatatgtatgggtaatttgcttatatgtatgtatgccttacacatgcatgcctgatgcccaacagaacagagctaacgatctcacggaacatggctgttctgtgggtccaagtaatcaaacctaggtcctctgaaagagtagccacctcttaaccactgaacctccgacttctatattaagtaactgaacaaggttgcccagctagtacacagtgacaaaggtctctgaagttcctttattgggattttagagactttttttgcgtctaacaattaggtaccaaaactcaatggaccaaagtttttgttctgaaccattctataaacaataagttgaggatttgtgtccccaagcttcatatgtattattaatctgctaactcggcatgagcagtaattatttgatatccttaaattcataaatgtcttcatatccttaagtaattcttgagtgtagaaattctccagggtagtcccaggtgggaagatgaaaggcagtggaatgcctgcttgaaaaaagccagtaaacattttttacattgaagtctttgcatgtgatgggttgcatacgtcaagattttttcagacaggttcagttctcagtcaaccacatgagcattactttgtacaaaaggaattttaaacgagtgagcaatgaatgtttggagatagtcatcttaagattctcctacttacctcagaagttcgtctccaagaggagcataaatagctagtgagcagtagcagttggacagagtcacaaaatgtatcggtaagaaggagctctagaagtctttgactgggatcaaattcagcctgcttcccattttacctgtatttgaagggaggaggggttgcttcttattgccttgggggtgaatttaattggagtttgaattttgtgcttttcagggcaacacaggacatctcctcgctgtctttgtcagccaggaactctcaacctcatagccctacttcttccctgacagctggggcttccagcttgcccttgctgcagtctccgccgtccactagattgcctcctggtcaacacctggtctcgaaccaaggtgaccactctgctcacctgtcaaggcatcagcagcatcttctttcgagtcagagtcatcagggggaccactaccgtcacgcccaggccagcctgacttcagcgcagcagcagccaggagaagcctactcagctatgcctcgggctcagcagtctgcttcttatcagcccatgccagctgacccttttgctatggtctctagagctcagcagatggttgagatcctgtctgatgagaatcgcaacttgcggcaggagttggatggatgctatgagaaggtggcgagactgcagaaggtacggctccccctgagggtcagtcagttcaactctttgaatcttactagtggctcttgttaaatgtcggtataaaggtttcattggtggggtagatctttgagattcttcttctgatgttggtcaaactttagaaaaaaaaactgtttgtctatctaggataactaagttttctctctttttattgtcataccttaattatatgaaactgtgggcttcatggtgaattttttattggaattttaaatgaatgagcaatatattatgtactatcatgtgtactcactatggtgtttttgaacccccttttcttttaagagggtaacattttacacttttactaaaagaaatatactattgatttcccagactctgtaatccttacaaaacttagttgaatgttttattcaaaaagtcatcagagatagttcttcacaatatttgtaaggcctgtgttcgtggaaaaacctgaccgcatttaaaggccttttgtcttgattatggtttccccatatgatttttgtctcaagaatataaagccatagtacatagttactagaaaaatcccaccagctgagattttgttggtttatgaaaaggctgactgtgcttttccttgtgggagttctcttcttcattcttttgatactggccctcctccctgcttttgctttggtctttgaccacagatccagttcaacatctgctctcctcctctggggtgtgtgtgtgtgtgtgtgtgtgtgtgtatgtctatgtgtctctgtgtgtgtgtgttgagggggcatacacaaaaggggcttagcatcacagctgggtgacaggtgacgacagccttaggcagaggaaattaaaaaaaaaaaaaaaaggtgtgcccagtttctgtttccccatacccactgctgcagctacttcatagcacccctcagtttcttgccttggtggctcttagcgagtgatgcctgtggcagtttctttgtagcatttgtcagttggggagttcacatggcatgatctccttgcaaactgttcccggaaggtgaggctgaagagacagttgctttgtattgttcagcagctctgtccttcggagacaagaagaaaaggaggtccaggggcctgcatgattgctaaaattcactgacaccaggtcttttacctaaaggagaagagggcttatatttttctatacttacattttatatatacatatataccctttctcattttcctcctcaaatctgattagaaactctcagggtggattaagagctattattttgtcttggttttatagtttctgtcttctcagtttgacaatgcccctcgttcatatcacattcaggctgtccatggatttttttcattgactagaaaccccattcggctgagtagacctcctctaacttttaatttgccttggcctggcctcatctttgacacaatcactcgtgactgagctcagctcttccctgccaaaggatccctggtgacggaccctaggagctgggttggaaagctactagtgcaggtagcagaataggaattttgttgattgtttgttccttgtgcggaaataacgtcagaaaagtacaatcatcatagttggagtgtctgcagaagaatggcataagccaagactgaggtagagacaggtaggggagaagaaggaattaaaagcagggtaaataacatgcacaccagatggtagagctagggggaaaaaatgaaacccacggtaggctctgaggacagaaagtataatgagcaagtctggagacccatggccgctctccctctcttctacctcttccttcacacatgtccagccagctgatctgtccttctgggaaggcttcatcacacagctctctctgcaaggggacagactgtatttcctcagcaccaagatccttcgtaagcaggctgtgcatgtttgagaaaagggactgtcttcttaggtgtggccttctggaatgtaaggaggaagcctcactgtctcttggctgcttctttcacaccaacactgcccagcctgctctttcttgaagagaagtgtttcttctctcctcttcagcagttgaattccattcgaaagctccatcaagcacagaagcttgtctctaaatgccattcaccagttttcaccttctgtgctgttatcttggtaccatctgcaaggagaaaaacactttcacgtctgctcttttcagtggcataagcctcatttgtttgcaggcagtcctgcctccagcaggattttaaagatgggggcagctggaattggaggtgatagaaatcctccctcccctcccccaccttcaattggggcgcctgtgtatttcaccccctaaagcaccctgagctttgttcaggaagagtggaaaactgagaagcaatgcagagcggttggaggagtcagacttaatttcaaaattgcttaataggccatggggtttatttgtcttatacaaattatatgcaaataaggtctgcggttcttacacatgctgtactggtcgcaaggctctggagtctaatttcttgttttcttcctgtttctgtctaattctggacaagagtctttgtctggttctttttttttcttttctttttttcttcttcttctcattttataagatttgcagagaggtgtcataaaataacacaaatcctgactttcagttagaaatctgtactagtttcccactgactctggtgagtatgggctaaagtccaaatgcctgacatttaaaaccattttatgacctgccttcagtccatcttcacagccatatccctctagcttccctgtggctaccacacagtgtccagccagattagactcctggtcattctgggaatgcatttgcttactcagaatagaatacccttctactcacctctgcccattgaaatccaatccagctttcaggatccgactctaaatgccatctctccctgacattattttcctcccctcccccacccagggatctttgctccttcttttagctttatatcattatgccttgttttttttaaagctgtagtttgccctctattctctgacttgattatactgaaagttccttgaaggcaaggataatgtgcatgttctcactctggttaatcagaccttcctaactctttgacccttgattaaatagttgtgaaagtgaattgaattatactgcaggaggctgacgatttgggattttagggctcatgtgtgctgctgatctgtacttgagataagtaatttaactactctcttatgctaaactgggacaagttaacattgcctaggcagatgtcaggacaaaatgagagaaccacatagagagaagtcctttgagggcttcaaaataaagttattgctatataatatacaatgttaatattttcaaaatcaagaaataatgtagaaattacactcagaaaataatttagaaattaaaatcaggtataaagtccattttatggagaaagagagactttgcttttgtcctaaggaaatcccatgaagcatttgagtcattgactgagcttacagtctatctgaaaggagatgcaactgaagagtcacatgtgtggttctaaactgtcatttccatccgactcctagtatcaatatcatctttctttcctttttttatgttaaggtggagacagaaatccaacgggtctcagaggcttatgagaacttggtgaagtcatcttccaaaagagaggctctggagaaagccatgaggaacaagctggagggcgagattagaaggatgcatgacttcaacagagatctgagaggtgagcggcaagtgcacttcactttctagttattttgtttgcttgtttgtttgggggacaaggtctctttacatagttcaggcaggcctaggatttacaacatagtccatgctagcctcatattccacaattcccctgctttcccctcccaggcagtgaggataaaaaagcatgtgccacgacatctgattcttgctttagagtagctcttgtattattttaagatttacatttgaaaatttgggactatgccacccaccctgtttgtcaaaaacaaaacaaaacaaacccaaaaaaaccaaaatcccagtgatgacttttgccaaaggcctgtatttagaaggcagatagcatgtgtgttaaccgtcttcaccttccacagaccgtctagagactgccaacaagcagctggcagagaaggagtacgaggggtccgaggacaccaggaagaccatctcgcagctctttgccaaacgtaagtctgcaatctccagatgcaggcgtgaatgcatgcatggtagtaacaggtgtggaaatgtggcaggtctggttggaggtaaagtttatgaaaatgttgcctgactcttttctttagccttctagaacatccaggagagaatgagtcttatctttttcctgttagtgcatgaaaggccacgaaggcttctgcctcaactctagtcacattgaaggagtgttctccatactaagtcagagaaaatccattagagttcctgccattgtcaaggctagctgaagaaaagaccttagggaatactgtcctcaataatgttgaagggattgtaggctctgggagatgggatgaacataaagaacaatgattaatgtttgaaatccccagcctatgccacgggttcacctactaaacacttattgctgtgtcatattattacccactggcagattgtagaaagaccagaaaaggaagggccttggtatgacctggactcatggttctgattacggagttggagggtatggggctgggcagagctgagccttccttataatagtgcttcctttgtctggaaatactcctaggactgtaacaatgaattaatcctcttctttatcgagtccctaatggactccacccagctagacaatgcctaattctttccaattgctttaataacagcagcaataaaaacttcatagtggttggagcccactgggagcatgaattgggttgagaacagatgaactgtccttgttcctacagatgcttaagcttggctgcccccctaccccagcctccctcagtgcaactcccactgaagtccttcttggtggggacttgtcagtctgttctatttttgctgggtctcccaatgaccctttcatgtcattctgtgcagtttccagttagcttttacaagtctgtttgatcttcatttacaatattcccttccctgcctggattgctctgttgtgctctggcttcggaacagtttttcttcctcttggcccgagcctcctgttcctttgtcagtagccttaagggtaaggaatgttgtttttctggtgtcatcagaacccagggtaaattgtgaagttgcttttgtggtgtcactgttaccctggaagctagttcagtggcaggaagacagtggtggcctcccagaataaaacaaaacatatggattcttgccctggatcttctagcttatactcctctgtgtgaagaaatggtatttcaggtgctctcagagctctgctgtgggttcatgaaattcacttagctactaagcaaaattacattaacaacagggtgaaatactgtcagtggttctaaaactaggtggagaagagagcatgtctttttgacccatttatttcttgtgcccttgggcatacaaagggtcctcagagatgggaagtgtagaaggaagaaagaaggctcttttgaaaaaccttctctgggaatatactccagcaaccccagaaagatagaagcagttcaagccagtaggtgattgggtacactagaaaactttagctccagtatggaatccacccctcattttccaggagctctggcgtgttagtcatgctcgagctccaagtcctgtttcctcgtatgcaaaatagagaaggggagaataacaccccagatccttgttctgaggattaagcaagcacaatgcctgataggtagagagtgttcagcaaatgtccatttcttttcaaggcacatctcttcagataggagtctgtgagaaatgaggccaaatgggccccgtgaagataatgttcaaggtcttcaaaggaagatccaccttcatgtccaagtctaaacactttatttttagtctctggtatgagctttgtcctaggtcacaagacaggtacctggaaaaacctgagacatactgtatatgccattgtcccttgtagctgtactttcatattaaattcaggaacaaaattactattcgtataggtccggtgacacttagctgtcacacttaaaaaaaactaatataaagatatcagtcatatttaattaaaagacatattttgaagctctgtgattctttttcatcattagtcatggtgatgcttatcatactctttggtactttttcgtgttttgctcatttaaatacattacattatctcatagaatccttaagaaatatggattacacaagacagtataatgttccctgtgctttcattacagagtggtttttatcctttcataggatgtccatctttctacttacataactctcctgtccttccattgttggctactttttaaaattaaagacataagcatattattcataggtgtttcacatttaggatctgatcagggtgacttctctggatgtggttctaatgcagaaaaaaaaacgttgtatattttgtcttttagttaaaaaatattttgattgttgttgttgagtagcaggaattatatagtggctaagcatatagtagacaggtatttgaataacacttgtcctgcattgtttttctaagggcaatactccttccggatgtggcataaggtgtggggcaaggtaaatgggatctaacccttagactaccattttagctttagtgagcctgtgcttttggactatgggtcatacaaatgtggctcaatccctactcttgtttactgtaccaggatcagaggggcctagagtcagagtatttcttctccagcttggaacatgttaaaataaacattatcccttctccagacggtttagtatccaaaatatttcaataagtgaggttctggttaaaatttctcctcagggcatgccttgttgagaagaacaagatgctctgggatatgtcataatggtctctttgacctcctgcggcaaatgacacgaggacatttttttctgatctcctgggagaatctggatgaacacctggtggcaaaacttccaaaaatgtgggtgttccagtatgagtgcctctcccaggaattagctcttacatttgtgcatcctgagccaccagtaattaatcaattatatagttcagggtttcctaatcagcttcaggtttccatggtccctgctcatggaattctaatttgctaaattgtgatcccctgtccacctgtctcctactttgaggtcggaagctcttccagtgaactttacttctgagggctctctggagatctctcctcaattgttttttttttttttttatttagttcaactttttaaacctctaatcatacggagtctcaatctttaagttccttccatgctgtattagaagccagaagttccatcattctactttagaagaaaaatgttaagacatggctggtcattgacctaactgcttttcatgctacactacagtagggaaggtaaaggcagggcagaagctagaatcaaggccctctttacatgcagcatcatagacttgaggctcagagctgtgatatttattgaacaagtgctgcatggctgagatgaacaccatttcatcttgctatgtcctctcctggtacacattttgctacagatcttggttgttcagttttctctgaacagagattagggatcacattctctttggattccagttcctgtgtttcagagtctctttcccttgttcatttctaatatcttttatttaccctgcttgacaaagtctccccagtggtttcatctttatgtatgttacactgctttcgaatgtgaccaacaattaggacaatttttagtgactcttccattctaaagacagattatatctatgcaaatgtatatgcacaggaatatacatacacacatgcatagatatatccctacacatcttacatataaatatgtgtatacacatatatgcaaagtacatattttactactataaaagttctaaacattacttacatgaagtggattcctatatttctctgattctaaattttttcccatactctcccctgttagcttgggctttccctagttagtggtcaattcagtggcaaaatccagatgttataaattttgattctcttagccatgtgctaggagtgtgcaaactgtctatcagttttgctaacttaaggctttgactcagcttcaggatgacagtattgatatttcatgtccatacagataaagaaaaccagcgggagaaggagaagctggaagctgagctggctactgcccgttctaccaatgaagaccaaaggcgacacattgaaatccgagaccaggcattgagcaatgcccaggcgaaggtggtgaagctggaagaagaggtaggtgtcctcaggtagcagatgagcctgagagtaaaagagctggggaactcgtagcgctggatttctcatccgtttgattatgcagagattaccccaacagagacagattttggctattcagtttttatctgaacagagataagggattgaatgatctttagattccattttctttgtttcagagtctctttctcctgctcatttctaatacattttatttatcctgcttgacagaaactcttccgtggtggttttctctttatgaatgttgctctgcttctgactgtgaccaacaattagaacaacttcgtagtgactcttccattctaaagacataggttgtatgtatgcaaacatacaaacacatgaatatgcatacatacttcagaatataaaaccattacagtcaaaggcggcaatttccattctcccatttatttcctaaactgataccataagttctccctagtaccttagccttgccttaagcctcttcttagtaagctttaaacatttacttccaaaggactatagaatgactccagatactttgaactactccagtgatcttgcaattggaatggtcctgttctcaccacactggatggaaagtcaagcctgctccttgtcctaagtccgaaatgcatcttgacacccacattttttgctattgcatttgaaaatagtgtttggagatggaagcagtcttcagaggtctgggacagaaataagacccagggagagtttatagtttatgtcaggagaatgcattggtaaagatctttgttgtggcttaagagaccagttttaaagaacgttattatgtggtatggttgtatttttcagctctttgtgtgagtggatggagccatcccttgacaaatacaagggcctctgaactattaagaatatgatttaaatatgtatccgattagcatccatgtagaagttgctctattgcaacactaaactgtcttactatgaaaaggagggcgctttgctgctgtactgctcattaattaatcctggatgttggttgagattgtactaaagtaaaattaactcttcaatgttttgaacatttgggaatgagagtattccaacaaagatgtaatgatgaagtataaattgactaagaaaattaaaaccttgttaaattctattttgaaatttgagttattttaagagaaatactacctttcatggatccgtagtaggaaaccacttgggctacatagcaaaatcaaggccagcccaaagttgtatagtgaaaaccttttggaaaataatagtaataccctccattattttacaagttgaaagccttatggatctaaaataaaattgtcattttctggactaaatgacattgtagctattgtatgagaaatgccttccctgcctccattaattgtctacttcttggccctcactaagaatggccctggtttctggagatctccagacttatagattttctctgctgtactttttgagccttaaagactggttggagttaggttgtgagttaatagtttcttaggagataataccatgtaatccatgatatcctttagtgtgacttatccaagtgttaatgtcaagttgtagaagtcaacataatacttcctcagatctctatcttaagaacatactgttacttcatgatgtgattgactcccccaagaggccttggttattcaagattaaaactgctcagcatagaatattaggattcacaaactgtatcagtttgatatgggatctttaatgtggttctgtcacaaagacagtgcctgtttctatcttatgcatggtttctgtgctgggcatggtggcacatgcttttgatcccaatagttaggagtgagaggcagatggatttctgtgagtccaaggcccagttcagtctacatcttcgaggacagaccgagaccctgtttcagaaaacagaatgagagagtggaagggagagctagagaagatttcttatgcttggtggacgtggctcaaggccaccatgttggaaagcagagagatacaccagaaggctcgccagtgtcctgtgtgaacacacattgtatggttcgtgtccggctttatgaattttccttattgctcagaactttggagggttttttttccaggaagaaaaatagttttcttactgattgagcaaatcagatttataagagctttctcgtaacaggccttttgctgggggaatatttttctcaggtttcttaagtatagggtcactcaggtaattagttttcattgcatcaagatggtggagaattaactgtattgattcaaggacccttgagtgcttttataccgtcacctcttgaaagcaagccctcgtgtgggtgcattccttgacattcatttcatttttctaatccagtgagcctcccctgtgggtctcagcagtctcccttataagcattccacagaagggacacctcaggcaagaactattttcctaaaggcataacttgcaatctctcctaggttaatgcagattcctttatgaaccatagtctcatgacatctgcagagagatttttgctagtgtggggatgaatagattcttttcctcacaagtcatggtgatacagaccttaaaattagactacatcctatgtagcaaagagccacaggaggtaaatgatgccttcctaaccccctgtcccttaccttttgggacacgtgggttttattgaaattgacactaattaaccaagtcaaaagagcactgggtcctaaagcagccacagtattctgacattcatagagagcttcctcccatcccctcaaagttaacctcactggggtgtttccatggaagtctggcatatctttctccaactcaagtcagcccggcttctggccggctgctacattaggagaatacagagttgaagcagtggcttggataattgtttcagggatggtgggaaaaataagacttggcaaacccagtacgggaagatgctgagggcgaactgcttagtgagtgcagtgtgtaggagagtagaaagcaggaggagagaggactagccgaaagaggcagtgagccatatttggagttggaatgaacacgctacagattaaagaagaagctgaagttcagaatcacaatgactggtggtgatttagctgatttagattgttagtcttgttgagatcctcatgtcacactcttgccacctcagccacttctcccaatgtacctaccttgttttatttcatttctcctagcattctccttaaggctaacatttggcaatctttctgtgcccctcactactagatttactaggctcttcatttgtttgttctaaaagatagtttttgctatctcccaggtactacaccagtttcctccttcccagtcacaaagggatatgtctgcataaacatttatatgtttaacactctctaataattttgaactgaggttggtgaagtttaagcttatacaatatctagagtgtgttataagtttgagtggaagtctaagagtgtgaattatgtgtgcactaagagggttgatagaataaggtacatatgcactcaggaatttcctgggatgttctactgatgaactgtcaattcatttgaaaagcatttcctcaaaagatgacttttttttgacattccaagtatttaggtttattgattgaacggggtgagggcagtagattatagtttgggttggggtggagtcctctgatttaatcattatcaccttagataaactaaaagatgatgggagactaagaaagaacatgcattgaaatcccaaccctgccagttatttgctgtataagtttagacaaatttaatttctctgagtcacctatgaaatgaaaacattaacattcagtcaaactctatgaattgccaatattcagccttttgacccacaacatggaaatctcatgcgactcagagtaaaatttaccttagcgaattattatgagggtttggtgaagtcaatatgtggagtttccactacatgggatgctccataaacattagattccctttcttatatgaaaatgtctttcatatagcattcaacagatgatttttgaataaaataatcactgaaggaagccgatttctatgtatgaatatgatgaggtcagtcctatatattctcaccccaccaattactttcttttttttctaaattaccctgggttcttttttttttaaattattagatattttctttatatacattttaaatgctatcctgaaagttccctatacccttcctccgccctgctcccctacccacccactcccgcttcttggccctggcattcccctgtattggggcatataaagtttgcaataccaaggggcctctcttctctatgatggctgactaggccagaaagatgatatttctaatgcccataacagtgcgatttcttcgtagtgattgttggttgttttacccaacatatttaaaaaggagaaattatgttcacacagcaaacagagatggagttgtctctcttcgtgtgctcctttcattcttcttttccttcctcctcctccttctcctcctcttccccctcctcctcctcctcctcctcctccttctcctcctcctcctcctcctcctccttcttcttcttctatcactatggccttttaaattcccaaggtaggagccttgtagatttctttattcccaaggcagcaaattttcagaagtggtgttttactctttaagtcttttaatatctaccagtggaccataaccttctggcagtggacagaggcagcttgctaataccaggctagtgttaacaaattgcttcagtgtgaaccctgacttagagcaggttccctgggtaaaactaaatcagatcagattaaaattactgaaagttcatggggcaacataaaactccttgtatgaaggagtataatagagaaaatatactgtagacatgacattttagaaaggactatgtgtacataatggaaggcaagagataatgcagatatgatgtaggcacactgaccttacttctgcatcagtttcagtgttcttgagaagatgggtgcctgtatatgtcaggattcactccttctacctgcagatctatgcttttaatctctgatttgtactttaacagatagtggttaatgtgtctcagtggtagggcacttgcctaggatgcacatggcctagtttaaaaaaaaaaaaaagaagaacagcaacagacatagtttatatcctctaggaatctttcaagtattagcatctttccacaagtgagaatattaaagtacaggcagattaagcaggacagttagaaagaaatctagggaaaacacacacaccactagccctgttacttatcatcatgtaaatacatgggaaaatgatggattaaggaacttccctgtaaaggcttgagagaaacaattaacttaaggtgctctaaaacggattttatatatagctatctttaaaaaaaaagtcagtttgaaagacacccacagttgttggaaggagggaagagatgccatcacatggtattcatttgtagggatcagattctcctgagtcagaagaggttatgggatctgccaaattcttgggaatgggttcaaattattacagaagtgcagtggaaaagatgattgacttagctcaagaggatttgctctgttctctatcagattactgtcctattattatttctcccatttcttgtgatttttaaagattccttttgtatgtctgcatttgtggggtggggagagagagagagagagagagagagagagagagagagagagagagactagttttcaaagtgcagggctgacaggcctttgaaaatttatcctgaataggaatgatttgatacccttatcatgacttggccaagcaaagtaaatatttaaggactacgggtgaagagacagaaatggaagttgccatagacagatccactggggtaaggaaaagatgactcaaagatgaaggcaaaggcaaaggcaaaggcaaggcaaataatgggttaagaagacaaattgagaacaaagattagaagaaagtaagggaagggaaaaatctttgacaggttttaagaagcagagtttactaagaaaacttaaatggatgggatgatgtctcttcttcactggataaccagagggatttaggttgaaatgatggatttgcatggcttcttctaggaactccttggaatggagtttgattagctactcagaatgactaatctgtggttctgaaatctcattttccagacaaagatgagagccactcttgtgaatttggaaacttttcaagagaaccctcatttccttaaacactgaagacatcacaaaataaataatctaggataaaaagtacacatgttctgtgatctctctctcactcacacacacacacacacacacacacacacacacacacacacacacaaatacacagttcatttctaacctccatagttataaataactatataatattctaggaccttatttaagatcttattttgtttagccctctgagatactgctcattgttacctatgaaaagaggactcctagatttgtgaactatgggagtttaaagactcacagaggtcattgtaaacaatttatctagtttaatgagcttttttaaaacttaaaactttgtgggagaaggaattcctaagcaatgaggagtgcagcaccaaagggtatatgggatccataagtattctgtgtataacaatgatgcatctgatttacaataagataaatgtcaggctagatgtagtggagtagacctgtaatcctagcagtatggaaggaggatcttaggtttgaggtcagcttaggctattttgaaaaatggtgtcttaaacaagatgactgagtggaataaagtgggcagctagttctttattttaagcatcagaaacaagaaggaatgagtacacaaacatatacatgtgcacacgggaacacatgaatgtatatatgtgtgtattaggatgttttatgtagaaccctaaatacataagtaaatacacaatagaggagaagagaggtgattcaaccaatccacagcagtagctccctacaacataccagatctatgaaatacagtttgaagtcttgaaaaccttcaaagattgatgaggtgtcccttatcccataaaatactatgtctgacactgaatagtaaatagttttaattttttgaaggcaacgtagtgttggctgcaactgctgttctcagtcacaatggctggaagaaggcaactgttcacattctgcaggcctgggactgtattggccatttagctttgttgattcatgaacttctcctcctattagctacgcttgtttgttaacaagtggagactctgaggcagagtggagaagttgtcattcatagccaacaagtaatctaagttgaggagcttaagggcatacataactgggaagagagtaaaactaaagcacataaaatctaggagagtaatgaagttagaacacattgaccgtagtacctagaaatatctgcacaatgtggagtgtataacctagaagatggctgagtttgtaagttgcatgcagaaagcctgcatgggcagcatccaaaaattgtcactttccattgtgacatatcttgggggataagcacttcccacgtgcttgtggtatttgtgggttaactataatctctctctctctttctctttttctctttctctttctccttttcttttcttttcttttcttttcttttcttttcttttctttccttttcttttctttccttcctctctctctctctctctctctctctctctctctctctctctctctccttccttccttccttccttccttccttccttccttccttctaaaagctatgccagcaataatggtctttatttttcttggcttgctctgcagaatctgtctcttttttttttttttctgtctcttaacactcgtttttcaacaaactcagaactcaccgatcccacgttgcctttcccattcagagggttggcttagtgactcctctttctcagggtgcttttcatgggctatttaatttcctccttgagaaaggcaggacagagagaaattggcatgaccctggattgcttgcctttcagttttcagagctcactttgctgtattttgccatcaaggcaaagaactgcatgctgtctctgtttaattgcctttaagtataagcgctgtaagcctttgtaattatagttcacattctctgcattaccattgcactgctcccgtagggttttcagcatgattcacaaataaatgcattcagctctaaatagctcacgaacattacaaaaccccaaaggtgaaggaaacagaatgatttcttctttcccagtactgaaagcttaacaaaaaagcgatgctgaaggatcccctacctcagtctcttgtttatcctagtcaggaaggaaagattgaagcttattgagagacaaaatatgatgatttctttgttcattgtataccttaggaaattttcataaatagcaaaacatgtagacacaaattcacctctcttggtttacagtgctagactgattgaggcctgttttgaaaggtaatgccaacaaaatgttgaaacaatgtttttctctagcaatggtcaaaggagatgccaggggtctggtgacaggaaaatgtaaggtatgtttcctgccacctgtagaaagctcagtaattgtgacctggatacaggaagattctgagcaccctttttcttttcgtttgcccaccaggaaggggtggtgctattgaagcagaaatacaaaataactgtggtttagactcattaccatgaagtgcttacctgctttctgcactgagaagatgtgataggtcctattgatgtgaccactagggctttgtggctgtggacaatattggtacaatgagtaacttcttacattgcagctacttactaaagtcactcagggcttaggaattacctacagtcaactacctggatttatatttttttaaatacctgttagcaacactattttaactcttaatctcagtggtggaggtatctctaaccttagtgaccaagggaaagataatgatgggagggccctacttgaggatttttattttagaggctacaagttgatctacttgctttgagaaaagctatacaggtagtgtgggaaacagaatctgttcttttgcaagcaaaatggcaaggctgcctgctgcttttccaaccgtattggatattggagcatgaatgtcttatttaaggctgtccaattgcttccttgatcattgctgctgagccaggatttggcttgcaagataaaagggtacaatgaatgtctatccttcttcccagctatctcaatttttgcttaggtacctggctcatagacttgtgaaggtgaaggattatgtctgactcaatccttctctgatggctattttccagctgaaaaagaagcaagtgtacgtagataaggtggagaagatgcagcaggcccttgtgcagctccaggccgcctgtgagaagcgtgagcagctggagcaccggctccggacacgtttggagagggaactggaatcccttagaatccagcaggtaatgaatgcagtgtgacatcctggggataagcagagatgatagagccctgtcattatcctacccgagtctgtcttcatgaaccagtaaagttcttagggttagttctagaaatattgacgaggggctacttacggaagtataggtgactcagctgcagctgtaaaggtcctcccccaccccctaagcatgggtgatgactcatggctgattcactgaagatctctgctgaacctcctgctgctccaccaatcagaattttgtctctgcagcaattgttactgcttatataatcttgaggagggggagttataaatcttgtgctgagtactttagtcttggaactattgcttacttcattccttcttgaggcttataagttttgtttatttttctgagtcttacttaacccgttatggaaatgagggaaaggaagaaaggaaatgcctctcttcttgggtgtttgtttgtttattattttgtgttcagcaaagactctaaagatacttaaatgcttgctcatctttacatttttccagttccccatgttacagtaaaaggtgtggccaatatacatgcatagtctccctaattccttagttttcttttccagcaaaatctgtcatttatttttcatacgaataagaacaaaaacccctatatgaagggaaacagctattcacctaaagtcattgatgtttttgaattcaagttggtaggatccttgggcagttcttctgtttgcttctgagattgtgtctcatgcagtccagactggcttataactttgtgcaagtgtacaccaccacttccagctggaagtgctctttagaaatcttctggtcatactacttatgggggtttagaggaaaagaaatcaagaccacctccctgccccacaatgttaagcacctcagtaaagatttcataaattatggacagttttggaaccaagttatagatttaaaaaaactcctgaagactttactgtcagccaggtactgaactttttatttcattacatctaatttctgaacaacacagcaatgtggaaatgcaaattctctttccttcttttgaatcagtatggtatccaaactaagagctgaggttaggaatagcttagtgataagcatttcatcagggctcacagcactgttttgtttgagacctggaaataggaagcagtaatagagtgcttgcccaacgtgcataaaactctaggttagtaggtttactatgtaaacaggcagacaaagaaacaaaatagcatgggaaagccctttcttataaaatagaaactcttcttaccagatctggtaggggagtctgtgtcatgagttcaagtctatatagtaaaatcctgtcttagaaaatcagcaatatttgatagatagatggatggatggatagatagatagatagatagatagatagatagatagataagtagctaaatagacaggtagataaatcagtctttgggacttggacactctggtttttctttcactaacttgagggatcttggcatctcccccaatagcgccagggcaactcccagcccactaatgcttcagaatacaatgccgctgcactgatggagctcctccgggagaaggaagagagaattctggccctggaagcagatatgaccaagtgggagcaaaagtatttggaagagaatgtgatgagacactttgctctggatgctgctgcaactgtggctgcacagaggtaagtcactgaaagatatgaatgggaaaaccaggtatgctaactcattcagaaatttcccaatatctagtctctcccccccaccccctttcagttcctcttcatatgttttcctctttccatttataagtggattagatggatttggtgacacatgtttaaggattttaaaaacatggactttctagaatcataattgagtttaccttagaagtgagctgaaacattgcaggtgggcttggctaagtttttggacacatcattccctactagctatagatcttttcagccacatgttcatgctgtttagtctcaggaccaaagtgaaatccccactagagaagtcccactcaaagcaaatgtcactcaggagtagctgctgtcatttgatagttctggctcttcctgggtatgtgccgaatatgagtccatcactgccctttgagaaggtctatatttgaaggctgcattctctgtattcctgaactcatcgcatataactagtctaattctatctggtaccagggagaagaggcaaggggagttttatttatggcttcttgggcaccttctttgcatattataaaaggaattgttagcttttataggaaacaattgctcatagtctttctatgttgcctatgttcataactgttagatgggaaagaaacagctcaggtatcatcaggtgatgggtttggtggtgttgataatggacagtaagtgtagactaaggtattgaaggtggtctagattctactccatttcatatagagtatattggatagaagccaaacaggcttctatccagaaagttattaggtacagcagtgtatttcttgcaaatgtagagtccagtacttgctagatattaggtaataataggtgtatggaaggagtccgtgtttaagatatggattggcacattctaaagatgctcatgattctccaggaagacttctttcatcctctggtccagataaccttatacctttaatagactgaagctgtcttttgcttaatcttgaagtcttcatcagctgaagttttcctggctttgtttcctgagaaaagcatgctcagtaaaagccagggtcataatagtgcccagtgaatctccgtctgtgtccgaagatggtcacaaggcttggagacagatatgaagcagaatttagtgtcatattacctacaggctcccaaagaagtgcagcacttgctcagaggtatttgtgaaagcctgatgctggaaacttgcttatggtgagccggagagatgcagggtaattttgtctgctttgtgcagaagctttgcatgatgtagctcatgtctgtacaaggcatgagaaaatgtctgaaggaggcatcttggtgctggctacagaatggagtccagggcacagtataggaaagctagaaaggtgcttggtataagggcctttatacacagataaaacctccattcctcttctcctgtggaaatcattaagaactgagagttcccttacagatctgtgtccaaaatgtgttgccttaaattcaatttctttgtatccctagatggaatgtgtccatataattactgttttcagcaaaataggcatgtttatcatttgatgtgatagaacacagcctgttcccagtgttcctagcaagtaggaacaccttcttccagaggcaagcatccctgatctggactgttcataacagattgagacaacaggagaaagtgagagatagattatattgaaatgcctgtaacataaatgagttagacttgatggtttcccctgacccttttattaaaggtttatgctctatttccaaagatagtatcatttcactttgctatacagattggtttccttattttccttctctgtgagatgacatgcagaaaacataatttcttaccttataggcttttctatctgtcttgccaatatctcttcacatgctttcttgtctatttgcccaccacaatgtagacatttgacctcgttctgtggtggaaatcacatatatagtggatgttgactgcagatagaaattgctcaaaattatgattaaagaaggaaaataaaaaaaaaatggaaggagcaaaaaaggaaggaagaagaggaggtggaagaaaaagccagtttttttttaataagtgtgtaatttaacactcaaaatagaagtcacattctcctatgaccttgtggcccttaaacttgatgctttccttcctacgcaatgactcatttggttcatgtcataaaattacaaacttctttcctagagtgtcaatataaaaggagtaacattgtgtttacgctctttgttttacttctcctgctcagcgtaattattttgatccctcctagttaatgcatttattaatagcccaggcctttttatttctgtgtaatgtgtcatggaatggatgtatcatagatcatttatccattcacctgatgatggatatttgaattatgtccagtgtgtgacctttgaatataataaaatacaaattttaacataggatttataaaaagtttattttcttgcattagaaggcatggtatgtggtagtctgtttataacctttgtagtgctttgattctaaataaccttttgtcacaggaaagctggtgatacaatggttttaggcagggatagaggactggaagctagaagtgttcaggaatagacagtgagaccgatcagtagtgtgaataggtaagttgtattcaatgaagaggaaacaaagagggggaaggagaaagaataaattgaaagctttttagcttttctatcgaggtagttgaataagtcttatttaaaataagtacttgagctgagtgtggtggcactgacctgttgtctcagtacagaaaagggacagggaggaagagtgtgagttcaaagccagcttaagctatataaaaccctatataaaataaaatacaatagtatgtgacattttatattttttgcccaaaggctactagacaatgtatttttacttttcaaaacacaggcagggctctagtgagaacttaaaacttaatacttatctggtctactctcaggcacggaggtattatatcacctctaggtcaatactaagggcacaatttatcagttcaactgtctcctagctcaatgacggtgagcttgagaccattggctgttcaatgaaggattagttgagacttcttaggcacctggaaacattatcaatagctgcagaatcattccctgcatccagtctctgagttactgtgtctctagagaatctaggtacttaatatgatgaatggaagtccctaaaaaagaagtccttgttcattcccagaagacctgatttggcaatacagattttgagtttgagctcataaatggtgaatttatgcctggagagcaacaaaaagatactacgataacaacccatcaaccatgtaatctattcggttggatttactgaattgggttgttaacagtacttggaatgtttcaggtttgttttgggcaatgcaaatctagaaaaagaggaagtaaagtaaccaagggaatgaggaagattcgtaccatgagtggctgtttgtttcttccttaatgtcctttctcagtttcctgagtttgctttcttctcagtctatattgtcgttacctttttttctaccaggacttccctgtagttagaaaaatgctgtcatagtagtactttcatctttaagattaaacttaaaaatctccaacaacttgttggaccttatcatagggctgttctcaagacaacttcactccaacagctctgtaatctaaagccatcatagcgctttggaaaaatcctctcctcggtttcccatgacaacaaacactattgcatgatttgaattacaagtacagttctcattcattcttttatctccctaatgtttccatggacatggtctccaagtccaatcacatcgaccacctacagcctgttcccatttccctttccactttactggtttgtatttttattattgtctgataggattactgcaatcaccttcctaactggtctgcttgattcaagtgcctctctcctctgatccatccctatatttcagcaaccgataatgctattgtcagagagcttggcacacactctttcattccccacaaaaagctgtagtgattctcagcgcctgttggactaaagtccaaactcattcctgtagtagttaattatttattccttgtgtacttttgcaagtttcttatatctagcgcctaatcgttttcacaggtttcttctctctagcttcccacgatcttccacttttagtaacgtttgtgcaggatgctaccaattagataaaactgaagcatatttgattgattttttttaaagttatttttgatctttagagacagggtctcactctgtgaccttggctgccttgaaacttgctatttagagctggtcttgtacttgttatgatcttcctgcctcagcctcccaagtgctaggactgcaggcctgaatcaccatactagtcaaggtaaagtttaaatggccactgggggttttatttggggagtcatggatggcaatcttaagcacaccagaattgaaattatgctattagagaaaagaagcatagatcatctggggtgagggatattaacagaaacctgtttatttaaggatttgagaggatgagatagcaggttcaggggcatgtggctttgcatgctttctgccgtctgcagccattatctcctgatactcttcaaatgctttactagcctgcttttcaaagtcattggcttcatagccctggtcttcttcaaggaagattgatgttgagggctgttctggcagccctgtaggaattcgctaagtgccccacattttcaggctccattcctgaacagttcccagtgtccatatcaattagctggcagggctctgtgtacccaaactggtcttttatgcaatgaaagtggctgtaggccagcactagtttccccaatgacaaaccgtacgttcaaacccccagtgtctgcagacagcatgcagttttcaagaggcttggctctaaagtgttaaccttcagttttcctaggcactctgtaagagcagaaaccgcctccaggattgcaccaccaaggggatgattgtctcaaacacatactgacttttttggtattctctttctagctatgcacttttcaatattaaaaaagaaaacattgttatatgcctgtattgtgcccagatgtatatgtttttatgtaaataattttaatttacataaaagggaaggagatgtcacttcagttgtcattttgtgtatgaagaagagtaagcataaaagcaggtaactgacattcggaggtcagaaagtttgttagtgacagagtgcttgtggaagctgtgacttgatcctggggctgtctctaggagtagccttcatatcaagtactatgcaagggagttgatccaggagaatggtgaacaagtggattgctctggagaaatatagaatttggagatgtcaaactagtttgaatttgacatatgatgcgagaaactgtatccttcccacgtcttcccaattccaataaacgcttacaactttgcaaatgagctataggcattgggatagcagtggttttttagaggcctaccagacttccctaatcttaaggctaatttaccacctggtcactcccttgttattacatcaccccaaatctatactgtcataatctcaatgccaagagaacatgactctttagcttctagcagatgtatctgggatctggaaggagtggtgtgaagtagggccacctcatccttcttcattcaccctcttgtcctgatttcctgtataacccttgtcattccatgtatgtcttctttaatcataatgtctatctctttctcttggtcctcatctcctttccttgtctttttgtctgtttcctgtattctcctctgcacacatgtttctccttgaattaatggcctgagagaattccaggtggaacacgatgatcccgtgcacagctgagactctagcacggcaacagtcacttgagttggtttaaaacccatgcattctgtgagagcagtggttctgatgcagattagataaagaaccaaatgggaccaagccaaaggccctttctgttagttcatatgctgtaactgactttagttgtttacctgtctctgtctgtagtatgtttctaagccctcatatgtaaatgatactcaactgtcacaaaacctacttgtttccttcaaaaatacctttccattttgtgactgtttgaagaatgaagtcagaagtgtacatattcatgaagttatacttgctgaaagctctttccaataagtctctggccaatcaaacattcctattgagatcaatgttaatttaagaattttcagcagaacctccactgacttaggctgaagaataacatctcgattttgatgcctgctcatcatcggcactgccctttttctcccacagagacacaacagtcattagccactctcctaacaccagctatgacacagccttagaggcccgcatccagaaggaagaggaagaaatcctgatggccaacaagcgttgcttggacatggaaggaaggtaaaatctgaatgtggacctagaagggttgaggagttgatattgagaccagctacatcagtagagaagggcaagtgtgtttattcataagtgaacttgattgtgtagcctgcccccctcctacctcttcacccctgccaaggtttgatgtgataaccttgataatgaacattcttactaaatgcagagttccaggtagagttgctttttcctggattttataattgttttccatttgtattctgctaaatctgagtttttgatgtttcttctctgaagtattctttatagcaataatacttcagttctataatacagacaagttgtcaacaaaacatctggggaatatggtacccaatgtcttttatagactcagtttcatttattattaatgacaaggtcatgccttattagtagaagactccatcttctcagagaatgatttctttcatacatggcctttctgtttgccaatatttaactctgatcttctaaggtgtctgcagaaatttttggatactctcttacatctacttggcagtccagaggatgtgctcatttttcctgcaagccctaacgtactgacccttgcctccaactatgaattaactagcccaacccttaattgaaaggataataggaacgcaaatccacgtaggcagtgagatcagaatagagaaatagcaaacaggtttctgtatgtggtcttttctttgactcctaggattaagaccctccatgcccagattattgaaaaggatgccatgatcaaggtgctgcagcagcgctccagaaaggagccgagtaaaacagagcaactctcatccatgcggccagcaaagtctctgatgtccatttccaatgctggatcaggcctccttgcacactcctctaccttgactggtgcgcccattatggaggagaagcgtgatgacaagagctggaaggggagcctaggtaaggaaaaggaaagcaacagaagcaaaggcacagtgacagacttagaaagtgtcctgactctgttacacacagcaaggaaaagggacaatggtccaggttctagagaggagaatttggagtcccccctctcaatggaattagatttataagcagcacctctgaagtctcagcgtgagaacagtaactgagaccaaagcttaaaaatatgagaatcttgtgtcctttaggggtgggaaagagcctagcttgaattttatctaaaaaaaaaattcttatatttggcttttgccacatgggaactttgttcaaaacccaaatggacttcatctccggcaaatttgaaattctagcatcactgtgttccttcctcccctacggaaagaggacccaaagttctctttaagctaatggagtcaggtggtagcttttgttaacagaatgttcagataggagaacagaatgtactttttttgttcaattcctatccactttatcccctctaattaaagtcttggagtaccatagatactgagacacatttttgatccagatgaaggaaacaaatatatatttcaaatcttttgttgtttttaacagctctcttgatccactgacttgtgcagtatcctttagtcagagtaaatgttctcagatccatggtcgtgtttggaaccgtaggttacacaactaaaagcaccctcattggtacccacaggttctccatagcactgagttattttcatatctgtagttaatgtggggtgttaagattactggtacagaaaagacctctgtcaatttggtcttctgcaatcaccagtggacaaagaagtctaccagataccaaggacacttagaggtttaatgttatgttgcatattggataataaagacaagacggaaccaaaagccactgttagctgggatgcaagataggggatcccagaggttccctagaggcaaaagctatgacgtttcaaagaaaaataccaaatattttcttttcctgagctccgacaagggtacacagttaatcagtagctagataaaaatcacctcccatcctcttgttccttgcttcatcgtaggcgttcttctgggaggagattaccgtgttgagccggtcccatccacaccgtcccctgtgcccccgtctactccccttctctcagctcattcgaagacaggcagtcgcgattgcagcacccaaactgaacgtggaccggaatcgaccaaaaccgcagctgtcactcccatctcggctccaatggctggtccagttgctgctgctgcccctgctgctgccatcaatgcaactgctgccaccaacactgccactgctgccaccaacaccactatcatggtagctgctgctccagttgctgttgctgctgttgctgctccagctgctgctgccgccaccccatctccagcaaacgctgctgctcttgccgctgctgccgctccagctacttctgtctctgcagctacttctgtctctgcagctaattctatctctccagctgctcctgtcgctccagctgctgtagtgcctccagctgctcctgtctctccagctgctgctgttcagattccagctgctgcatctcttactcctgctactgtttctccaactgctgccactgctactgctgctgttgctgcagctactactgctgctatcactgctgctgctgctgctgccactactgctattcaggttgctccagctacttcggctccggttccatctccagcttcgattccggctccagcaacggctcaggcttctgctccgactccgactcaggcatcaactccagctccgactgaacctcctagtccagttccaactccaactccagctttggttcaaactgagggtcctgcaaatccaggtgccagttccggaccacgccgcttgtctacaccaaatctgatgtgcaacccagataagccaggtaatcacaattttccggagcaggtatcttctggttttgttctcaggtgtgcatctattagttgatgcctgaccttttgacatagttaaatattgcatgatccaattggtcagaggagagaaaagaagaggttctaaatctgccttctgtcattcactaaaaagggagtggtcaagagcagaggccatttttcagtaaagtaaatgatgggcatgtctgtagttgcaagtcacgttttaaaaatgagttctgttatggttcgcaacattgatttttgaaaggtactttttactttgtgcctaagtcgtttctaacccctcctttccatttagatgcccctgctttccactccagcactctggaaagaaagacacccattcagatcctggggcaagagcctgatgcagagatggtggaatatctcatctaaacagcacaatcaagagctggcgttatcagcaagagttctttttaataatttttccctttcatttgtttaatctggggtgaagatagggtggggaggtggggatgatttttctaaagggactttttattggactctggtagtacataagtaataccatagaaacgaattccaatctattttggaatacttagggagtacctcaaaaagataggttaagcagaatgtgctctaaagcttactgttgggctttgtacaactcatggactattaaccagtagtgatgtccattgatgttttgaatacgcttcaagttgttttaaatttccctatttgaggtcatttttcattgaagaatacagtatgtgtagaaggcaggttgtaacatggagttccgaagtggaaattcagggagagtttgaggacttgctactttgtcgggtctctacctagacaacagccacagaaagctctgactttgggcttgaggaaagaaagtgttttaggagctatggaagctaaagaaaagttagagaggattggggtgaagaagggtgctggaaccaattttttctcccagttgccagttatcctgccccctcattgatggtatttctctccatttcaatggtgctttggaagtggattcttttggtttcctcctggaggttgatacattcatatatatactgtggaataatttatgcatttggataattaatatattgctttcagatggtaggaaggtaaatgaacagtgatccatgactgcctctctcataggggattagatgttagaggccttgataaaaggctgcatgagatgctgcatgcagacttttgtgatctgggtatagtcatgaccatggctcagtcaccttaaattagtcctggtgactggcatagcctttccccacccataatgcagattcgctggctgctttgccaatatttgtttaccagtagtttgcaagataaggaaacatcgttgttgacaggttgaatgtgttgaatttctggcaaatacttggaaatatttctctttttttttcccaaatctttagcatgtgccttcaaaggcatatgcaactgtcacctccaaggaaatcacataagaaatccaaagtaccaggctgcagtcatgatcaaggttgattgcagcaatctcctcaactacctcttctcattaccagtgactccatcttggaatccctttgggaagcagctaggaatgtatatatgggcgggaccaacatggggccttgccacagagctgcctccaaggacacagaaggtgtcagttgtcacaggtccttgtcctttgtctctgcccttcattgaggcaatagaactacagatagtaccattaagatgagttttcaggggtctagggaagttaagggtgggagggtattaggtaagggagatagacgtttagagatgtgttaagttagaaatcagattgatgcaagtgtatcctgtattatgccatgggctatagtgatggggaggaactttacttagcaatgtagcattaagtttagtgatgaggaatctgagagttggaaaagttcactgactttttcaagatcacacagcacatctctctgttctgccaactacatacccatttggcaaatgattataaaaaagaagactctgttttaaagaaaggacatcttcatagtctagggcgtacctatgttatgaaaatattcttggtgtgaatagattgattaggtgtctgaattcttatcttgtctctgctggagtgccttgtgtgagactggattttttcctcatcccatttaatcattgagctacatgaaatgcacccataaagaaaagtcaacccatctgtttttcactataaaatcgggtgtcttgggtcattttatgtattcctctgtgagtataagagtgctatatttacctgtattcttgtgtagttcctaattaccttccaaaagatttatgtgtgtgtttgtgtgtgtgtgtctgtctgtctgtctgtctgtctgtctgtctgtagatgagggaaggcaattcaacaacttttaactagtatctttttcacatttttaatagcaaagtgatcatccaatgtattggtcctcagttacagagtgaatgacaaatagacaattaaaagtgcaaggaaataaaccccttcagacagtagaagaatcaggcagcaaacaccaggagagctactttctgtccaagcaaatgaatgaaaatcaaagaaacttcatgtcctctcatgatgaaaactcattgatagaatttgggctgactctgggagccattattataatcacatactctaaagtgatagatgaaatgaattcctcactgtggcaaccatcgctttagagtcatgtgtttggggagaaaaggaagtccttgctgaagtatgaactttccagaacctttgtgccctgtcacataagaggcactccttctcttcagttttctgtcccaggaaatttgctagaaggacattgtgtgtctaagacatggaagaagactatattggtatagtctgtatagactccaccatttgagaaaaatttctaccacataccagttaaaaaattcagtatatgggatgaatctcgaattaaccttgccttcacagttgtgtggatgtaacatttcaggccttttcctggacttcccagaagaggagggaatatttcttgtcttaacttttactgtctagttgtctatgaggatcttataattcattttgttatccccaatgtcccatgtccagcaaaatttcatttgagggaactatacttgatacaaaactattaacattgttgaggaagtaatttaacttcctttgaaagtcatgtattgtgactgttgtcttaatgaaggttttaatttcagtgttgcttttgagctgcagggtgacggggcagtagaaacttgaaacatctgccatcatccatggcaggaaacatagcaagatgttctctttttacttttgcactgttgagtgggtctaacaaactgatttcccagctagtttttaaaatgaagaatctaaataatgtggcagcttaaagtatagatgtatgtgctaacttgaataaatgctcatgtctgttagccatacagtctgttatcttacatcctcattcatacatggattatgttacttaagatatgttccttcttacagaaaatattttcaaagggaactattcactgtgggttcattgtcactgatttctgcctgccacaatcttcagaaattcttctctcatgtgccacccattgacagtaggacaagggttggaaatacattttcttctggtggtaagggtgggtgacaagacgttttcaaatccttctggcctcctttgcgatcgatggcatgtgtttaataagatggctagatgggactggcagattgttcaagaagaattacttttggcttaatgtacatggtcttgtagtgattgtgatcctattctgtaatcaagagagttagatcaaataaagttaagcaggttaaatccactttgtgcctatctttcaataaagttagccattttaaaatgc

SEQ ID NO: 690 - DNA, 69477 bp, mus musculus
cctcgccccccctcccaccctcagcctgcgcatgcgtcctaagaaccccctccactcgcggcccaggctccgagtattgtcgggggctattctctctcccaggaacatggcggcgagtcagggaggcggtgggaacagtgggggcggcggctgcagtggaggtggaagtggcggtggcggtggcgcggctggaggaggaggtggtggtggtggaggaggaggtgggggggccggggcgggaggaggtggcggctgtggcgggaccgtggcggtgcccatcccggtaccgactcttttcggtcagccgttccccaatgggccgcagtggcacccggggagcttgcagccgcagcacacggtgaggagcctggaccgggccctggaggaggcggggaactctggcatcctgagcctcagtggcaggaaactcagagagttcccgggcagcggttacgacctgacggacaccacccaagcaggtgacaggctggggggaggggaagcggggcctggaaggaggatggggagtgggtggctgcgtggctgccttggagtctgctggcccggcgcgcagaggcggcgggagtcccggaatcctagcagcctcctgtgactgcaaaggggcaatgcaggcagcgggaaagaggggcgccagtagcccagggatgatggagagctggctgcgatgttaggggcattattgttagagagttgcgtgcatacaggcagaagggacttattgacaccttccttaatgcacttcttgcaactcttggtcttatctttccctacctcaactgtgagtaggtgggaggcagtgagggggagttgagaacagacaatgcagaatatcataatctctacttattccttgaaggcatccatgcctgcacgaatggcatagtcctttttagagtcaggtttgctgtttgtggtcttatggtggatttgtttaatcatcttagggtatttttggcttctttcccctcatgtatgccttatagagtgttttctattttatcttattttatttattcattttcctggcgttgagaggtgatggtggctagattagtatttgttgtagtagcaaattaaatcatcaatcacttaagggtttggttattgggtgaaaggcagtccagatttgaatgatgttagttttaatttttatagcagaaatcaaaagaaatgagcatttttgagaaaaatattccatttcttatggagttgatggttaatggattatcctatactctgtgttcgtctttgttgtggctggtatttttgctgttgttacgaattcgctctccttctaaagctgtgcagcttatttttagctttgtttaggtttgctgaaagtttttttttccttctcatgatctttaattctttatttatgtaccccatatactctgctgaaatgaattatgcaccaaaatattagaagtgatgtagtgattttgaagcaacatagtaagtaaattcatgcgtagtaggaaatagtaaacaaccttatttacaaaccagacaaattgagtgcattcagtttctagacatcaaatcaagatgcatgcactggcagaggatggaagaggaagaaaacctcaaatgaagcttcctagtcaataatcctcttaggcgttagcctcaggaatgcataatcaagacctgattttgtattttggaaagcacatttgaatgtttacacctttaccaagaacagattgtccaaacaactctattcacatactcatggtgaggtactgacaatatatgctccttggtgtgtttttacaaaagcttcaagaaaaatggctccatgatgcattcttataggaattgtttttcttactgtttttttcttttctttttttaacccataaaggttccttcattctacctgtgggacaaagtttaagcatcttagctgtcactgtctggccccaggttaattattgcaaccttatctccacaaatgtttctgccttctgttccaactaggtcagcttgctgcccttcaaatgtgtttgtgtaattttgcctcatattcatgaaggttctcagtatgcaggaggttttctaagaagctggctccataatccatagcagtcttctgtttctttgaattcctcggcacttattgtctttactacttgtttgacatttctgactttattttccctttatgcttgtgccttgttctccctgaggatatggggagcccctttaaaggtatatactcatttagtgttaccattctatattgcttcctcctcctccccctcctacttctcctcctcctcctcctagccccctcctcctcctctttgtatagtgacgtttctcacaaacatgaacatcattttattcagttataaccatttgcttttaagcctttggttggttttctgaggcaaacctcaacacaacccagaaccatatttgttcttggtaagctgttaactccccatatctttttgttggtactggtgctgaagactcaggattttgcacatgctattgaagcattctgtatccatcttaatctttactagggtctacatggtataccttttggtgtgtgtacttgtgcttgtgcccgtgcaaacctgtgctagggtgtgtatgaaaatgtgtaggccaggggtcagcctcaggtgcagtgcgtttgattttctttgagaggtgctctcactgctctgaagttgtcaaggagactaggctgggtggtttgagaacactgaggacccatttctcttcctttctccagctctgggatttaaaaaaaaaaatgtgccaagctttttttcttttgtatgtagatgctggggattaaatttagatactcatgcttacctgactaacaccggctgaggctgagtaaggtgttttcatttgtgtgttttcctcctttaccttttcattctcttcctgcttcctcctttgtgtgtgatactcctgtgtgtaaacattcccttatggatgaaggcacatgggtgctatgggcaatgtgtggtcatcaaaggagtatcttgcatatccgttcttaccttctacctaaagataggagtcttctggactctgagtattcttggctagctgacccatgatcttctagggcttctgctgcctttcttcttatcttcctaaaggagtgctgggattgcaaatacctgagttactgtgcctgtcctttacgtgggttctggggatttgtactccagctgtcattctgttgacaggactttacccattgtcatttccccagctccccttacccacccttttgagacagagtctctgtatttccagctagtattgaatttactttgtatcccaaattggccttgaacttgagataatttgcctgactcagtctcacctaattacaggcataagcaaccatctgatagtacttttcaaaataactctgctttattataagctatgatgcatatatgaaggagaataggcagatttttctctttcttactttgagttatctttgcttaatattatactttctaaacccacccacttgcctcttaatttcacttttatgaatatctgaataacattctagtttgtatgtgtagtacattttcattatctacacatttgtaagtggatgcccgtgttcattccatttcattgttattgtaaatacaggagcgataaatatcgatgtgcaactctacctggtatggagtcctttgaggagtctagctgggttatatggtcggggttcttttgttttattttctgaggaaattccaaactcctctccttacttattgtaatagtatgaattctaccagcagtgagtaaggattacttctccccatcctccccctataaccctgtcctctctaacttttgctgttagatttcttgatggtagccattctgaccagggtatgttgaagtctcaaagtaatttactttgcatttatccagtgactactgatgttaagtactttaaacaatacattccatttgtgtttcttcttctgaaaaatgtctgtagatttaattagcccatttgttaattaacagttttaattcctagcctataatgtgcatgcatgtgtgtgtgtgtgtgtatatatatatatatatatatatgctgttagtatgggtgtagttataacatttagaaagacaatagagagaatacaattagatgatgaggaaggatgggataaaggtaaaatgacatgtgaatcatgaacaggacataatgacactttttctctcctggtttcaactctctctcatagatttgtaaatttttttgtggtatacaagtgaagaaaaatttaattgaaagtaaaagtgtaaagccctaagcaaagctttgtctcttcagaaatgatcattctgactgtatagcagtttgctgagatggacaggcttggggcaaggcaagtgtttgaaccagctgtgtagataaaaaagtgaatgtttttatttgtgagtaattagaacaaagttattttatttaaaaatcaataatgtggttttattttttttaaaaaatcaataaaacagcaaattaaaaaggaaagaaatgccaaagatttaatatttttttttgtctttcaaatgtactttctttgtgagaccatatcaaaatcaggtagagtaaaatagatcttgtggtattatctttttcatttcaatgagatataagtatgtgagttacttgtcatctgttttgaaaagatttatctatgcattatctaggagcaatatttgtgaatacagatatcatgttcattctatgtaaatgaaagaaggcacctcagatttaaaggcaaatgcagcatatgtgaggttatatatgtacatgtacacaaacatatacatccaggtaaataccgtcttctttaagatgacactgcttgatggcattgttacagtgtatgtacaatgactcttggctaatgtttcagaacaaaactgattatttagacaagcatgaggtagtttattggatggaggaaggactcaaagaaatgaaaatagctaagatactattctgctaattaaacagtggttggaacatgagttaaaaatagcagatatgctattctgctaattaagtggttgctggaaaatgagccaaagcaatattgacttaagggaaatcgacaaatttccaaagaagaacgaagggaaggctttctgtgtttttttttttttttaaactctcactcatacatgcataagatgaaatataccagtgtttcctgctctggctagacattacaatcacaagggattttttttttaagcaccaaggccatactccagaccaattaaattagggtctcagtggccaagtttctcaaacaaaatcttcccaggtgaattcaatatacagtcaaggttgtataaatgtaaacactttcagtttgagtgaatgaacgttcaggcagaaatttagtgattaacctaaggttactactcatccagaggttcaaaacccaagctatgaagttttcaagttctagtgcagtgttattgtgtgtctttatactctatgggatgagcttactaggaacctatggttagttttttttttcctttagttttcttggttatcccaaccgtatagctcatcctctttgtaaactttacatactgtcctccaattatgtagccatgaagccttgttgcctctaaaaggcttgctaagatggaacatggcaagaagagctgttggtagagtgtgtctttggtgtctttttccatttttctctgcatttatgtctgtgacttgtggatccctcctgtcagttttcatttctacctctgtctcacttttctcctttactgggatggtgctcaatgctacatgattatgacagtttcttgagagaagattcgcatttaagaggagcttgtacctttcctgagaaatcagctgatggtttgtcctcatgacctttttgagtatatccactttctcaactcttaataataataaacctctcacccaaaatggatataagaagtatccaaaaattgttattgtattttgggaaagacacttattctctttgtaatctctcctttcatgtggcctgcttatagactttgtatgaactttctggataccatgataatttgttgccttaaaatgaatttattgcactgggcagaggtgttgcatacctttactcccagcacttgggaagcagagtcatgcagatatcagagtttgaggttagcctgctctaaaaagtatgttctaggacagccagggcaacacagagaaaccttgttttgcaaaaccataaaccaaccaaccaaaaacaacaacagaaaaaccaagaagaatgtattggttacccaaacatatgttgatcgttttcacagctcgccctcccccttgctacaactgagtggatgtgtttgagcctgcttgcagccagtccctctgatgcactcactgtacagtaacttttctgtccacgagcagatgtctgtaaaatagatttaggaattcttttgccagattgtgctgtgtcccgcataatcacatgttttcctgtaaaccaggaattgactctaggatttcctacatatgttggctcacctcttcaactgtaggatatggtacattgtattcaattgtaaaatggagccagataaaaacatctgacctagtctcatagttaaaggtcttgctagtgcactcactggaacaagtttgtgatgtttgtctttgacctgaatcaagtatctgcctttctttatggagtgtcttcctaaaaatggaatgtgaaacacatttttcagagttgactcatattttaataactgtagattatatctgatttgctaaaccttgaatggatttactctagaacaaattctatagtgatcccttaatgtcttttactttttctgcaagtttgcaaagttaaataaaattttagcttgaattggaaggtgtagtcattgttaaactaattcaatttgtacttcttcatatataatgtatacattctattttatcctattaaatatgctttgacattgtttgctattggtagaatacatagtacttcttgtgtttgctgtggagtatatagcaaagtattggttaggaatagcacagtgaagtatccactgggaatgttttttccttattatagaactattaatagaaatttatagaagttacttcttgtgaaagtgcatacttactcaactttatggctatcatacattttccatgtcatgccatgttttatttactcacatagccttttatgcctttatgtttgaaaactttagaataaaataattactattagaagtttaactttggagacatgttcaattgtccagaaagaaaggaacctagcatgtatatagatgtacatctgtaatactatccatctgaaggctaagagagtaatgtattattattatttcttctattttgggtgattataatataattacatctctcccttccttattccccttccaaatcctcttatacttacaactccctactctcttttaaattgatggcctcccttttcactgtattattattgtatgaatatatataaacacacacattcctaaatataacctgtttagtccatgtaatgttgcatgtatgtgtgggtatctgtgtgtggtatgtgtatgtgtgagtgaagggcagactatggatccatctttctatcccctaggcagtaataccttgaacttaaggctaaattaaagtatataaggcataaggaaacaatgtcaaaccaaaaaaaaaaaatccagaaagattggtatctcagtattagaatccttgcctagcatgcataaaggaagccctgtgtttgattctggtgtaaataaccaaagataggctacatatttgaagtacagcataaatacacacagaaatggatagttaggataccctgtacttggatgggaagtgttgcttaaagtttaaatttttatgtttcaatttagattagttataattagttagggttctctagaggaataaaactgatgggatagatgaatatgtctatatgggttatatataatattatatagatattataactataactaactatatgattattaccatatatatgtatctatctatctgtctatatatctatatctttctatctatctatctctatgtgtgtctatctatctattaatctatctatatatctgagtgtattgcaggctgtgtgtggtccagctagtctaacagtggctgtctactaacagaaactccaagaatccagtaattttttagtccatgagctggatatctcagctgatcttcagtatatgccagaatcccaggaagtgggttctaatgccagtgaaggaaagaacttgccagtgacagtgagagcaagcagacaaagagcaaacactttcttcttctatgtccttcctatagactgctaccagaaggtgtggcccagatttaatgtggattttctcccctcaaaagatccagatgtagtttgggtcttcccacatcaaataattcaatcaagaaaactttctcaaaaatatactcagccactcatattttagttcatcccagatgtagtcaagtaaataaacatcacacttgggatagtttatatggcattagaaataggtgatcaagatcactgacaatgaaagtaatgttaggtatacctttcataagaactaagtattgaagagttatagcatactgactttctggggcatagtattcaaactctagtaaattcattgaaaatggacattctctctgctcaacccagtagctcactctgaatgatacttaaactgggtgaagataaacctcatgccttggggattcattatcaccatggcacaggagatgaaatcttggccttgggatgtaagtcagttgaaacaatggctgcttagcattcagaaagccctaggttcattcctcagcataacacaaaccagttattgtagtgcatgcttataaccccatcattcagagaggaaacatgagggtctgaatatcaaacctcgaactggcttgatagtgaattggaggccaacctctgttactggagaaccagtctcaaaatggaaacaaacaagcaaagcagtacaagcagtgccactaagagagtcaaattataactgtttctctttttccccatgcttggatatgttcagatagttgatgaagcattgtaatactcttgtagaatcagttttttgaaaattttagagacttctctacatgtcctttataggacaaaaatccacaccttacactccagagcaccatttaatgtatttaaagaaaatggtatggggtaattttataacaagtcaactttaagtgtcaatttctgcttttgcattcagtctagtaaaggtcaaactttaactaatgctggtttgggggtactgtagattgaactcagagctttgtacccttgttttgtttttaccttaatcccaaacactaagtctttgtttaatctgtttcaaagagatttaaatttgtagaatttcacttacctaaaaccagtgtatggattctactagataacaattccatattttctaatgttatttgaggtcatgtgaaagaaaagttttgatatgagagttttaatatttttttttacctaaacaagatttacagactgagcaggttgtagttaggtgtgtgtgtgagtgtgtgtactaaaaacaaacaaacaaaaacccagatgaatctcagaaacttaatattgggtcagaaaatataaaagtttctacagttaaagaaaacatagtattaattgggtttcactttttaaagctttgagacaaagaataagagattggaactctgaaagttttgttaagacagctgactggcttgaatgtgctttagcaaccactgacaatcatagttacacaatgcaaagcacagtcgaacaaggactgcaaacagtaacaatttgggggtggtgctgataacaacatttagtaatcagagatgagggatgctgccaagcatctttcagtgaaaagaacaatccccacaatgaagaaaaaaatgaaatttttttttctttcccaaagcatcaatggtaactatcatttttgaaccttaactttgaagaaggttgagtgttgtaagtgaaaacagtgtgcattgcttgattagaggttgggatagcatttgattgcactataggcacatcacagggagctttagaaagaatactttgtctccatatttgctcccctgagtattttgttcctctttctaagaaggacaaagcacccaaaatttggtcttctttcttcttgagcttcatgtggtctgtaaattatatcttggatagtctgagcttttgggctaatatccacttatcagtgagtgcatgccatattcgttcttttataattgagttacgtcactcaggatggtaggagacaaaatgaagagcagagactgaaggaaaggctacaagatactgtcccacctggggattcatcccatatacagtcaccaaaccctgacactattgtggatgctaagaagtacttgctgaaaggagcctaatatagcagtctcttgagaggccctgtcagagcctgacaaatacagagtcagatgctagcagccaccattgcgctgagtgtggggtccccaatggaggagttagaggaagaactgaaggacctgtgggggattataattccataggaagaacaacaatattaaccaaccagacccctcagagctcccagggactaagccatcaacaaaggagtacacatggctccagctgcatatgtagcagaggatagccttgtcaggcatcagtggaaggagaggtccttggtcctataaaggcttgatagatgccccagtataggggaatctagggcagggaggcaaaagtttgtgggtgggtagaggaacactctcatagaagcagggggttctgagggggatgggatagggggtttccgggagcagggaaactgggtaagggggataccacttgcaatgtaaataaagaaaaattaaaaaaaaatgaaaagaatgcgttggcttagaaagaggatcacatagaaccttactgaatatggacatctcaatattgtctcaaacccagcttatcagatgacaagctcttgttgctgactcttgactctcttgtcactcagatcaggaatgtggggcttgttccagcttcttcttttttctctcagcttctccatcagttagaaattggtgcctgttcaccagaggcttttgaataactttccttcctgtctgtcctcactgccaccgttattctggttcctctcctccttgccttgaactggacctgtcaatagtttctcacagtttctcatctgtcatcttggcttcaacgtcattttattttctccacacttgttcaactgtgctttgcattgtgcaactatgattgtcagtggttgctaaaacacattcaagccagtaagctgtgtcttaacaaaacatttcagagtcccattttcttattctttgtctcaaagcttaaaaaaaaattatactttgttttccttaactagtaactttaatattttccttaattacgtttccgagattcatctggttttttgtttggttttggtgtgaagtgcaattcattcttttgggtcactacactataccacactctgacttttgagctatccccattctcctgcagacaatcgacctgtaaacattaagcatatctcttacatatatggaaatctttctcttttgtatactttgaaatggaattgctaggttgttgatcaatcttcaaattgttttacagtttatattttcatggaaatctcgtgcgcacatgcgtgtgtgtgtgtgtgtgtgtgtgtgtgtgtgtgtgtgtgtgtatgtgtatgtgtgtgtgtgcttcctgtacacagactagatcaggcttggattatgtgtcatgttggatgagatgtctcctgatgctcctccatagacatttctacaagtgtttatgaacacgagtcccctatatttaaatattttctaatttcaaacagtatttttggaagtcttttctaaacttttattgatcttttgtgaatttcacatcatgtactcaatcccacccatcttcccatccattcatatccacccttgcaaccttcccccaaatgaaaacaaaacacacaaataaaaacctcctcactgtggaagctgcagtatgtcagtatcatggggtactgcatgctaaacccttttgctcagatagctttacttgcaaatgctcactgcaaggagtcattggtctggtttgaggcctctgtatgctatgctagagtactatagtctcaccaggactcctctcgcatatcctgatttgccctctgtcatggagattctgcagccttggatctctaggaccagctccttcaggcactgcaacagtccatagatgaggtggatgttggggtggacaacgttaggtgtgggtggtagcccaccagctctcttgcacgcacaccaccagagtcagctttacattattgcctcattagcatacccaaggggcggggccaactctcctgctctcctgctctgctctgctgtcctgctctcctgctcttggggctggctcaccctagcctctgccaccaggataagctctattgtgctgtcttaatggtgcagggttctctaccctgagtgccatagccagcggggtgtgggactggctgtcttgctctcatgactttgtggccagctctcctatctgctgcaggttactggggcgagagggtaaggcatggcatctctcttgagcccagatcacctcatgacagaagagggttcatgttctcagggaagcccacacccccgcaccctgtcgcccacacccttgtcccctctattgtgctgcccaggtgagatgtgtgtgtatgggcggggcactctccagagtactgtagctggtgaaggacagggctatctctccccagtgccacaaccagtaaggggtggggccagccctgtactgtccttggacaccaacatggtcccaggcagcagccctcacaagggatatcacgattatgtttggtggtaacacgggccatggttatagacacagacctttgctgctgcatttccaccagcccaggcatgaaccctagtgtcaggatgggctgggacttcaccattgcctcaggtagcagtgctggctgctaacatcaggctgttcctcacaacttcgagtttccagtcccacctctttttattgtgctcaaaccattctgcttgtctttctctctcatctctccaccacatgcttgcatatttagtagcgcccttggtgagcaggccaagcagtgcacagcatcacactgagaacatcataaatgcatatgatatgttttgatctaatccttattcccccattccctcccgttgaagttgccttttatatctccttaccacctttatctcccaacttcatgtactttgtttgttttaatccagaatcagtttagtgctgtctgtatacacttgggtataggaccatctactggagcatgggtgacctctcagagtttgaatcgctgaagaaaactcacactgatttctgaattatggtgcctttcatttctgtttcatacctagttgtcctgaatataaattatggtacaatatttagtagatatagtgagaaagggcctttcttgtctgagtttggaagggtaacatttttagtattttctcaatagatatgacgttaactttggtatttgagcatagcatttattaggtatctcattgagggtttccagtgccatgaaaagacaccatgaccaaggcaactcttataaaagaaagcatttaattagggctgtcttacaatttcagaggttcagtcccttgtagtctcatgcagggaagatggcggcttgcaggcagacatggtgctggagaagttgagagttctacatgtagatctgcaggcagcaggaagagagatatactcgggctcttgaaatctcaaaggccacaccaaatgacacgcttcttccaacaagactgaacctactccacaaaggccgtttgccctaattcttctaagtagttccactccttgataacttaagcattctcgtatatgagcctatggggcccattcttattcaaccccccacatcaggttgaagaaattcctttctataactagttttatagtattttgatttttaaaaggcattagattttgtaaaatgctttttctgtgcaataagttaatcatatttttgttctttattgcattcatatgggatactacacagatttattttattaaggaactcatcttgttttactgaactcccatgcttttatttagtctcagagttcgaaactatggtttgcttttcaaaagtatccaaccacccatctttgcatgtttcttggtctgtagttactccctgtcaggcattctgccttttggtaagcctcctttcttttcgtccttcacctgcagcagtgataacttcagaccccttttgtagtagctgtgatattttattgcaattcctagctttcctccattgcaccatttaataactatcatctttggaggcagggtcttgtcctataactcagtctgatctagtacccacggcgtagtccaagttggccttaaacttccagtgcttctgctttgtgagtgctagaatcaaggatgttctaccacactgagctctatataatttgttcctttgatttgatcttctcccatacaatacatcctgagcgttgtctttcctccctccacaattaccagtgccccactcccattgctccctctgtttgccttcagaaaagagcaggcctcccagtgatatcaacctaacatgacataagatgccataagagtgggcacaaaccctcatgtcaaggcccagtaagaggaaaggggtcttaaagcataggtaaaagagtcagagacatcctcgctcccacaaacctcccaagctaaccaagcacagcatgtatgctgaggacataggacaggcccactcaggctatgtaattgctgcttcagtctctgtgagcccctatgagccatagttgattgtgtaagtcattttctcctcgtgtcctcttgctgctacactgctttccacagagttccctgagctttacacaatgtttggtagtatgtttctgtacctgcttctgtcagctgctggaggaatccattctgatggtgactgggctaggcactaatttatgagtatagcacagtatccctgggaatcatttcactgacttttttgttgttgttgttgttagttatgtttggttctactttctttgaaccttcacaattctggatcctgaccatctagacagtgttaggcataggctccttcttgtggcttgggcctccatttagacagtcattggttggccatgcccataaattctgagccacaattgccccagtatatcttgcaggcaagacagaggtcctgatggttttgtggctaggttgatgttgcaatcccatcactgggagccttgcctggctgtagaagatggccagtttcaggctcagtatcctccattgctaggagtcctccctggggtcaccctcaaagattccaggaaaatactatatatatatattttaaactgaaaaagacaaactaacaggaagatttctctggagatagcaaagtccttgccatggaaacatggggacctgagtttggatccccagggctcatgtaaacctagctggggtctactgcaaatctgcagttctgaaattcttaggtgagatgggagacagagacaagagaattcccaagagcttgtaggtctgatactctgtggtaagccacagggactacaagtgatcgagtctcaaaagtgtgccataatacctgtgattgtcctgtgacctgctcacacatgcattgtgacaaatgtgtgcctgaactcacatggaaatacacacacacacacacacacacacacactaaaaaaaaaaaaaaaaacagaaataaaaacagaaaaaaagtgctagaaagaaaaaacatgtattattgctccataagcataaataacaaattttaagagtttagagatgtgttattgtttttaaatgttctatttttggtttttacattttcctatattgcacaatggaatgtttttaaaaaaggaattagtttattgaaaatatttaggttaattattcagtataattgatttaagttatatattagagatggatcttcactgcactcatggcaaggtggggcagtaatacaaggcaaaacagacaattagagcacattaaccaactattttaaattgtctaactcctttaaaaaaattccattgtccaatataaaaatatgtaaaaaccaaaaataaaacatataaataaacaacttatttccgaactgttaaaatattttgtcatatttttattattcatgatatttcattaaatagtaaagatggcactgaaaatagtaaagtgtaatgtagtaggaggccggctggcggcctacatgaaccgggtatttctggaaggcaggctggggctgaaagagagactagatggcgagaaaagaaagaagccaagacaattttttctttgatcaaggcccgagagtttactaagagattgtgcttataagggggaaggcccatctcccccacccccagtccattcttggtgcctggagccagcctgtaaggcaaagtgcaggataggatgtgtctctggaatgtctcaagggtctctcagcaggtagcagagtctcagtgaagagcagcggttgacataacaatatagccatctaggtgggaaggctacaccccaagtgatctcatattcagtggcagcaaagtctgaatcagcctgcttcaaggctgggggaggctacagtgtaagaaattcaaccttttgtttgtttgtttgtttgttttgttttgagtcaaggtcttatggtacagcctggactgcctcgaaactcattctttggcacaagctatcttcaaatgcacagcaattcttctgcttcagcctcccaaatgcgaggattataattatgagccactaagactgtctaggtcacagacttagtgttcaaagtcataattgcattgacatgaggaccaggaaaacctgagacaagtgagcacttgtgatttattttagaattatttcctgttttcttgtagcatgccgtgctctgcttttctcttcctgctttggccagacgccccttcttgctgttgagtgcagttcagatccatagtctccaagctacagttatcatctgcaggcagagtgagagtagaggtgctcccgaataacaggtctgtgtgttcatggcttcttcttttcctgcttcatcaaaacctaatgactgaggtttactcacctttctttatataattctgctgtcatgaatttcatgtttcctttgttctataaatataggaatcaaggcaacggggaagattccttcatattggtagccctgagttacagaggtttatatcctggtcttttaaagactacctgtctcatttaggtctaagcacagagaactagaggcttatggctaaaaagtgtcaaagctcaacatttattgctctagattttggatgcataggcttattgcccaggttgtagaggctcaaaaccagtggctaaagttatagattatgagtatgggtatctgaaattttggaacttcattactcagtagcttgttcaaactcttctagcaaccagagctttcagttcttgaagttcagctcctgtctttgactctccacagtttcttatcttccctatgctcaacttttctgcctctgcttcttggccattccttactttctcagtacttccatcattcttagagtattgcaagtttagcctttggtttctctctggaactcttcaactgtcgcctagtactacatctctgaactttaaagcatccagcttagagagctttgcctatgataaggaccatttatggaaagcacccagcattttttaggatcttaactgaggtttgaatggggtatatcataagaaaagccttgggcatggccccacaagattgaataactgcttgcttatatagctagggaatggatgtggtgtacgtgtggttcaactgtaattatgtaagccacagcatggtttcccagacccagttcctaagctcacataaagaccgatcagaagccttatataggaagtaatgagaagctctttgatgattcattggctaggcagccatggtaggttctgagtgagaataacatcagtgtgagcagggtcatctagagtgtaaccagattgtcctgtgcagagtctgttttcaatcattcagatgacttcccactcctataagcttttggccttttgaatgaactaagtaacagataattgactgagttgggccccagctgaggtgcctctgcagtccttttcgcctagaaaatttaggagggagatggtgctatggagtgatggttggtgggaaagactacaaaagaattggttgtcttatattggagctggatattaacacaagaaaagaaggacgatcttaagcaggggctttcccaaataagtttaggctgttttagaatccatggagaagaaatagtgagttgttgataatattggctgtcaggattagtttagatgaaagtaaaacgtttttgagatacaggtggcagtggagtgttgaataaaacattgttaatgtctaaaatagttaaatgttttatgaataatattattgaagagagtgtgtgggttggtgataggattaggacaacagaaaggtcacaaataaccctaagatcttaagaacgacctggccttgagacagggacaatgggaattttatacagaaattcagttggggctaaagaaagtaacatttaggaatttgtagtaatgtgttaagagtgttctcaaggctttgaaacttatatggggaattggataagtctttaaagttgatgaaaatggaagtaatatgtgagactctgcctgagtttgacgtgttccaagtagacaggaacagctgactagttatgaaatggaagatattggagagcagaaactatggatggtcttggtgaacttctgttgtttagggaaccatgtttgaggttagatagagtgcagatgtagtttggtccccagtttgtatataacatgtttttaactaataaatcaaggaagtccaaattaggaaggcatgactaaagtactgttctccaagaaaacaggacgaaagaggaatggccattggttggaaaatgccattgacttcaactatcaagatagaaaccagaatgacacaccttgaaaaatcatggtctgcatctaagataaaatgatacccttctttggatagtgaacactaactacactgggcttaggcaatccagtaatctaagatagggtttgttttgaccctggcttattttagtcagtctactgcaggaagcccaaaagatccttccttgtagaaacatcacccaccttgagccttaggttagaaggttagactttggttgagctgagacactctcttcgtgtgtgtgtgtgtgtgtgtgtgtgtgtgtgtgtgtgtgttagaaagagagagagagacagagacagagaatgttgttcttcctgtgtctgacctgtttacacgtttttctagatagattaggtgggagcctcttttgggaggcaaatttgatttcagtggccagcagactgtacctaaaacagaaactaagggacacctctcaaaggcccaactagtagtgaggcaaggggctgacaggcttgtcttttcatctgggatcttaaggacttaatcttttcctttctctctcatgagcttgctgattgttaaatctccaaaagactgtctgagatttcattattattattattgtctccagtaacatagtagcctagctctatgaagcttacattattaacatatattgttgctttagcacaaatgtgatattactcttttgtagtgacacatgttgcaattatatatatacatatatatataatgattattaagaacttattattattattattattatgttattaagaactcaaattcttttgtaacttgtgaaagaattgtagaacttggctcttaatttgctttctgtttgagaaagaacataaagacacacaagtgtggacaatgcctttgcctccaagtacttagaacagcaggcagttccgaactcagtagcctgaaagcagtggccagagtgggtatggagctaggagggtggaatggtcttgagtgaggggtcataaggggtttagaattaaaatgcagtggatatatctggtcagcatactcattgtaagagtgcgagtaggagttgaagggggaagggagatgaattgaggagaaagaaggggcatgcatgcaagtagggcacttactaacgtaagtgagcaagtttgaagaagtcctgaataagagaacacaaggccaatttctgcccaagtgatagcatacatggaattggaataagacactgtgattaagagaacaattttcaggccagacttcctaggcatcaaggttgaataaaggtcatgttatactacaagagaacacttaaggtcctagattcttggagactccagaatagcatacccagtctttgagagtctgtgtaaggggctacaaagattccttctaagaacataaagacagtgtccctggtggtaattaattcactgaaagattgggcaaaactagtgctaggacttttgctaaatgagaaacaaaagggaattgcctgtctgagatagtatgaaatattttctttcttgcctaaagtgtctgagttattaccccatcatttattctcaatacttatgaatgtctatttatgaatctcttcattaactgttgactactgcatatacaagcttctctgaccaatattgagagtagcactaatttaatgatagaaacatagatattttgatggcaacttcatacagtgtccattcagctaaacaacagtagtaagttcccctctagagcctatgacatttgccatctgtgggctattgaacaggtctacagtaccaggtatggattcccctcttgtgaattgggcctcaaatccaatcagaaagcaattggtcacccaataacaaacttgttgtcattttacaagtgaatatattttgcttgatatgttggtattatagcttgcagggcttacagctgattaagaccattagtgacttttccttccctcacagcctgcatagaaccttctagtactgtgaaatctaactcacaagtagggaagttccggcttagatctagcctcatttctctatgttctgcaaacaaagtatatagtatcttcagcaatagggtctcaccatgtagttatgataggttaccaaagagcaattggaacagtttgtgttgttttttgggagaaggaacaacttttggatcctccttgtccaacagctcttaagggggcatcccatacctgaaacttgtttattatttaataaatattatttaataacttatgacttctggtacctcagtttaaattatttaaaatttgtttcaatatgttatatgaatgctgaccattgataatattttaatttgtgatataatcaatggaggtgtgctatttttattaatgtgcattaattattgctttttaatatacccatacttttcttcagatgagtctaagccaggaaaccatttgttagtgatttatttcttcatgtgatactttgaaaatccttccccattctaaaattgcacagtgcttttcatgttcatcttctcttttcatgtttattttactttagaagttatatggtttgcctttaaaaataaaaagttaagtcaacagtcacttcataaataacacgacactggttcaaaatgccaaattcacagtctgtacaatttacatgggttgaagggtagtgccattcttaaacatcactttgatgttggtgccattactctgattcattaggcattaattcttggtgaaactgaagaatgttgctgaaattcttagagacggctctgcatgtagcccctctcccgacttttattaaagccttggccttccatgtgacttaactgatgcatgactcacagtcttttcctcatagagcacggatgtaatctgcccctctggttaacagctgtggtttcttcttgcagcatctgcctttgttggcacccttgcttttcagcatgcctgtggcagcacgagtcttccatcactgttaattgttgaaaagtgaaatctagatgcttcatattgattctactaaatgttggctttacagcaacttttctgcattttcatcaaatatctacaagctactcctttccctccactatactatagttcacactttatttaatcatgaaataccttagaagttctctatctcatgcatcctggtgaatcaacaaggcttagactatataaactgtttgttatttcctcgtgaatggcagcccgacacccttctagagaatactgaatgaagaaatcacttgtctttggagatggcatgtgctggaaaacagataccagagccatggggttgtcatttcccatcaggctccagcatcagaatctctaattcttcaaagacatcaatagacagctgtgctgcctcctgttttctcattgggtgttgtttctagttctgaccattctttttgatggaaaaatagataaggaagtattaaaatgtgagagcatattaaccagatttattcaacacaacttgaattgagtaatggcagtttctgaaaagttgtaaaaatgtgtttttaattttcatgttagaaaataaaacaacttgttcatttttatgtactctccaataggataattttgttatatatatatagtccatgtcataaaaacaaacataatggtctaacttatattatttttgcttattatctatacaaaccttatttttcatttattgtgcacaaattgatgaattatcttttattactattatttatatcttgtgagattttaggttgttagagaatatctactcatttttagcaaactaataatgatggattaaatgatgttggaagtctcttacaaaatcagaagtttgttctgatgtagtctactgttttcttttaagttgtttacagttctgtgacatttaaattatacattcagaaactttaccctaagaatgatggcatatgggacagtttgaagacctttataaaagttacaattttagttgaaataagtgaagatgattcttttatatttcttcagtcactgaaattgtactaatgttagcttatctaataccatctgatgctagagttgtacatgaattggtattgcctgtagttcatgtctgagcttcccttaacatgtacttcttcacccctacataatatttaatgaattcaattaaatgaatgacagcaagtctattaaagattctacctgaaaaataggaaaataagttttggaaggtgattatcacaatcttcttatgtggctacataggatttgagacttaacaatagctagataccaatttgcacaactgtggttatgctctgaccattttttcccttgatactggggatggaacccagaggctcatgcctgccagacaatcattctgctcttgacctacattcccagtttataagctgtaacttctaagccttgctggactgtggaaaggcaaggagctgaaggggtctgcaaccctataggtggaacaacaatatgaactaaccagtaccccagagctcttgactctagctgcatatgtatcaaaagatggcctagtcggccatcactgcaaagagaggcccattggtatagcaaactttatatgccccagtacagaggaacaccagggccaagaagtgggagtgggtgggtaagggagcagggtggggcggggggagggtatagggaactttcggaatagcatttgaaatttgaaatgtatataaagaaaaagttgtcaactagaaacagtgctcaaaagagggtcaaagatgtttttaatgagcatatatataattcgcaacaggccatggtagtttaagacattatatctaaacaaaggaggatgtttaaaacatttatgatgatataactttaggaatcattttaattactgtatcactttcataatgttaatgatctttctcacctagcaagaactaagctttcaaataatgcagagggtacatgatgtgtgatatattaaaaaaaacttcctgtccaaaaaaaaaaaaaaaaaaaaaaaaagaaaaagaaaagaaaagagaaaaaaaaaactatttggagacagttctcaataggcttttatgtttccatatctctttgttgtgaagcactgttttgtgtgtcagattctcttttcaaggatgtttgtatggtgagcagccttgcaagatgagcataactgcttccttcaatagcaaagatcagacgggcttgcatccttggaagaattctgttgtgtctctagggcaatgtgctaccacactgtccagtaaaataagaatacattccttaagacacagggaaggcatgcttactgctctaaatgatgtgggtattctcttatcacattcctcttataataagatgtaccacaatatgcacacctacattggctcagtaggattttaaagacaagtggaacaaatatcagtattttcttcatttcccgttgctggctgtgagttctaaagtctttcatttttcatacaggagcctcatgccttattctagcttccatacatagctttacaagtagttatgtacttacaagtagcataacatttcagactctttgtagtcccttcaataaactcagtggttctgtgtattgtgttatatgcctttagaataaattggtttacttagttttctttaatccttatttaatgaattgattaagaatattgaaacgctaataaaggcccattcattttaggagctaacaaggctgtatcttatctcagagcaaacaattgtgtattgataaaattaggaacagctgagggattatcatactgttgattactttctgggcctgactttgggacgtaagtaatactactgttcagtttcctgttataggaataagtctttgtgtatatgtttagaagagttactgtttctctgaccttgatttgtggttggaatcagaatacttgaaatgtgagacaggaggtcctattagtgggaggagaggaaaattacatagagatcattggctttgaagttgatttgagttcaaaagcccagtgctgtcattttttttttcctgtattggacatgtcattcaatctgtctttgcttcatatgtataataaggaatggtagctactgcatagaattagcataaggattagagataatctatgacaagtgcatggattctggtgtaatttatggtgtgtgtgtgtctcagtcttactgatatgaattttgaattctgactttaagtaatttatacattaatctatgtattaatcttatgttcctttaggcagaaaattctttccttcgttcttcctcctgcctacctttctgtctgtctcatgccattgtgttgtttgggttttactctaaatcatatgagctgaagatctatgattatatgatgctatctgatgatgatgaagatatgttccaacaatttatataaatattagacattttactagagagaaacatggtctgggcttcatatactagtaaggtactgtggtagtctgtaccactggatagcagtagactaaaaattactcatttctcttattttacagtttggtagtttgtatacttccactaaaaatatcagactataagtagcacaattagtgtgataatttctgaaaatctttttctgtactttggcaaaactactgctgatggaccaggcaatacgttgggcagcagatggacccatctgtgatgcttatggttgcagcttggaagatggctaacagacttccattccatctgacttcctcctcctttctccaattttcttggtctttgaagctaacagttatacaggacgccttttcgattagattatttcagaggctcgattagcatctctaaaaggctgtcagcgttttgtaaagagtgtcttgtaggaaggcaggaaacagtaaactgcaatctgtctgctgacttacagccagtaatggttgatatggcttatgtttagaaacgagacaaaggaaaagctgggtacttgttataatgtgataatgcctaaggatattaattaaatgaagtgtcaccttgaagcacaagaaaaaacacatagctatgcgttttttattatatgtgctgccaaataccacagtacgtagctattaaaatttttaaaggctttttacccaataattatagtaaatgattaatgtgagatctgtttgtttcctgtggtttctataaaaattatcataaacttagtggttcactgtagtagaacctgagtctgctatagtttggagatcaaaagtctgaagtgagttttatgagatgaaaatcaaggtttcagcgaggccctctaggaggctggaggggacattccatgtcttgttttctaactttaggtggcttctgaaactatctgtacatattactccaatggtggcttctctctttatgtggttttctcttcagtgtatctgtctagtttccttctgtctttccccttttccatttctgtgagaagtagtgtcaatatgtagttcagactgtctcaaatgtgtaccattggtctctgcttgctctgcctttttccttacaaagacatttaatctgcctttttccttacaaagacatttaatcaagtatagggcccacctagatgatctaagatatgtcattgtggcaagatttttaattatatttgcaaaatacttgccttttaaggtaatgcaggttctggtaattagacttgattaggtgtgaggactaccattcagtccacaatagaaagatgatttttaatgatgaaatgatgaacatctttatacttgtcgtttcccaagtccttactgctcccttaggaggtaccttttgaaactgttttaaatgaatctcaacaaggaatatatattaacagtttatattcttggttttgatgaaaaatttatttttctgtttatgtatttctatttttactggaactatgctgaaacaccaactttatggatatttcttgaaaatcatatgtgcattattgtgttattctagttccctgagtataaatgatgattaaatattttttactgttctgagactcttttattaggtaaataacccaagataaaattttaaaatcagtttagttttatgtatttcatctctgtaagtcagtctttactactttcaaggtaaccatgacatgttgttaagtgtgaaatagttcagagaattaagacctagattattttgtgttatttctgtgtttccttagtggtttagtattgttttggcagtgttcttttctcacccagtgcttagaaaggatgtttatactaatttacaatagaaaacacactagactagatttccttaattagggcctatgccatagttagggctttaatattatttccttatgctttgtaataatttcattcagttagagtaatcctgtaattttaactgtcttttagtaacaggaattcattcagataataatttatgaatataaatataattaaaatccagagaggcttatactattactttgtaatttaatatcttttgaaagaaaacaaacaaaatacatcatttaaaatgctattaaaatacgtaaaataatgtgttgctatcatttaaattattttttgtgtgacatattcattttttcatgatttaatccttttttacagttcaatcttcatccccctcctagtctgacccccctactgctccccatgctatacctccttccccaagcccaatccccctacgcacccctgtctctaagaggatgtccccaagcccaaccccaccccaccagacctccccactccctggggcctcaagggttaggtgcatcttctctcactgaagctagtcctctaccgtgtttggggcttcatatcagttggcgtatgctgcctggttggtggctcagtgtccgagagacactgggtgggtgtcctcagagtttcgggggtccaggttaattgagactgctggtcttcttacagggttgccctcctcagatagtccttgggaagaccaacatttggtattcaagtggggaaaaagagttaaagaaaccaagaggtgattgagattagtagacattcagaaaggtactcttctaggtcaaggaatgaaaatgtttccagataggtggagaggttaggtgtggttgaaaaatccatagtaaatttagttgtatagtggatttgtataaatctggccatgaaggaagaagaaagagactgaaagtaatgaggactcaggggatggttagggatgcgtttttattgttactatatatctaggtgtttacttgttactcaaacattgtttttattttttcagatctttccagaaatcgttttacagaaattccttcagatgtgtggctatttgcaccacttgaaacattaaacctatatcataattgcatcaaaaccattcctgaagccattaagaatttgcagatgttaacataccttaacatcaggtaagcaagcatacttttaaaaataaatcttgaaggtgctgaaaatttagctcagtagttaagaaaacagccttcttgtttcagaggaacagagtgtggtttccagaacccatatgttgacttataactatctttaagaccagtttcggggatccaatgattcctgacctcatcaggcatcaagaatacacatgatacacatacgtgaatgcagggaaatactcatatcatcatcaacaacaaaaataataataaagcaaatatgatgcattttattatatttaataacataaatattacatactagattagctataatacaaaatatatttttctatattaaaatagtatatattatatagtagtataatatgtaatatactaaaatatgtcatgtaaatataatttattattgtattattgtttaataagtaattaaaacaattttttaaatattacaatgctttatcgtgtttagtagtagaggaatgtattctgtttatgcttacattatcttgttggcttttgggattgttctttaaggcaatgtttgtcaaagtttcacacacaggaattgtctggggatcttgttaaaagattctgtcctgttagacctgctgtaggaactgcattttcgaaaaggtcccttgctgattcctctgccagcatgtgtgtttgtaattagatctcactttgagaagaggctttagaatataaatatttttttattatttgctgtccactcatctgaattgacttatataacactctggttagagtatagtgaaaaacgttttaggtgaagttttattactggtgatgttgccaattcaagaataggtagattgggatgggatagttggaaaatgagaggacagagcacctttatgattaatatgttttgtctttcagtgatggggatcaaccctgggtgttgtgggctaggcaagcattttgccaatgaatgacatttctagtcaactcatgcttaatttgtatttactgcatgccaggcaatatcccaagtatttgactcatattacttcatttaatactccaacatcattattgatatgtcttatattatacctataatacaaatgaggaaactgtgttgtttgaaaaagccatatattcatacagttgttctttggtgtctgtgggacaatgacattcaccccaaatactaatgtcaatcaatattcagtttccttacataaaatggcagagtgtatgaaggattatgagtgggacctaggacattacacatttcagaagtccttcgagattactaagtaaagatcattatccttcccttttgttacacacacacacacacacacacacacacacacacacacacaaaggacctctattttaaagccagtctagtatttctagatatactttgccaacataagatgtggtaaagggtcttttcttccctcctcattctttcttgaataacatgtagcttttattaatatatatcttatataaaacatgaggtacaggtctcttaatggcaattagaaaaataggggaaaaagtaaaattattgcttgtcagtgcctgctagtatataattggaatgttgtcttctctatattttgattgtgaggtacattgggtcaattgtctgaatttgatttttgactatagcacattaagggtaaagatacctgtgccagatagatctggtttcaaccatgactctcctgcttatcaactgtataacctgagaatgttttacttaccctctttgtagtatatttttcttttcaaaatgggactcatgatgagtgtcttcctaaagtagattgttgtgatagacagttgcgttatttcataagagctattctgaacatttactggcacatagtaagtattcaataaaatgttgttagccaagtggtggtggcagtagcacatgcctttaatcccagcactcagaaagcagagggagccagatctttggaaagcctgtctagacaatgtgtgtgtgtgtgtgtgtgtgtgtgtgtgtgtgtgtgtgtgtgtgtgtgtgtatgagtgcagtacatgtagagagtagaagatggtgtctgataccctggaaccggagttacaggagatggtaaattgacccccactaggtgctggaaactggatttggggatgcgtcaagagcagtcccacctgaaactgttggcccatctctccactttccaagctatcagtcttttaaaagataacttctttcttcatttcaagtacattttcctgggagccttaccatggttagggttatggaggcactaagtctgctaaaatttgtgctccagaagaaggttctggcattctctaatttgtgtttgaatcctttctataaactaggcaagttacttagtgcacttttgccttcagttttcattcttgtgacttgaagctaatattccctatttttttgagttaatgagcagattagacagagtgtgaaaagaatttgcatgctcttgttttaaaggaagtactcaataaatgtcactgaaagcttatgatttactactaagttgctttgtatttttttagataacattgagactcagacacatttttcataatgacactttattcttctttttttttttaaagtcgaaatcttctatcaacattgccaaaatacttatttgaccttccccttaaagttttggttgtcagcaataataaactcgtatccattcccgaagaaattggaaaattaaaagatttgatggagttggtgagttaaatattgttttaaattataacacacacacacatacacacatatatgtatatcacatataatatgtacctttttcttttggaattgtatgcattcttttgtggaatttcactgtaagttttttttttttaaggcataacttggtatatgtctaaattcaataggatagcaatctcagctacatttatttaggtctgattttagctcccagccaacaataacagaaacaaaagttcagtgattcctcagtctaagagactttaggaggcttggttatgttttcagacatatgtttcaagtgaatcactatttgttcattcactttgtggacagagaaggtcttaagcgatttccccctaaggtttacagagctgatgaggaggcttagagaagagtggtaaaggtagagaatacagctgtgggtatggtgctgcatgtatggagtctcggctcctagctactccagggaaagacagcatgatcatttgagcttatgcatttacacatcaagtcgggcaacctactgagtccccatttcatgaaaacaaacaaagggacaaataattggttctttttttattaggtattttcttcatttacatttccagtgctatcccaaaagtcccgataccctcccaccccactccccaacccacccactcccacttcttggccctggcgttcccctatactgaggcatataaagtttgtacgaccaatgggcctctctattcactgatggccgactaggccatcttctgatacatatgcagctagagacacgagctctggggggtactggttagttcatattgttgttccacctatagggttgcagatcccttcagctccttgggtactttctctagctcctccattgggggccctgtgatccatccaatagctgactatgagcatccacttctgtgtttgctaggtcccggcatagtctcacaagagacagctatatctgagtcctttcagcaaaatcttgctagtgtatgcaatggtgtcagcgtttggaggctgattatgggttggatccctggatatggcagtctctagatggtccgtcctttcatttcagctccaaactttgtctctgtaactccttccatgggtgttttgttcccaattctaagaaggggcaaagtatccacactttggtcttcattcttcttgagtttcataaattgtatcttatatcttgggtattctaagtatctgggctaatattcacttatcagtgactacatatcatgtgagcttttttgtgattaggttacctcactcaggatgatgccctccaggtccatccatttgcctaggaatttcataaattcattatttttaatagctgagtagtattccattgtgtaaatgcaccacattttctgtatccattcctcttttgagggacatctgggttctttccagcttctggctattataaataaggctgctatgaacatagtggagcatgtgtccttcttaccggttgggacatcttctggatatatgcccaggagaggtattgcgggatcctccggtagtactatgtccaattttctgaggaaccgccagactgatttccagagtggttgtacaagcttgcaatcccaccaacaatggaggagtgttcctctttctccacatcctcaccagcatctgctgtcacctgaatttttgatcttagccattctgactggtgtgaggtggaatctcagggttgttttgatttgcacttccctgatgattaaggatggtgaacattttttcaggtgcttctcagccattcggtattcctcaagtgagaattctttgttaagctctgcaccccacttttaacggggttatttgattttttggagtccaccttcttgagttctttatatctattggatattagtcccctatctgatttaggataggtaaagatcctttctcaatctgttggtggcctttttgtcttattgatggtgtcttttgccttacagaagctttgcaattttatgaggtcccatttgtcgattctcgatcttacagcacaaggcattgctgttctattcaggaatttttcccctgtgcccatatctatgaggttttcccccactttctcctctataagtttcagtgtctctggttttatgtggagttccttgatccacttagatttgaccttagtacaaggagataggaatggatcaattcgcattcttctacatgataaacgccagttgtgccagcaccatttgttgaaaatgctgtcttttttccactggatgattttagctcccttgtcaaagatcaagtgaccaaataattggttcttcaaaagcaaagaatatgatgcttacaaacaggagtagtagtgcattgttgcactgtgattggctgactccattttaattattttatgtatgtatgtatatatatgtatatctatgtatatatatatatatatacatgtatatgtatatatatatgtgtgtgtgtgtgtgtgtatttaaagaagcttctacagttgtagatttccacatgatttgtccccagaaggtatttagatgaatgccctttcaatcagggttacatttgtataaccttgagagactgcagactctggtcattttgagtagctttgagtgggatttggattactcagatccttgcttggaactttcatattcatatctcttttggaaaaaggaatttatttaaattttccttgactctggtgtctggttctctagctcacatctctgaatccttgactttttgaggtttttatcctcgtaaatagtctaaaactataataattgacagactactttagttggttgatagttatctatagtattttatcttaccttgaacatttggcttattgtaatttttgtggtgaaatttgctctttaattgagagttttacccttgtacttactaaatttaatctcagatactcacagaacaatttttattgacagtggtatattaagttatgatctaatacaaataaaaacccatcagagaggaaattagaagtaactttcttagcaatttggccatgtgctcaaagtttaaaattgaaagtatgtttgtatttctcaattttgatacactttattttcttgttttccttaggatgttagctgcaatgagattcaggtccttcctcaacaaatgggaaaattacattcacttaaagagctaaatataagaagaaataatcttcatgttttgccagatggtaagacagacagtcaccattttcactcacccgagtgatagaggaaccatacaacctttaacttttttttttcatttctgaacagaattaggagatctccccttggtcaagttggacttctcctgtaataaagtgactgagattcctgtttgctataggaaactgcatcatttacaagtaataattttggataacaatccattgcaagtaccaccggcacaggtttgtaacaagtgcatggttcttatttttctcagatgtttatggtttcatctgtgtattaaattttaaagtagtatcttatgactcaattttgtcttgtataaagcattacctagactttctataagaactgaaattttacatcttgttttgtttttgctttaagacaacatctcgtgtatacgtaggctggtctcaaagtttctcaatggtggatgaggatgacttttgatcctcctgctcctacctgtcagtgatggacttggaagcctgtgccaccatgccctgctagatgggactttttatttcaatttggtagtaattatagtgtagattacagataagcagttggaaaagctagaatcagcctttttgtgaatttgtagttctgattgtaaatattattttaagaagaaagattctgactgaatacattcaagtatacatttgcttgatatttgttgttggagtgatattataatgggtactgagatgtgggttggaatttgagttactctaggaaaattccatgctgggtgttaagatgaggttcctgctagaccaagattactttgcctgaggtaagacatctctcataaagaagactagtcacatatagcttccagcatattcttgtaactgagatagaattcatacagatagaaaaaatacaaatggaaaacattaaatttggattttaaaataataattattaaagccacaaggaatcccctaaaataataaagaataactaagatatatacccggaagggcaaagagaattcatgagaagcagacagcagaatgttgagaatgtaaaataggtgaaatggtggtaacttgtgcccccactcagaaggcagacgtttgcctgaggagcacaattcctacccgctccaagcttgggtctgtggtgtatgaagaagcatttgttggcttgtttgttttaatctttcaataatctcctcctcctcttcttcctcctcctcttcctcctcctcctcctccttctacagatttctttaatacaacatattgtgattatggttcttcacttaactctttccagtccttctcatctctccacccactgcaatctacattttcttgctctcattaaaaaacaaagaggcatctaaaataataaaacaagttaaaataaaaattaaaaatctggatagggccaatcaaaaaacccagataaacaaagaataaaagaaaaagcataagaaatatacgtaaatgtagagacatatatattaacacacagagaaatcacctaaaattacaaaatcagaaaccacaatatataagtaaaggactctacaataagaaaagaaaatgaaaaaaaaatatcctagacaaagaattatgaaacaaaaaccctccaaaaatactattaagtttattttgtgttggtgtctactgctagacatagagtctggccttcacagtggtttgtgtatccagtgagactatattagagaaactaagttttcatctgtgagtagttatcagttggagataacttttgggttagggatggggccttgtgtgtacagatctggaactttgcttggctcagaaacatgtgggtcctgtgtatactaacgcaatctctgtgaattcatatatgcattggtcccagtgtgcttagaaggccttatttccttagtgtccctcatcctgtctggctcttacaatctttccacctcctctcccacaaggttcctgtagttgtggctttctttaatcatccacatcaactgcaaaaaaaacctccaaaaacataaaaactctgaaaggaggcatgagagctcaacttatttgaatataaggatacatatttataatgttgctagaatctatactggtttaggatattggaagtagtagcttctcttttatattccatgtactcttccttttttaaaaaatatttatttattttatgtatacgagtacatactgttgctgtacagatatagttgtgagccttcatctggttgatgggaattgtatttaggacctctgctcattcaggccaaccccactctttccggttggctccacttgctcagtccctgctcacactggcccaaagatttatttattataaataagtacactgtagctgtcttcagacacaccagaagagggcatcagatctcattactggtgattgtgagccaccatgtggttgctgggatttgaactcaggaccatcagaagagcaagtcagtgctcttacccactgagccatctcaccagcccccatgccctcctcctttgtcatgaataattggctgtgtttatagtgccaagcaataactcccttctattaagtgaagtgactggtttttttttaacccctctaacgacataggttatctaacaaagcctagtttcaggcatgagagacttcctttcaagtttttggttggggacaccaaaaggaccccccccccaaaaacaatatatgctgtgtccagtgcccttagtgccttccagaaaaaaaggtaagattccattgctgaagacatcacatacatcatacactgggtttggaggaatccatctgaaattgaactggaagcatcagtgagaacttgcaatcatagtttcaggaggaaccatacatgcaagctgtcaatagatgaaaacaacagcttacccagatgtaacatcaatgaaccattacattgatcgacatggcaaggtattcttaaaggtgccacaatggcacgaatatcttggggtactaacactaacagttgataaatggacttgatgaaataaacagttttccgcgcaacaaaggacaccatcacttgtgtaaagagccagcatatagaatggggaaaaaaatcttcataagatttacctctgtgaaaaggtcagcctctagaatattaaaaacaaacaaaaaaacaaacaacccccccaaacaaacaaacaaacccttaaacaagaacctgaacatcatggaaacaaatgaacagttaaagttggagcatgacagtaaacacttaagtttcagaagaagagatacaaatacccaagaaatactttaagaatgttcactatcgtcaactatcagggaaattaaaattaggttgatatttcatcctacttacgttagaatggctattaaaacaaatcaaaacaaaacaaatcccccaaaaccctcaaaatcaagtgagcacaagtgcttgcaaggatgtgcatgaaggaaatgcatagaaacttagtgagagtacaaaatgatgcaaactctatggaaattggtgtctcaattcctcaaaaagctagaaatagatctgccacacaactcagccatatcactcctgggcatattcccaaaggattctatacccttcaacacagacacttggcctcccatgttcactggataaagaaagcagcctagatgtccatcaactgaagaatggataatgaaagcatgtcacatgtactcagtgaaagttctcttataaagaacaaggaaattctcagataaatggttggagctggaaataattatccctgctgaggtagtccagacacaaagaattgctttgtgtttcctctcacatgtggatgacactttagaagtgtatgttctaattggagtacccgtagaagtcaggaagccagtaaggactactaagggactagtaagaagccataggaagacagtttcaaggagtcctgaatagaagacaggtgggaggagacaggaagaaaaatcatggactaagtgttaaatgaagggggcagtggaagggcaggaggctggctcttctccattgtgtattgttagcttctttgtaaaaaaaataaatacataaaataaaatctggctttgtatatctgcatctgtattggtcaggctctggcagagcctcacaaggaacagccatactgggctccaatcagtaagcactttctggatcagcaatagtgtctgggtttggtatctgcagatggctacatccctaggtggggcagtctctggatggcttttccttcaggctctgctccactcttagtacctgcatttcctttcgatgggaggaattctgggttaatatttttgagagcagggaccccagtggggaagttagggcaagcatgtagaggctgaaggggtttgcagccccataggaggaacaacaatatgaaccaaccggaacccccagaactcccagggattaaacaaccaaccaaagaaaacacatagtgggactcatggctccagttgcatatgtagcacaggatggccttgttggacatcagtaggaggagtggcccttggtcctgagaaggcttgatgacccaggatagaggagcacaaggcctctgaggcaggaatgggtgggtgggtgggagagcaccctcctagagacagggggaggaagaagggggtaggaggcttgtggaggggaaactgggaaggaggataacatttgaaatgtaaataaaataatcaataaaaatgtgaaaaaaatctggtagctataggaaggtgggtttgtatgcatcatctatcaacatgtctgtttctatacaagtataatgctgattcattactattattcaataatataaattgaaatcagggatcatgattcttccagcactgttttcaatgttaagaattgtttttgctgtcctagctcctttttaatttgctatacttactttataatagtgcttagtctctctgtttttaacctctgcgtcctatttcaccatctcccttctccttccccttctccttgccctctctctgtgtgtgtttatttgtaagtgtgggtgtgcacatgccatagtagaaatgtagtggtcagaggacaatctcatgtgctcaggtgttggaccttatttttcacttgtttgaagaaggatttcttgttttctctctgcatatgtgagactaactcactgccagttttaggagtttcctctctccacattctgtcttgtcttaagagtgttaggattacagtgggggggggggtgctatatttttgttgttgttgttttataatgtggatttaaggaatcaaacataggtcatcatgcttttgtggcaagcacttgtgagtcatatctttagccagcaaaccttctttgtagatttcctctcttaacattggttttttgtatgagcaacagacatattttctccgagcattttcctagttgaactttattccaactgcattgctattatgatttttatttgtttattgtttttatttgtttctttgttcgtttttgagacagggtatctttgtgtagccctggatgtcctagaacttgctctgtactgagtgtttgaaataaaggcctatgccatcactgcctagcactttattttttaaatttgatttattacctacttatgccgtctttattagtctttctcacattttatatcatgcttttggtttggatgagattatatatgtatattttccctgttctcactagtccagtgaatagtatgtttttaatttttctaataaagacattgtggtatagatcttttagtgttcagtagtttgttcattttacttttaataagaaaatgtgagtgaaatatagaaatatgggctagagatgtagatcatcagttaagaacaatttctgctctttcagagaccccagattcagtttccagcacatgaagaaaaaaaaaaaaacactccagttccagcatctcccacaccctcttatggcttccatggtcatcagctatgcatgtggtacatttacatacatgcaggcaaacatgcatatacataaagtaaaaataaatacatttttataaaaggaaattgtttattttaaaaacaatatacacagagatcgcacaggtctaagccagataggacctgtggcgagaggatccagatacaagccccatcctaactcaggagctactttcaactgacaaccacttgcaaaggagaatttactttttatctatggattttcactgggtatgcaaaccacagtagatggccaaaataaaatgaactcaactgtatttttgaaagcttatttttaaattgtctcatgatttgtctgagctattttttaactcttatagaatttttgtttatatattgtggtttccaattttggttttattggttttatgagaatgaagcatgcatgtcagcatctttatgtgttttttgtccattttctttgtttttttctatttagtttataatcttttgtaataataataaatacataaataaatgataaataaaaagagtgtgggtttggaagtggagaggatcttggttgaattagggaaaaacatgatcagaatgtattgtttaaaaagatctattttcaattagaagaaaagaaaaactgactgcattagtaactaataaaaattaacatagaatactttttgataagatgatagcagattttgttacagtattgtcacattttcctgtcttgctccacacacttaattcatgaaaattctggttgtgataccttagcataatttgagattatttcaatatataaatcacttgatagtgtcccattttatttgcaattatggaacagagagatcgctcagcagttaagtgcacttcctctttatgaagagtacccgactttgtttcccagtacacatataggggctcataaccatctatacctaattccaggcatcctatgtcctcttctgcactctgtcatatggcgtgcacatggtgtacattcttaccggcaaagcattcagacacataaaaataaatatttgaatttaaatttgttactaaatactttacttttttgtttgcttacagatatgcttaaagggtaaagtacacatatttaagtacttaaatatacaagcttgttgtagaatggataagaaaccagactccctggatctcccatcactgaataaaagaatgccttctcagcctcttacagacaggtaacataactagtcttacagcttcagacaatgattgtgcttgttgttataaaagaaatttatcattcatgaggatactgaatatatttagcctgattaaatcagtgtttaaaaaagtcattgaattttttttcatttaataacctctgtgatgctgaacaaaatgtgagatttttctttaggtagttattattttagtacaaaatgtaaatattttacagtataagttccagcatttacagtataagtaacagcatcctctctgtgacagctgttaacctaattttgatcaccatattaataatacttgtaatggctagttggattagtctgtaaaccgactttgagagaagaggatgttattttggaggtgcctttcacccttatgctaatgatcttttctttttccaatgttgaattttcaatctaaacaagtgctctatcgctgaaccacaaccccagccgtgtgtgtgtgtgtgtgtgtgtgtgtgtgtgtgtgtgtgtgtgtgtgtgagagagagagagagagagagagagagagagagagagagagagagagagaatatgttttctttttctggagtactgggagttcagtccagagcgtgttttatactagacaagtgccctaacattcagctatacctctttatcttctggtcaaaaatgatatattattggcctttgattgtgctttaatctttaggacattttaatatggtagataaattgttcttttaagatgtagattggtctgaaaacctttttcaaaaatacaattccatccagaaatatggaaaataacatggagtgggggtaagacgacagaaagggtgactgtgaccacctaaaatatttaaaggtttgtcattgatttatatgataaatttgatgttttggatgacattgtagtaagtactgctattagcagtaaaggacttgaattcccaaatagcaccttcccatgaatctttctcttgccgccataaaatatttatgtattatattaattcctaaattgtattttggttattattagtagtacagaaactataatattctattgaagttaggattggtatctatactaatctctattaatatgcttattatttttgcagatgagatactttattattaatggtgttcttttcccccagtcatttgtgatatccatagctgttgattgcctactgttagactcaggatgtattgtgttgagagctgtacatgttggtcttggcatctcgtggacctcacagtctaggtggaagaaacagtgaagaaacaaaacaaggaaacaaataagagttcagttcactttgcactgctgtacttttaagtagtagacatttttgtggctcatagttttggagactgattaagtccaagataggggaggaataatcagtgacatgtcaaaaggtaacagatgaggaaaagaacttgagagatgtgaacatgaagtcaaatttactcctgtggcaaatctatttccaggacaagaaagtaactactacaatagaaaggttaatctcttcaaagactgtactcttatgagcaaaccccttactagaccccacaagctgatgcttttgcatcaggaattaagtttacaacacactcagacagtagcatgcctatttccttccccttactctcctccccttctccctcccctccttccccctctttcacatgcacagtcacaagtgttgcctgccatatgatgtttcatgttaccatttttcaagtattccatggtacttaagttacatgcagtcagcagaaaccattcttgagttctgaattctcatcttttctggggatgccaatatgtagtatgagcctctgcctcctgagtgctgaaattaaaggcacatggcaccaccaaccagcaacgttgaagatttttagtgtgttttgttttgttttgttttgttttgttttgttttgttttgttttgttaagacaaggtttcaccctctggactcgatgtaaaccagtatagtctgttattctgaggatcctccagttatgtcttttaagctataggctggtgccgcctggcctgcaatcacccttaaatgacatgaataaaatatttgataggattttttttttttggtatttcctcttttaagaatgtttgatatcaaaactatttattttgcattatctagggacagtttagctcaatttgctttctgtatttaagaaaaaaaaattctagctgctcaaagtatttgtctttctgcagcatggaagatttttatccaaacaaaaatcatggccctgactctggaatcggaagtgataatggagaaaagcgattgtctacaacagaagtgagatttttctcttgctggcctgtgttgttttcctatttcttagagctttaaaaaaagaggcacttcagggccaagaagtgggagtgggtgggtaggggagtgggggggggagggtatgggggacttttgggatagcatttgaaatgtaaatgaagaaaatacctaatttaaaaaaatttggaaatgaaaaaaaaatataaaaccttccaaataattgcttggaggaaaaaaaaaagaggcacttaaatgcattggattttacttttacaggcagatataattttgttatatattttatgacttcaaaagaaggaatacctactgattttttaaagtaaaacattcattgtaacatggatttttggttggaaatctggagatgtagagcagatattttgtaattcctatttaatcaaagaagcaaaagcttccttgagtgttccaaatacgtcatttatactgtgtacttgttcctttcagccatcagacgatgacacaatcagccttcactctcaagtctcagaatcaaatagagagcaaacatcaagaaatgacagtcatataacaggaagcaagcctgattctcagaaaggtaattcttgtggtgtctcttaggtttaactcatttacacagcccatattaaaaatgatatttttatttgaagtggactttgaagacttataaggttataagatatagcttatattgaaaaggtgagcttttatcttgagaactaaaataagtagaacatctataatgtcttgtaatattaatctatacctagaccaggaggtgtatgattttattgatcccaacacggaagacgtagcagttcctgaagaaggagatacacatattggatcatttgtttctttccttaaggtaaataagcaaaactcaatgaacattgttaacattcacttcatcctgattatacaaaagtataccatgaaatttacaatgataattttgctttttataaggggaaagaaaagagctctgaaaaatctcagaaaaatgaagaaccgccaaatgaaaaaaagtaagtatagtctgctttttgaaatacagtatgaattatgaatgcttggattattcattatgtattcctattgagagcacttgagaagtttttcatatgtcatgggtttccccatgccatgtttagatagttacctttaaagtccttcaaaagaaaaaataaagtccttcaaattaataattataatagacctttgcttttccccttgaagtagaataataatcctgcctacagttttgttacctaaaagggctgtgtcttcacaaatactgcttcatttgagtcccccataaaaatcccaacaggatcattttgtctataaggaagcttaggcctagagttctgaatttccgaacttgagctttctgtttcttgatttaacattttatattatctcctaaaagactttctattgtgtattgaaagctcttccctagtccccgctggtgtcaggactgagttttatcgcagctttcctaggtttctctgcacaccgtgtttccttcaagtgacttggttgcttggtaatcttgttgaatgctcggtactgagctccaggcctcattctctctaaatcacaaacccagaaccttgttagttctctaagtactccttagtgagtctctcttactcagtaggaaagctttgttttgttttgtaatcctttccttttgcataacactgaggattgactgttcagtcttcagcatgctagtagacaagagcgctctaccactaaggtgtagtctcagtcctagtaatgtgtttctagacacctttgcagatgtatacaaggtgtagtagtcactctcatctcccatgtcactactatcctgattgtccccactctccactgactttttccacacattgttcatgcctattcatcttgttttgtggcccacggagattaattgcctgtgtcaattatggacttgcaactatctgtttgaacggggtgactcagtaatgaatatataactaaacacagttcaccttcaattgccagtagttcagaaattatggtagggtgccatgtattctctccttccttgacctgttgatgtaggtcttgtgtgggcctgaaagaaactaactatggtttttgtgaagtaacatttagcaactccaccctgccttctggtttttactttcttctataatgttctcagagccttaaaacaggtggaagaaatgcctttctaatggcttcatcccttttttaattttgtattaattatattttggacaggattttgctacattgtcaaggctaaacttgaccacattctatagtcctgaactgccttggaattgtgatcctcctgtcttagacccccaagtttataagcctgttggcaccactttgtttatttagatttccttcctctattaagctctttcctcataaaatgaagagagttgcttaagttcaagtgacaccagtgtatgtaagatgtgataaaacacaatatattgtgacattattgttatttatgcttattgttattaaatgaagtgctttttacatggaatacttagaatttggagagcaactcatttttaagttagtttttaatgttaaaattatatttctggctgagcagtggtggttcatgcctttaatcccagcacctgggaggcagaggcaggtgaatttctgagttccaggccagtctgttctacagagtgagttccaggacagccagggctatacagagaatctcttgtcttgaaaaaccaaacagaaagagatatttctggaaaatacgaatatttttattatttcttaataaatactcactgataagtggatattagcccagaaacttagaatacccaagatacaagatacaatttgcagaacacatcaactcaagaagaactaagaccaaagtgtggacactttgccccttcttagaattgggaacaaaacacccatggaaagagttacagagacaaagtttggagctgagatgaaaggatggaccatctagagactgccatgcctggggatccatcccataatcagcctccaaatgctgacaccattgcatacactagcaaaattttgctgaaaggacccagatatagctgtctcttgtgagactatgccggggcctagcaaacacataagtggatgctcacagtcagctatttgatggatcacagggcccccaatggaggagctagagaaagtacccaaggacctaaaggggtctgcaatcctatatgtggaacaacaatatgaactaaccagtatccgccagagctcgttatctctagctgcatatgtagcagaagatggcctagtcagccatcattggaaagagaggtccattggtcttgcaaattttatatgcctcagtacagggaacatcagggccaagaagtgggagtgggtgggtagcggagtagggggagggtctgggggacttttgggatagcactggaaatgtaaatgaaacaaatacctaataaaaataaataaattaattaattaaaataaataaatttgtaaaccttggtatggtgaaggtagtggactctgaagctcaatgatcattacctctagccaattagcatgcagccattcctggattttatgtgggcattgaaagtatgaatgcaaattatttaataaaataaattttattaatatttgaatatatttttaataatttctggaaattttgaaaatgtcatttgaaccaattttatattattcttatttaaactattttctttgttttacatagagttttaaaaaatccaaatgagtaaacttctagaaacagtatggcaaatgaaacattttgatagtagtttttctttatttttaagaataggccatgtggagcttttcaattttattcatactcaatactgagcagtgtgtactgctaattttttgtgaccattatacatctcaaattcagcatcacttattagctacatttctattgagaatgcagatgtattttcctaaaattccttatatcccattttagtattttaaacataacatcatatggattagctttctcttttttagtgctttatttatttatttatttatttattattagatgttttctttttttaaattttttattaggtattttcctcatttacatttccaatgctatcccaaaagtcccccatacccacccaccccccactcccctacccacccactccccctttttggccctggtgttcccctgtactgcggcatataaagtttgcaagtccaatgggcctctctttccagtgatggccgactaggccatcttttggtacatatgcagctagagacaagagctctggggtactggttagttcatactgttgttccacctatagggttgcagttcccttcagctccttgggtactttctctagctcctccattgggagccctgtgacccatccaatagctgactgcgagcatccacttctgtgtttgctagacccctgcatagtctcatatagtctcacaagtctcacttactagctacaattctattgagaatgcagatgtattttcctaaaaatacttatatcccattttagtattttaaatataaaaccatatggattagctttctcttttttagtgctttatttatttattattaaatattttctttatatacatttcaaatgctatcacgaaagtttcctataccctccctctgccctgctcccctacccacccactccagattcttggccctggcgttcccctgtactgaggcatataaagtttgcaataccaagggccgctcttcccagtgatggccgactaggccaccttctgctacatatgcagccagagatatgagctctgggggtactggttagttcatattgttgttccacgtataggattgcagaccccttcagctccttgggtgctttctctagcctctccattgggggccctgtgatccatccaatagatgactgtgagcatccacttctgtatttgccaggcactggcatagcctcatatgagacagctataacagggtccctttagcaaaatctttctggcatatgcaatagtgtctgggtttgttggctgattatgggatggctccctgggtgggcaattctctggatagtccatcctttcgtcttagctcaaaactttgtctctgtaactcctttcatgggtattttgttccctattctaaggaggaatgaagtatccacccattggtcttccctcttcttgattttcttatgttttgcaaattgtatcttgggtgttctatgtttcagggctaatatccacttatcagtgagtgcatatctaatgacttcttttgtgattgggttacctcactcaggatgataccctccagatgcatccatttgtccaagaatttcataaatccattgtttttaatagctgagtagtactccattgagtaaatgtaccacattttctgtatcaattcttctgttgagggacatctgggttctttccagcttctggctattataaataagggtgctatgaacatagtggagcatgtcttcttattaccagttggaacttcttctgggtatatgcccaggagaggtattgacaaatgggacctcataaaattgcaaagcttctgtaaggcaaaagacaccatcaataagacaaaaaagccaccaacagattgggaaaggatttttaccgatcctaaatctgataggggactaacatccaatatatacaaagagctcaagaagctggactccagaaattcaaataaccccattaaaaatggggttcagagctaaacaaagaattctcacctgaggaaatcagaatggctgagaagcacctgaaaaaatgttcaacatccttaatcatcagggaaatgcaaatcaaaacaatcctgagactccacctcacaccagtcagaatggctaagatcaaaaattcaggtgacaggagatgctggcaaggatgtggagaaagaggaacactcctccactgctggtgggattgcaagcttgtgaaactactctggaagtcagtctggaggttcctcagaaaattggattagctttcctatggcatttaaaataataacagtttcaatatctagatgttgacaacgttcagttggctttacgctttgaataactgtgtttgtttcagagttgacaaagaacagttacttccagaagaagaagatgatgatttgaaagaagtaactgatttgaggaagatagctgctcagttactgaagcaagaacagaagaacaggtattcttttcagtaatgagatttgagtagtcagatcttatcatcagtaaaagatgaccaaattaaggaaatgaagtttcaagtaaacaaaaggggcctttaagtattttgttttcaagtgattaaaaagacagaagaaaatccttaggagagaaataagaaattacatatataactaacagagtgtgctcagtttgacactatatttattttaggggtgctggtgatgaaagtcagggctttcatctgcgctgggcaagacctctgctttgtagctacaacccagccttagttaatgtacctcacattttacttctgtgctaaatcatacatagtaactatctgcctatattcatcatagctcacagtaccattaattacactataagcatttctttctggctatgtactatattggtaacatttatttattagatttttatatcagattcttaataatttgggatctaccattccccaaggatagaggtgaattataatagttgcttacatcagttcaggatttacctatctcaagttcacacttgtgtgtttcttgagtaaacaaacttttctccctctggttcagttttcttcaaatacatatctttgccaataagcaaggcactgtattcatgagtattgaatcaaattaagtttatttaaatttgtgtgtgtgtgtgtgtgtagtgtttgaatgtgtgtgtacacatggaggtcagaggtccgcatcaggtgtcttcttcagttgctctctacattatattttgaggcagtctcccactaaacctaaagctcactgtttgactagagctactggccacttagtttccagggtggaacatcctcaccagatcaagttttccgcattcatggtggccgtccctggatttttatgtgagtgcaagaactctgaacgcaagtcctcatgcttgcatagctggcaatttacctattgaggccaaagcccatttttttttagtacaaaaaaatggaccatgtgctacactactacctacaatagtacatacactgtaagattactgagaatcttacattgatcattttgactgaagtttctgtttctttttcatgagtaaattgataagagaattttgctatatttaggatgaataagtagtatttcctttcacttattcaaaaatacatgtttatggttatcatggtggctgtgtctttagagtttcatatttaaatatattgcatttgttttaaatagatcatttaacatatattagcatctggcagctgaagtgatggatggtttaggggttaagggaaccttttgctttcttagaagattggatttttttccagcacccaagttgggtgtgcttctgttacttcacctccaggggtccaattttctggcctccaaagaacccccacacatgtgatacaaagtcacatatacatatatgcataattaaaacaatgcagagcatctgggtattgtggtgcatgcctctaatcccagacctaatgaggctgagggtgaccagttgataagccagcctggtctgtaaaaaaccaaccctgagggtgtactgggtgcccagcatgtacgggggcacaatttgaattcccagtaccatgaaacaaagaaacacgacagtgctggtgagatggctcagtgcataaaggtgcttgcggacaaacctgacaacttgagtttgatccctggaacctatatggcgggagtagagaaccaactcccacaggttgtattctgagttttccacaaatgctgatgcatgcaagtgtgcaaaacagacatgcacacacaaaataaatacatatgcaaaaccagaacaacaaaataagcaaacatatcaagtgagaggtatagaatctgatgttaaggaaagaactggacaatggatcatatgataagtagccatctagtaccatttttgctcagccactacattttctcttaaaaatgtcatactaaaaaataccacttacctgtctttatcattgttaatgaattctcattctccatttacattgcttttcctgtatcactgctttatgtaaatgtttctatgtgatttactgtttaatcttttctaacaatgcatttcttatgtgccctctaaaaataacttttgagattataatgtgattatctaatttctgctttctcttttctcgcttcagtcttttacataactctccattttactctttttcaaactcatggactttttcctttaattgttgtagaatgtctatttgtgtggaggtggatgtatgtacatgttttacatatttatttattttgtatacacacaacacacacacacacaaacatattaatatataccgcctgctcagtccatatagcttgtttgtatgttttcagggttgatcatttggttttggataaccaaatagagtgctctaatctgctttttacaaagttgtcacagtaaggttttgtggagcctatgtgttgatcgcctgagtggtttgacttagtgaagcatacttccaccagctcttgggacataaaaattgcttgagttcatgctaccttttaggtagcatatttgtatttatttttcattatgagaaaggactagtgataattttaagactatagtaatacccactttccatttgaggcgtgtgttttagattccaccttgtgattcatagttgtttctttattttcatctttactcattgtatttaggttttcctatctctgtttcgtaattattccctgtagtttagattagggatcctctgagtaggccaccttttgtagggtttgctttggtggtgcctttgtaactagtacctaatggcacgtagtattgtgccttctatgtggtgacacagaagacacagaattagttgattcggttcttgaaaattataaaatttaaagttaacagaatttgtttagccaaaatttttatattctctgtaaacactttaattcaagatatatacaaagctaattttgtctttatctgattttctttttcattatctttttatgtgttacaaataataatataagaactatttatattaagcattgctatttttcacgatgagaaaaataacaagcattgtagagtcttttagaaaatggtaatctttctccataaggtgaaatgtaactctcacctgctaggtaaaggagaaatcaatccattttttaaaagttctacagagcagatgtacaatttatgtgttatgttttaatataattattatagattttttggtctttgtttattgctattcctgattaaaactcatttatatagtataagattaacgacgagtaccagagaatatcaccccaaccacccaggactcctgccttaactacatactgagctgttctttttcttatcattgcttgaaattaaacataatttggggtccagggtaaaaggaatcatgtttatagtcttaaacttggcttggttggaacaatacccacattgtgttccatgatgtttttgtcataattcctttgctacttgtttatcctatactagttaattaaaacctttgatttgctgaggaagtttgtgcttttatttcataaatgatgctgtcctaggagattaacaaatgatttcagaagacaaaattattaaccaaaaactgtgggacatgtagtcagtaaatagagtgtcatggaggtaactcataaggcttcagattattgtaaagcaacctcttatttctctggttagagattaagattctgtgaagctagcacaatagtgtatgtctgttttctaactacctagtggctgaggataaaggatttttgaatgtaggaattggactcaaattgtagaacatattcataaggataatgttgcttaaataaagtataggaaatggcattccccaatgaagcaacccaaacaatctatctataaaaattagtatcttaaaaataattttatgattatgaaatgaatagtatgtatatgtctgcttatataacactgtgcctatagttaacagtgcacttcacacttaaaaatgagtccttaatagatctcatgtcaatttaaaaaaatgttttatgttactggggatcaaactcagaccttatgcatatgagataactaaacattttcaccacaattaaacttatataaaaatcatgcttttcagatttgggaaggaaattgagaaaaaggagctgagaacaaaaatactaatattagagtattttttcatgttgtatatgtgatttatgataaacaagaaaactcttaatattgacctgagaataaaacagaggaatttctgttaaaaacactgtcatgatgctctataaattattaatactttcctacatttaaatcagctctacttatttatgtaaacattagaaaaatgattattatgctttactttatactgactttattgtggagattagctagcttcttaatttttggttattatcctaaaggaaagattattgtgtatgtgttttttacaatagcttcagctaactgattctcattatataattacttggctaacttactttatactattttgatatgtattacatattcataagtattttatttgctttcagttttgtcctaagagcttttctttattgtggaaggaggtatttctgaatgttttgtgacatagctagataacaaaaaagcagttgttaaatggcaaataattgaagtaaaatggaaatgatcaaagaattcaaaattgggttttaagaagtttattgtttgcatttagaattataaagcatatataacatgtttcttgtaattttgatctgattatatcaagttttcagtttgaggagctattatgttaacttttaatttgttataactacttggatacttacccttgaaacctagccattctttcttttctgtttcctttactaatgacttccttgtcttctccaaaacatcttccttcccccatcttttggtttgggtgatatatgtgaaatgtgactatagatggaggcctttaagttatagaacatcattcagtgacaaactcttccagaggaccagagcagcaggacggaaatcaaggtatctagagttggtggaagccataagcattaaggggccagacttatgtggctgaactgtctttacattttgctttaaataagtactgagaactgtgttagggaagtgtcttaataatctgtattagacttttaggtaaaatagattttaatatttatttatcacttagtaaaacacaaaatttctgtgtatattccagagttctacataggtcaaatttcaaatacattatccattttttacatgtatgttggcttcaactactttttttctattctatcataccagtaagtggtgtggcgagccatcatttttattgtgatgaaattcataataacttgaccagttccccaataattctaactttccttcctgagtagtatttattgtcatttctctttcttttatttttgtaaaatctctatttaaagcctattttcctttgttatttctataattttgcatttggggatctaaggaaattttagcacatgtacataattttttttaaaaaaatgtgcttaattctgtgattctttggctcagaaatacagtagtttgcgtctaatacttgacctttctcacatcactgaatccttttagtgaggttatggtcagagccaagctagtgaagatgtgagcctggcaccacctgactgcactttagtcatcatagtgtgtatttagttcatatgcaatgtattcagattttttaaatagtttttagattgttgatgtctaaagaattcttttagaaagtagattatttgttgcagcactaatttaaaaattaatttacatttatatgtataataataaaaatgattacatatgttcatttattttaattaaagataattactaatttgccacatttgacagggagattaatacttggaattgggtaaagccatggacaaatagttctctttatagggattcattagtttttatttttgttctaatactgtttcctattcaaagtttaagacttttttgaattttttgaaaggattgtccattaacactgatttttgcttttaaagttaatgtttattttttggcttttgtcaaagtgattataaactaccagtataactcatgttattttctatgcttataaaaagaaaatgactcaaaaggatacctaatatatttctttatattctgtgtaagtcagacttagatatacacacagtactcatgcaatggctacatagcatccaaacttatagagaaagtgtttttaaaccaagatgcaaaacacatttggtgaacttaaatctttcattaaagaatgtgttaattggcatctgaatctaaatagcattgaagtattattttctagaaatgatcttcgtgaatttaggtgtagtttatttgggacaaatatgtcatatgtgtgcaatgttctcttcagtatagtttgtaatcactgtgtcgatttacttctaggattcttaatcactcaacttctgtcatgagaaataagctgaaacaaactgtggaatgtgaaaagaggtataaacatatcatagcccttatatttggtatattaaaatgagacttgctactctgagagtgattttcctttaaaggtctttttcctggatatatgatgcagatttaatataagtagataacataggaatcaaacatgtcacaacatcagttcaatttggctttctataagcaaatcatgattctatttacttatacttaccatttgtcttcatttattcacaaatatttatcaactggatgttaccactaggtataattatttcttcatcactggctgtgaattttttgttactgtttgcgttttcatttcttcccattgggttttattaaactcttcatttgatttaatgacttaggtttacagatatgattttaagagaattagaagatctgaaaatttctatttattgttctttgtggtatcaagtttatgttttatctaaatcctagctcaacacttgcataagtgaaaaatttcaaaaataggcatgaagagttacacactgagttgccaactattagacgttagggtttatgtgcagtgttcttagctctttcactggattgctttatcaatcatcacaatacaattaggatactgttactgtggaaatcttcattttacatataagcaaactgaaactcagaaattatcataacattctcaaaatcacatagtaagtgggagagtcaggatgcaaactcatatttgtcttaatgcagaacctgaaatctattatttatttatttatttatttatttatttgtctaattcattcattcatttatttatttttttatgtgaattgatatttttgccaacccacatggatgtctgtatgaaggtgtctggtgacctggaaatggaattacatacatttctgagcagacatgtggatactaagaattgaactaaggtcctctggaacagtagccagtgttcttaaccacggagtcatctgggattcagtcccagaaactgaagtcttaatgtacagtaacagtattgacaacaataagtttacttcatatctgtgcatcttactgaaatatttccattgagagtgcactgttccatgtaaatttctctctgcaactccatcttttcttgtatggtccatctaccctatcgaatgtgaaacttcttatgtagtctcccaagtcagagactttgcaaatacctcattattgtgtctttttcctaatacagccagtcatgcaaaattaatgttgtgctaaccgtcttttcatcctctcttcctatcacactcatgttggctcagctgccattattttccatttgagtcactgtgccagtctccatgcctaagtcctttcttcaggtttgcttagttttaaattgtttctctgtatcattaaagaacagaggttgtagaacacaaatctgacaatgcaacacccatttatcaccttctaatgggcactcagaccttttatgataaagattagaaggttgaggttaatcgtaaacttaaaatgagcttcaatttatcttcaatctcagatcagagcctcatttgctgcactctctcgagtggcattttttgagtttaggatcatgattctttgatttatcacgtttctatttctataccctatatcctggtctgatttagatgttgcctacattcttcactgtctttgcatggtttcttaggagtcatctcagttctgcatggttgtcatgagggcttcatagtagccggcctctctgtggtggaagcatgtataaaagagttcacacagtaagacagaaagccagagagatttagtaataaagttagcttttagggttttttttaatgtaatgcatcttattcccatagggagcaaatgaagctcctatataacaatgataatcccatctaatgacaggctcaccattgaccacactaacttccactcctaaagatttcaccagttctacaacacaatgctgaagttcaagctctcaaaccttgggggaaatacactgtattcaagacagcatacccttcttcaaaatgtgcatatgcatatttgcatttgtttatatatgtgttcatcagtatatacaaatgtttatatatagaaatgtgcattgatatctaccacagtgtttatatacatgtgtgcatcaatatacattatattgtttatgtctaagctgtgcattaatatataccacagaatggtgaattttgttgtttccttgctattgccacttatatgtacagtacgaatgcctgacttcttcatatcatacttacactcagtcttattgtgcacttaaatgtggttctcctggatttttcccacttcagaaagtgctatctccattcttattgtgaagcatctgaaaaaccctacattaagtttgtcatttgctctccaactgcagttgatcaattaccaaataatgctgattattgggaatatttctcgaatctgatcacattttatcgactccacttctgtgaaccttgctctatatacactcccaacagtgctcaatcataagttaacaaataagtgatttccctgaaaagctttcctgtggaatacagttttgctttactgtataagtactcaagaatcgtttcaggtcaggtcagcctgtagaaattgactcctgaaaaatatttggaaatatgtttgaagagaaattgtcctcatttcgatattatgatattccattgttcagaggtgtgtgtgtgtgtgtgtgttgaccaatgagggtagggttagagattgttagatgcatagtccagagaggtatgtgtgcattgtatgacatgtgaaggtgaaataggcaggctggcaagtgctttatttgaagaggtaatacacgcatgtctgtggttatgtgtgatgtgcgcgtgtgcgtacccatagccaaaccaaatacagctttagttcgctattctattttgtttccttgcttgccttgttattatattgtcctgtgggctatatgtgcccctttgtctttgagtcctaaatttagggactgtctgacatctacctttcttctttctccctggtctgtggagtagaaatgttttcagtgtagcaacccaggccaagcatgacattcatctcttgttatccatttctcggattctttatttacatttaaagtaagtttgtctaattgatagatgtctgtatttggtaagaggtaagggatctagagttttgtctttccaccctccctcctttttcttacccatcttctgctgctgtttctttttctgtagtttacaaagtcatccagttggttatgtattgttatatattctataatttctataaatttaaatctcatttgtacgtaaagttactgtgcttaaaattttgtacttgatctcccactggagaaaatctataaattctggaattatttattttcttatttgtatatattttattactccctagagatagagatgtcccttgtacttttattaaaatttttattatcttctctgttcttactcttccttcacccatttctccttttctccatcctttttctgtctagttgaaataagttcttactctgtggcccaggatggcccagctgggtctccatcacatggtggtacctcagccttgtgagtgctgagatgaccactgtgagccatcatgcctcagctttaccctgtgtcctttagatttttgaaccttttgagtgggttttggtgtgtatatatgtctgtatctgtctgtttctgtgtctgtgtaagtgcatgccacatgtatatatgttgtggatgcccatggagaccagaagaggatattcgatcccttgaagctggaacaggtcctccatagccccttttatgtcatagatgaagctcataatcagtgattcaagagatgatcaagtatttgtcttctgaattctttggcctttaagaaaggatttattcatgtatttatttaatatgtgtgtgcgcatgtgtatatatgtgtgctatggcacaggtgtggaggtcagaggacaactttcaagaattcaaggagttacttctccccttccactatctggaacccagggttctatctaactcaggttgtcaggcttgatggtaagctagaacctttatttacccactcacctcactgatcctattacatgattttataaaacggtaacttgttttcagtaatattctgtgtacttactgcagatttgtacatattgtagtcaatttgtactctccaaaataggttggcctatgtataaggctaatatacaataaacccatgttgatgtttctcttagaacagtagttcataggcatttacaattggttggttttatcaatttcagtttatatattactaacccgtgtggtggttacttcctctcattgcagccctttgaaggctgaggcaggagaattgctatgacctcttggctagcctgggctacatacagtattaagtaccaggccatccagtgctatatagtaagacacaatctcaacgtaacacaatacaacacaacacaacataacacaaaacaacacaacaaaatgaaacatgggtatggatagtgtttatgttgctgtcttaaagcaataagaagacaaatttgttgtttataaagtatgtgaaatgatttttaaaataccttaaggaatattaaagcaactttaattttttagtgtcccagcagatgaagggaattcaccattatcacctcttgcatggcaggtaaggggaaataaaattaataacacatgtattatttggtagtcatgtgttgagttaaaaagacgtttttttttatttttattatagccattagaaaatcagaaggaccaaatagttgatcaacagtggccagaatctcagcctataatctggcaaaatgaagagaggagacgaagcaagcagatcagaaaagaatatttcaaggtaaattaataaattataaattttgtttttgtttcatacttactacttttggattttgacacttttctcttaaattaataatatttaactctccagttaaatgtcacaactgtgttcatgctgattgcccttttgtggatggtagagatatgctatgtaaatatacccacaaaattttagtaattcaaattaccaatatacactgtgattattttcaagtagctaaaaaagatgaatgtttgtgtgttacactgctaattgtggcaattaattttatgtttctttttctttattcttttgagataaattttcacaatgtagtccaggttagcctcaaatcagaatcctcccacctctgtctcttatatactggcattccagaaccactaagcctggctcagaaaaagactttcattgaattgctttcactaattagttcagaagtcttttcagatagcatttaaccatgcctgtataaataagtacttgaagactggtccatactttcttgttgtattagtagatttgttttgagatagggtctctctgcctttgacatgatacatctggtcctgattgtccgggacctctctatgtagaccaggctgtcttcaaactccccgagatccacatgcctctgtcccctaagtgctgggagtaaaggtgtgtatcactgcactggatgcagtggatttcttaagatggtcttttagtaaagataagttaaaataccagagcatatgaattattccaaatttctattgaattactacttatttgtattttaagtctactgtatttgcaggtctcatcaggatttagaatcattttttatattagcgagcatttactcttagaattgacttatataagcagtgcaaacctggtcctgtaccctaaatagcaagctgtgttgtcctttacctccctaaatcctcttctcactgaataacagtcattttatccaggcataactctgctaagttagacattatttcaaattcatgccactaataaatagtatttattttatagttttatgtttggtagaatttggtacttctgtttatattaatgtctttccatatattgggaagcatcgtgtgtttgaaattaacatatcaaaattaaaatgtatgttttagcaaatatcttaaatatattaaactaactttgaacaaataactattgagaattttgagacttggtttttggttaattagacaacatgaggcataatcacacatggaaaagacgtcggaaggaaatcgggaggtcattccagtgagaacgcttttatcagaaccatttgcagtttgcagcttggcatttatcttagcctccctttttaattcaggaaaacttaaagcaaagcactgaataaaatatgtttataggtgacctttgatgaattatttttgatgttgaatttctgagcaattttgtcatttctttgatttcttctatcaccaaataacaaaactatactgactatattcatccaaacacttgtatcagaattatcacatgtcaggcactgtcatgaatatttacacatattagtcagtttaccctttagaaaacttcagtatcattaatgaagttatcatttctattttgtgtacatggacaataaggcccggaaagtgaagtagtttgttaatcatacagttgaaattcaagttcaaagcctttacagtgttgtttcttttttgttgtggacagcttgatataaaatgaacaaacactaacatttaaacagtttcattgttttaaaaatattttgtactaattagagttaatagagggcttagtgagcctttatcacagacaagtgtttcttgctttaaaagcatttgttcattaaatattttagttttgatggctgacacatttcttctactgtgtcaattatattttaaagttgctaagaaataaaataggataatatctgaaatgaccattacagaactgtcactcagtaagtgttcatttctttcatatgcaatgatgtacgtgtaaacataatcttcagtcacggagggagaaatgctttaagggcatgtgtagttcttctcaattgtcagaagatgtcagtgttaggacattgcataaaaaattagctatcaacaaagtattcctctgttgtcaggaaaataaaaaattgtatagggctgtgggtgtaactcatagataagttgcttagtatgctcaaagttataggttcaaccttcatcaaaacagaaagaaagttagaacatggaacttatggtccattattaatcatagctgtaaaatacattagaggaacatgtctcctatctgtaattcctaatacaccttagtttgggactgaaatactaggtaagtcatatatttttttctaagagatataaaagacagagttacataagagggacaattaaatagaaccctgaatatcaagcaaaacagtttgggacatgatctgagaattagtagttttgaagatagaagttcgatgagctcctgtatctaccattgacttgcagcagaattcattgcattttggtagagaatcagaaaataagaactctaatgactggcacactgtgtgatttttgattctaagcatcactttgtcacatagataatttacattgaacaatctatctctatgtttcacaataaattgggggataatagtacatataccttatgcagttgttataaagatgaaacttttcaatacatataatgcagtcattactgatgtataataagcaatagttctaaatgttagattttagcactattactatcattgggaagtcggtatatgcatttaatgcagtttctttaagcctgaaatcagtagattacttcttttgttgtgctgaggattgaacccagagtttcagagatagtaggaaccacatctctagctcagcttcttaaaacaattgctcatgttttagtatagtgaaattacaaaccaggtgggagattctaagaaccctggataggatggtagttttaagaattcagaagttagccaacataattgacttgttgaacagagtgaacttagaagaagcaagactttacaaccttcctaatgccatgacactttaatacagttcctcatgctatggtaaccccaagcatacaattattttgttgctacttcataactgtaattttgctgcttttatcaattattatgtaaatacctgatatgcagggtatcttatacgtgatctccaagcccttcacgacccacagtttgacagctgtttttctaagatagccctgagattgcaaacctgaaggaatgggaaatggatcttgcttaggaaggaaatgttacttggcatattttgaggtcttggagcagtgtcactcatggcattgtatgtgtgaataggaagactgtttaaactgactgtgtccataagtttcattgcaggtaagttaataaaagtaccaatgtagcaataagccttatgtgccattatgaacaaaactttcacatgttcaaggaaaaaataaaccatgcatttgaattgtttttcagtacaaatcaacaaggaagaattcaagtggcaatgagaatgaggaggtgagacaaagggtgatttgaaagatttccttgcatatttagttggctcagtgatagttaatggagcccagctgtcaactgctttgttactgatttaaagtgtgcattttctacaataatgaagatttctgagcattttcatatggttactaatttaatcagttcgtttctggtgcattctggaacatgatttctaaaatagttgtagagctttgtggtttgctaggaatctgcaacctttccatttacatttgctgtcatttcccactttactttcccaaagggcatgttggtcaggtcagacttcatctgtttcaaaactgtgcctgtgtgtgtattgatgtgtgggcacaagtgtgggtgtgtgtgttccagagcatgcatgtggacgtcagaggacaattctttggagtcttttctctcctttcctcttcgattttagatagtgaagttgaagtcatgtcagtttttggaagaaagcactttaacctcttgacagactggctctgtctaagattttaaaacaacttttgtcacaaaatctgttcagatgttttaaattttaaaattgttttttatgcatttcacattcttctacagcttctgctgcaccactgctgaaacaatatttcataaccaaagtccccaggttttttgtgtatttggtttgggaattggtagtcaatttgatgcttagtacttggcagggcatctgaaatttatttttcagaaataaaattacactggaaaaaagatctatatgaattatgtctgcctaactcaaaaactgttttctttccatgttctatcaaatagtatttgtggtgacttaaaaacaaaacacggttgtttctaatgtttcccactagctatctcactgttagcgtttggggtatatctgagggcaggtttggtgtagatgtgtttcctaacatgttgctgctcatgaccccagtcaattcgtatatacctgatgctggctttccattgagatttacaatatctgtctgacccttacttcttattcctctctgtcataacccaccatatgcactgtaaagtgctgttatcaatgctcagagttttgaggactaatgccagtgtacctgatgagcacacctagtttatgtctctagtcccctacttaccattaagccttaggcttttgtagtaatgtgtcctccatcgtagttgattgaaacctaagttcctccactaagggctcaatatgttcatctttttcacccacaatttttccaaacacgtttgctttttaaattgatgcagttgtttttaaccgaggttgcactttggaagccctgattagtttttaaaggatactgatgtctggatcttactctcagatgttcaaattgaattgatgtgtatgtgtctgtgtgtgtgtgtgtgtgtgtgtgtgtgtgtgtgtctgtgtgtgtctgtgcgtgtgtgtgtgagagagagagacagagacagagacagagacagacagacagagagaagtgacatgttcaagagttttccatttgagttcactgcaggcaaagttgataactactttatcaaatcagtatttcctttctagacatcagaagttggcaaggtggcacagagctcactgactatgcttgtgactgaactttaaatacaaaagatctgcaaccatttacctatagatgcctttctgttctaatgacatttacacagttaccacctagaccatatgtctaaaatgtttactatctagccttccacagaaaacattctctgatctccaagctagaggttcaccttggctgttctccttgccttctgtctatcaattttcccccatctgcgtcaatatctattccattactgaaatccactatttctctttcttatttttaggcactgaaatattttgtctacacactccaccttcatttccatctttgcttctttggtcttttttgcttggtttcctacagtagcttccttgatttttgtctttatatcatctctctatctctccgtctatctattctttctatctatctatctatctatctatctatctatctatctatctatctatctatctatctatctatctatgtgagctctgtcaccttccagtgtcttccttagtccttttcaacaacctttttttgagacaatgtctgttagtaaatctgaatctccatgattcagctaggtttgctggtctgtgagatcaaagattctcttctctctgccttctcattcttgggatcacagaacatgccaccagttcaccattgtaagtaggtactgagtaccctaactcatgtctatgtttatactacaaacactttatcaattgaaatgtctctcccaccacttttctccctttagtgcattttcctgatgctttcagaatacaaatacatgaaaatacaagaaggctgttcctttgtttagaaaccttcagtttcaccaatgccttaaccataaattctttgtccattttaataaaagccctggtagccatagcaacagaacctcacagcttgccctcctttcaccattgtcatctgcaggaacacaggcttgctctacagttttcttttttttttaatttattgctctgtgtcttcattcttatctttttgctttacctagcttttactgatttgttacttgctctcacaaaacttaccttttttcagcatcccttcctttcctccagagtttctttgtgatttcctactaggccatacatagactggaaattttctaataactgctcacatgaacctttcttccctctagactgagacattctctaaggatgatattttaccaaatttccttatcttagtgtctagaacattatctgacatagtaggtgtccagatatcatttgtcaaatgagcatttgttttatgtggtattcatcttccaggttaaatgtcaagatttttgcattattttaacattagaatatttattcaaaactactagccctttattgtttttattcaattaaattctttgtaaatagttctctatttatactaatatacattatcttccagatagtttcttattaattatgattacctcttgctagctttcattgataggtctcagatggctatacatctaatctactgtaccgagactgtagttctgattctataaaatacttataaatcattagggtttcttatattgaatctgatttattattagttggagccagagatcattcatgtctaacaaattcactgagaatacttgtactgtacttcaccaacaacatttaagtggcaagattctatattttacattgtcaattcctccttggatattttataggatcagtcttccattttctttttgtatgttaaaatcatcattgtgtattttaatttcatctttcatgtgtttatttttatattttagcaagagagtgataatgctcatatgtccgcacagtctccagtatcatctgaggtacaagttgttttaatgatttgtcttttatgtgttttccaaagagttcttcctttcttcctttctcaaaaaaa

SEQ ID NO: 691 - DNA, 45326 bp, mus musculus
cagcctgcgcatgcgtcctaagaaccccctccactcgcggcccaggctccgagtattgtcgggggctattctctctcccaggaacatggcggcgagtcagggaggcggtgggaacagtgggggcggcggctgcagtggaggtggaagtggcggtggcggtggcgcggctggaggaggaggtggtggtggtggaggaggaggtgggggggccggggcgggaggaggtggcggctgtggcgggaccgtggcggtgcccatcccggtaccgactcttttcggtcagccgttccccaatgggccgcagtggcacccggggagcttgcagccgcagcacacggtgaggagcctggaccgggccctggaggaggcggggaactctggcatcctgagcctcagtggcaggaaactcagagagttcccgggcagcggttacgacctgacggacaccacccaagcaggtgacaggctggggggaggggaagcggggcctggaaggaggatggggagtgggtggctgcgtggctgccttggagtctgctggcccggcgcgcagaggcggcgggagtcccggaatcctagcagcctcctgtgactgcaaaggggcaatgcaggcagcgggaaagaggggcgccagtagcccagggatgatggagagctggctgcgatgttaggggcattattgttagagagttgcgtgcatacaggcagaagggacttattgacaccttccttaatgcacttcttgcaactcttggtcttatctttccctacctcaactgtgagtaggtgggaggcagtgagggggagttgagaacagacaatgcagaatatcataatctctacttattccttgaaggcatccatgcctgcacgaatggcatagtcctttttagagtcaggtttgctgtttgtggtcttatggtggatttgtttaatcatcttagggtatttttggcttctttcccctcatgtatgccttatagagtgttttctattttatcttattttatttattcattttcctggcgttgagaggtgatggtggctagattagtatttgttgtagtagcaaattaaatcatcaatcacttaagggtttggttattgggtgaaaggcagtccagatttgaatgatgttagttttaatttttatagcagaaatcaaaagaaatgagcatttttgagaaaaatattccatttcttatggagttgatggttaatggattatcctatactctgtgttcgtctttgttgtggctggtatttttgctgttgttacgaattcgctctccttctaaagctgtgcagcttatttttagctttgtttaggtttgctgaaagtttttttttccttctcatgatctttaattctttatttatgtaccccatatactctgctgaaatgaattatgcaccaaaatattagaagtgatgtagtgattttgaagcaacatagtaagtaaattcatgcgtagtaggaaatagtaaacaaccttatttacaaaccagacaaattgagtgcattcagtttctagacatcaaatcaagatgcatgcactggcagaggatggaagaggaagaaaacctcaaatgaagcttcctagtcaataatcctcttaggcgttagcctcaggaatgcataatcaagacctgattttgtattttggaaagcacatttgaatgtttacacctttaccaagaacagattgtccaaacaactctattcacatactcatggtgaggtactgacaatatatgctccttggtgtgtttttacaaaagcttcaagaaaaatggctccatgatgcattcttataggaattgtttttcttactgtttttttcttttctttttttaacccataaaggttccttcattctacctgtgggacaaagtttaagcatcttagctgtcactgtctggccccaggttaattattgcaaccttatctccacaaatgtttctgccttctgttccaactaggtcagcttgctgcccttcaaatgtgtttgtgtaattttgcctcatattcatgaaggttctcagtatgcaggaggttttctaagaagctggctccataatccatagcagtcttctgtttctttgaattcctcggcacttattgtctttactacttgtttgacatttctgactttattttccctttatgcttgtgccttgttctccctgaggatatggggagcccctttaaaggtatatactcatttagtgttaccattctatattgcttcctcctcctccccctcctacttctcctcctcctcctcctagccccctcctcctcctctttgtatagtgacgtttctcacaaacatgaacatcattttattcagttataaccatttgcttttaagcctttggttggttttctgaggcaaacctcaacacaacccagaaccatatttgttcttggtaagctgttaactccccatatctttttgttggtactggtgctgaagactcaggattttgcacatgctattgaagcattctgtatccatcttaatctttactagggtctacatggtataccttttggtgtgtgtacttgtgcttgtgcccgtgcaaacctgtgctagggtgtgtatgaaaatgtgtaggccaggggtcagcctcaggtgcagtgcgtttgattttctttgagaggtgctctcactgctctgaagttgtcaaggagactaggctgggtggtttgagaacactgaggacccatttctcttcctttctccagctctgggatttaaaaaaaaaaatgtgccaagctttttttcttttgtatgtagatgctggggattaaatttagatactcatgcttacctgactaacaccggctgaggctgagtaaggtgttttcatttgtgtgttttcctcctttaccttttcattctcttcctgcttcctcctttgtgtgtgatactcctgtgtgtaaacattcccttatggatgaaggcacatgggtgctatgggcaatgtgtggtcatcaaaggagtatcttgcatatccgttcttaccttctacctaaagataggagtcttctggactctgagtattcttggctagctgacccatgatcttctagggcttctgctgcctttcttcttatcttcctaaaggagtgctgggattgcaaatacctgagttactgtgcctgtcctttacgtgggttctggggatttgtactccagctgtcattctgttgacaggactttacccattgtcatttccccagctccccttacccacccttttgagacagagtctctgtatttccagctagtattgaatttactttgtatcccaaattggccttgaacttgagataatttgcctgactcagtctcacctaattacaggcataagcaaccatctgatagtacttttcaaaataactctgctttattataagctatgatgcatatatgaaggagaataggcagatttttctctttcttactttgagttatctttgcttaatattatactttctaaacccacccacttgcctcttaatttcacttttatgaatatctgaataacattctagtttgtatgtgtagtacattttcattatctacacatttgtaagtggatgcccgtgttcattccatttcattgttattgtaaatacaggagcgataaatatcgatgtgcaactctacctggtatggagtcctttgaggagtctagctgggttatatggtcggggttcttttgttttattttctgaggaaattccaaactcctctccttacttattgtaatagtatgaattctaccagcagtgagtaaggattacttctccccatcctccccctataaccctgtcctctctaacttttgctgttagatttcttgatggtagccattctgaccagggtatgttgaagtctcaaagtaatttactttgcatttatccagtgactactgatgttaagtactttaaacaatacattccatttgtgtttcttcttctgaaaaatgtctgtagatttaattagcccatttgttaattaacagttttaattcctagcctataatgtgcatgcatgtgtgtgtgtgtgtgtatatatatatatatatatatatgctgttagtatgggtgtagttataacatttagaaagacaatagagagaatacaattagatgatgaggaaggatgggataaaggtaaaatgacatgtgaatcatgaacaggacataatgacactttttctctcctggtttcaactctctctcatagatttgtaaatttttttgtggtatacaagtgaagaaaaatttaattgaaagtaaaagtgtaaagccctaagcaaagctttgtctcttcagaaatgatcattctgactgtatagcagtttgctgagatggacaggcttggggcaaggcaagtgtttgaaccagctgtgtagataaaaaagtgaatgtttttatttgtgagtaattagaacaaagttattttatttaaaaatcaataatgtggttttattttttttaaaaaatcaataaaacagcaaattaaaaaggaaagaaatgccaaagatttaatatttttttttgtctttcaaatgtactttctttgtgagaccatatcaaaatcaggtagagtaaaatagatcttgtggtattatctttttcatttcaatgagatataagtatgtgagttacttgtcatctgttttgaaaagatttatctatgcattatctaggagcaatatttgtgaatacagatatcatgttcattctatgtaaatgaaagaaggcacctcagatttaaaggcaaatgcagcatatgtgaggttatatatgtacatgtacacaaacatatacatccaggtaaataccgtcttctttaagatgacactgcttgatggcattgttacagtgtatgtacaatgactcttggctaatgtttcagaacaaaactgattatttagacaagcatgaggtagtttattggatggaggaaggactcaaagaaatgaaaatagctaagatactattctgctaattaaacagtggttggaacatgagttaaaaatagcagatatgctattctgctaattaagtggttgctggaaaatgagccaaagcaatattgacttaagggaaatcgacaaatttccaaagaagaacgaagggaaggctttctgtgtttttttttttttttaaactctcactcatacatgcataagatgaaatataccagtgtttcctgctctggctagacattacaatcacaagggattttttttttaagcaccaaggccatactccagaccaattaaattagggtctcagtggccaagtttctcaaacaaaatcttcccaggtgaattcaatatacagtcaaggttgtataaatgtaaacactttcagtttgagtgaatgaacgttcaggcagaaatttagtgattaacctaaggttactactcatccagaggttcaaaacccaagctatgaagttttcaagttctagtgcagtgttattgtgtgtctttatactctatgggatgagcttactaggaacctatggttagttttttttttcctttagttttcttggttatcccaaccgtatagctcatcctctttgtaaactttacatactgtcctccaattatgtagccatgaagccttgttgcctctaaaaggcttgctaagatggaacatggcaagaagagctgttggtagagtgtgtctttggtgtctttttccatttttctctgcatttatgtctgtgacttgtggatccctcctgtcagttttcatttctacctctgtctcacttttctcctttactgggatggtgctcaatgctacatgattatgacagtttcttgagagaagattcgcatttaagaggagcttgtacctttcctgagaaatcagctgatggtttgtcctcatgacctttttgagtatatccactttctcaactcttaataataataaacctctcacccaaaatggatataagaagtatccaaaaattgttattgtattttgggaaagacacttattctctttgtaatctctcctttcatgtggcctgcttatagactttgtatgaactttctggataccatgataatttgttgccttaaaatgaatttattgcactgggcagaggtgttgcatacctttactcccagcacttgggaagcagagtcatgcagatatcagagtttgaggttagcctgctctaaaaagtatgttctaggacagccagggcaacacagagaaaccttgttttgcaaaaccataaaccaaccaaccaaaaacaacaacagaaaaaccaagaagaatgtattggttacccaaacatatgttgatcgttttcacagctcgccctcccccttgctacaactgagtggatgtgtttgagcctgcttgcagccagtccctctgatgcactcactgtacagtaacttttctgtccacgagcagatgtctgtaaaatagatttaggaattcttttgccagattgtgctgtgtcccgcataatcacatgttttcctgtaaaccaggaattgactctaggatttcctacatatgttggctcacctcttcaactgtaggatatggtacattgtattcaattgtaaaatggagccagataaaaacatctgacctagtctcatagttaaaggtcttgctagtgcactcactggaacaagtttgtgatgtttgtctttgacctgaatcaagtatctgcctttctttatggagtgtcttcctaaaaatggaatgtgaaacacatttttcagagttgactcatattttaataactgtagattatatctgatttgctaaaccttgaatggatttactctagaacaaattctatagtgatcccttaatgtcttttactttttctgcaagtttgcaaagttaaataaaattttagcttgaattggaaggtgtagtcattgttaaactaattcaatttgtacttcttcatatataatgtatacattctattttatcctattaaatatgctttgacattgtttgctattggtagaatacatagtacttcttgtgtttgctgtggagtatatagcaaagtattggttaggaatagcacagtgaagtatccactgggaatgttttttccttattatagaactattaatagaaatttatagaagttacttcttgtgaaagtgcatacttactcaactttatggctatcatacattttccatgtcatgccatgttttatttactcacatagccttttatgcctttatgtttgaaaactttagaataaaataattactattagaagtttaactttggagacatgttcaattgtccagaaagaaaggaacctagcatgtatatagatgtacatctgtaatactatccatctgaaggctaagagagtaatgtattattattatttcttctattttgggtgattataatataattacatctctcccttccttattccccttccaaatcctcttatacttacaactccctactctcttttaaattgatggcctcccttttcactgtattattattgtatgaatatatataaacacacacattcctaaatataacctgtttagtccatgtaatgttgcatgtatgtgtgggtatctgtgtgtggtatgtgtatgtgtgagtgaagggcagactatggatccatctttctatcccctaggcagtaataccttgaacttaaggctaaattaaagtatataaggcataaggaaacaatgtcaaaccaaaaaaaaaaaatccagaaagattggtatctcagtattagaatccttgcctagcatgcataaaggaagccctgtgtttgattctggtgtaaataaccaaagataggctacatatttgaagtacagcataaatacacacagaaatggatagttaggataccctgtacttggatgggaagtgttgcttaaagtttaaatttttatgtttcaatttagattagttataattagttagggttctctagaggaataaaactgatgggatagatgaatatgtctatatgggttatatataatattatatagatattataactataactaactatatgattattaccatatatatgtatctatctatctgtctatatatctatatctttctatctatctatctctatgtgtgtctatctatctattaatctatctatatatctgagtgtattgcaggctgtgtgtggtccagctagtctaacagtggctgtctactaacagaaactccaagaatccagtaattttttagtccatgagctggatatctcagctgatcttcagtatatgccagaatcccaggaagtgggttctaatgccagtgaaggaaagaacttgccagtgacagtgagagcaagcagacaaagagcaaacactttcttcttctatgtccttcctatagactgctaccagaaggtgtggcccagatttaatgtggattttctcccctcaaaagatccagatgtagtttgggtcttcccacatcaaataattcaatcaagaaaactttctcaaaaatatactcagccactcatattttagttcatcccagatgtagtcaagtaaataaacatcacacttgggatagtttatatggcattagaaataggtgatcaagatcactgacaatgaaagtaatgttaggtatacctttcataagaactaagtattgaagagttatagcatactgactttctggggcatagtattcaaactctagtaaattcattgaaaatggacattctctctgctcaacccagtagctcactctgaatgatacttaaactgggtgaagataaacctcatgccttggggattcattatcaccatggcacaggagatgaaatcttggccttgggatgtaagtcagttgaaacaatggctgcttagcattcagaaagccctaggttcattcctcagcataacacaaaccagttattgtagtgcatgcttataaccccatcattcagagaggaaacatgagggtctgaatatcaaacctcgaactggcttgatagtgaattggaggccaacctctgttactggagaaccagtctcaaaatggaaacaaacaagcaaagcagtacaagcagtgccactaagagagtcaaattataactgtttctctttttccccatgcttggatatgttcagatagttgatgaagcattgtaatactcttgtagaatcagttttttgaaaattttagagacttctctacatgtcctttataggacaaaaatccacaccttacactccagagcaccatttaatgtatttaaagaaaatggtatggggtaattttataacaagtcaactttaagtgtcaatttctgcttttgcattcagtctagtaaaggtcaaactttaactaatgctggtttgggggtactgtagattgaactcagagctttgtacccttgttttgtttttaccttaatcccaaacactaagtctttgtttaatctgtttcaaagagatttaaatttgtagaatttcacttacctaaaaccagtgtatggattctactagataacaattccatattttctaatgttatttgaggtcatgtgaaagaaaagttttgatatgagagttttaatatttttttttacctaaacaagatttacagactgagcaggttgtagttaggtgtgtgtgtgagtgtgtgtactaaaaacaaacaaacaaaaacccagatgaatctcagaaacttaatattgggtcagaaaatataaaagtttctacagttaaagaaaacatagtattaattgggtttcactttttaaagctttgagacaaagaataagagattggaactctgaaagttttgttaagacagctgactggcttgaatgtgctttagcaaccactgacaatcatagttacacaatgcaaagcacagtcgaacaaggactgcaaacagtaacaatttgggggtggtgctgataacaacatttagtaatcagagatgagggatgctgccaagcatctttcagtgaaaagaacaatccccacaatgaagaaaaaaatgaaatttttttttctttcccaaagcatcaatggtaactatcatttttgaaccttaactttgaagaaggttgagtgttgtaagtgaaaacagtgtgcattgcttgattagaggttgggatagcatttgattgcactataggcacatcacagggagctttagaaagaatactttgtctccatatttgctcccctgagtattttgttcctctttctaagaaggacaaagcacccaaaatttggtcttctttcttcttgagcttcatgtggtctgtaaattatatcttggatagtctgagcttttgggctaatatccacttatcagtgagtgcatgccatattcgttcttttataattgagttacgtcactcaggatggtaggagacaaaatgaagagcagagactgaaggaaaggctacaagatactgtcccacctggggattcatcccatatacagtcaccaaaccctgacactattgtggatgctaagaagtacttgctgaaaggagcctaatatagcagtctcttgagaggccctgtcagagcctgacaaatacagagtcagatgctagcagccaccattgcgctgagtgtggggtccccaatggaggagttagaggaagaactgaaggacctgtgggggattataattccataggaagaacaacaatattaaccaaccagacccctcagagctcccagggactaagccatcaacaaaggagtacacatggctccagctgcatatgtagcagaggatagccttgtcaggcatcagtggaaggagaggtccttggtcctataaaggcttgatagatgccccagtataggggaatctagggcagggaggcaaaagtttgtgggtgggtagaggaacactctcatagaagcagggggttctgagggggatgggatagggggtttccgggagcagggaaactgggtaagggggataccacttgcaatgtaaataaagaaaaattaaaaaaaaatgaaaagaatgcgttggcttagaaagaggatcacatagaaccttactgaatatggacatctcaatattgtctcaaacccagcttatcagatgacaagctcttgttgctgactcttgactctcttgtcactcagatcaggaatgtggggcttgttccagcttcttcttttttctctcagcttctccatcagttagaaattggtgcctgttcaccagaggcttttgaataactttccttcctgtctgtcctcactgccaccgttattctggttcctctcctccttgccttgaactggacctgtcaatagtttctcacagtttctcatctgtcatcttggcttcaacgtcattttattttctccacacttgttcaactgtgctttgcattgtgcaactatgattgtcagtggttgctaaaacacattcaagccagtaagctgtgtcttaacaaaacatttcagagtcccattttcttattctttgtctcaaagcttaaaaaaaaattatactttgttttccttaactagtaactttaatattttccttaattacgtttccgagattcatctggttttttgtttggttttggtgtgaagtgcaattcattcttttgggtcactacactataccacactctgacttttgagctatccccattctcctgcagacaatcgacctgtaaacattaagcatatctcttacatatatggaaatctttctcttttgtatactttgaaatggaattgctaggttgttgatcaatcttcaaattgttttacagtttatattttcatggaaatctcgtgcgcacatgcgtgtgtgtgtgtgtgtgtgtgtgtgtgtgtgtgtgtgtgtgtatgtgtatgtgtgtgtgtgcttcctgtacacagactagatcaggcttggattatgtgtcatgttggatgagatgtctcctgatgctcctccatagacatttctacaagtgtttatgaacacgagtcccctatatttaaatattttctaatttcaaacagtatttttggaagtcttttctaaacttttattgatcttttgtgaatttcacatcatgtactcaatcccacccatcttcccatccattcatatccacccttgcaaccttcccccaaatgaaaacaaaacacacaaataaaaacctcctcactgtggaagctgcagtatgtcagtatcatggggtactgcatgctaaacccttttgctcagatagctttacttgcaaatgctcactgcaaggagtcattggtctggtttgaggcctctgtatgctatgctagagtactatagtctcaccaggactcctctcgcatatcctgatttgccctctgtcatggagattctgcagccttggatctctaggaccagctccttcaggcactgcaacagtccatagatgaggtggatgttggggtggacaacgttaggtgtgggtggtagcccaccagctctcttgcacgcacaccaccagagtcagctttacattattgcctcattagcatacccaaggggcggggccaactctcctgctctcctgctctgctctgctgtcctgctctcctgctcttggggctggctcaccctagcctctgccaccaggataagctctattgtgctgtcttaatggtgcagggttctctaccctgagtgccatagccagcggggtgtgggactggctgtcttgctctcatgactttgtggccagctctcctatctgctgcaggttactggggcgagagggtaaggcatggcatctctcttgagcccagatcacctcatgacagaagagggttcatgttctcagggaagcccacacccccgcaccctgtcgcccacacccttgtcccctctattgtgctgcccaggtgagatgtgtgtgtatgggcggggcactctccagagtactgtagctggtgaaggacagggctatctctccccagtgccacaaccagtaaggggtggggccagccctgtactgtccttggacaccaacatggtcccaggcagcagccctcacaagggatatcacgattatgtttggtggtaacacgggccatggttatagacacagacctttgctgctgcatttccaccagcccaggcatgaaccctagtgtcaggatgggctgggacttcaccattgcctcaggtagcagtgctggctgctaacatcaggctgttcctcacaacttcgagtttccagtcccacctctttttattgtgctcaaaccattctgcttgtctttctctctcatctctccaccacatgcttgcatatttagtagcgcccttggtgagcaggccaagcagtgcacagcatcacactgagaacatcataaatgcatatgatatgttttgatctaatccttattcccccattccctcccgttgaagttgccttttatatctccttaccacctttatctcccaacttcatgtactttgtttgttttaatccagaatcagtttagtgctgtctgtatacacttgggtataggaccatctactggagcatgggtgacctctcagagtttgaatcgctgaagaaaactcacactgatttctgaattatggtgcctttcatttctgtttcatacctagttgtcctgaatataaattatggtacaatatttagtagatatagtgagaaagggcctttcttgtctgagtttggaagggtaacatttttagtattttctcaatagatatgacgttaactttggtatttgagcatagcatttattaggtatctcattgagggtttccagtgccatgaaaagacaccatgaccaaggcaactcttataaaagaaagcatttaattagggctgtcttacaatttcagaggttcagtcccttgtagtctcatgcagggaagatggcggcttgcaggcagacatggtgctggagaagttgagagttctacatgtagatctgcaggcagcaggaagagagatatactcgggctcttgaaatctcaaaggccacaccaaatgacacgcttcttccaacaagactgaacctactccacaaaggccgtttgccctaattcttctaagtagttccactccttgataacttaagcattctcgtatatgagcctatggggcccattcttattcaaccccccacatcaggttgaagaaattcctttctataactagttttatagtattttgatttttaaaaggcattagattttgtaaaatgctttttctgtgcaataagttaatcatatttttgttctttattgcattcatatgggatactacacagatttattttattaaggaactcatcttgttttactgaactcccatgcttttatttagtctcagagttcgaaactatggtttgcttttcaaaagtatccaaccacccatctttgcatgtttcttggtctgtagttactccctgtcaggcattctgccttttggtaagcctcctttcttttcgtccttcacctgcagcagtgataacttcagaccccttttgtagtagctgtgatattttattgcaattcctagctttcctccattgcaccatttaataactatcatctttggaggcagggtcttgtcctataactcagtctgatctagtacccacggcgtagtccaagttggccttaaacttccagtgcttctgctttgtgagtgctagaatcaaggatgttctaccacactgagctctatataatttgttcctttgatttgatcttctcccatacaatacatcctgagcgttgtctttcctccctccacaattaccagtgccccactcccattgctccctctgtttgccttcagaaaagagcaggcctcccagtgatatcaacctaacatgacataagatgccataagagtgggcacaaaccctcatgtcaaggcccagtaagaggaaaggggtcttaaagcataggtaaaagagtcagagacatcctcgctcccacaaacctcccaagctaaccaagcacagcatgtatgctgaggacataggacaggcccactcaggctatgtaattgctgcttcagtctctgtgagcccctatgagccatagttgattgtgtaagtcattttctcctcgtgtcctcttgctgctacactgctttccacagagttccctgagctttacacaatgtttggtagtatgtttctgtacctgcttctgtcagctgctggaggaatccattctgatggtgactgggctaggcactaatttatgagtatagcacagtatccctgggaatcatttcactgacttttttgttgttgttgttgttagttatgtttggttctactttctttgaaccttcacaattctggatcctgaccatctagacagtgttaggcataggctccttcttgtggcttgggcctccatttagacagtcattggttggccatgcccataaattctgagccacaattgccccagtatatcttgcaggcaagacagaggtcctgatggttttgtggctaggttgatgttgcaatcccatcactgggagccttgcctggctgtagaagatggccagtttcaggctcagtatcctccattgctaggagtcctccctggggtcaccctcaaagattccaggaaaatactatatatatatattttaaactgaaaaagacaaactaacaggaagatttctctggagatagcaaagtccttgccatggaaacatggggacctgagtttggatccccagggctcatgtaaacctagctggggtctactgcaaatctgcagttctgaaattcttaggtgagatgggagacagagacaagagaattcccaagagcttgtaggtctgatactctgtggtaagccacagggactacaagtgatcgagtctcaaaagtgtgccataatacctgtgattgtcctgtgacctgctcacacatgcattgtgacaaatgtgtgcctgaactcacatggaaatacacacacacacacacacacacacacactaaaaaaaaaaaaaaaaacagaaataaaaacagaaaaaaagtgctagaaagaaaaaacatgtattattgctccataagcataaataacaaattttaagagtttagagatgtgttattgtttttaaatgttctatttttggtttttacattttcctatattgcacaatggaatgtttttaaaaaaggaattagtttattgaaaatatttaggttaattattcagtataattgatttaagttatatattagagatggatcttcactgcactcatggcaaggtggggcagtaatacaaggcaaaacagacaattagagcacattaaccaactattttaaattgtctaactcctttaaaaaaattccattgtccaatataaaaatatgtaaaaaccaaaaataaaacatataaataaacaacttatttccgaactgttaaaatattttgtcatatttttattattcatgatatttcattaaatagtaaagatggcactgaaaatagtaaagtgtaatgtagtaggaggccggctggcggcctacatgaaccgggtatttctggaaggcaggctggggctgaaagagagactagatggcgagaaaagaaagaagccaagacaattttttctttgatcaaggcccgagagtttactaagagattgtgcttataagggggaaggcccatctcccccacccccagtccattcttggtgcctggagccagcctgtaaggcaaagtgcaggataggatgtgtctctggaatgtctcaagggtctctcagcaggtagcagagtctcagtgaagagcagcggttgacataacaatatagccatctaggtgggaaggctacaccccaagtgatctcatattcagtggcagcaaagtctgaatcagcctgcttcaaggctgggggaggctacagtgtaagaaattcaaccttttgtttgtttgtttgtttgttttgttttgagtcaaggtcttatggtacagcctggactgcctcgaaactcattctttggcacaagctatcttcaaatgcacagcaattcttctgcttcagcctcccaaatgcgaggattataattatgagccactaagactgtctaggtcacagacttagtgttcaaagtcataattgcattgacatgaggaccaggaaaacctgagacaagtgagcacttgtgatttattttagaattatttcctgttttcttgtagcatgccgtgctctgcttttctcttcctgctttggccagacgccccttcttgctgttgagtgcagttcagatccatagtctccaagctacagttatcatctgcaggcagagtgagagtagaggtgctcccgaataacaggtctgtgtgttcatggcttcttcttttcctgcttcatcaaaacctaatgactgaggtttactcacctttctttatataattctgctgtcatgaatttcatgtttcctttgttctataaatataggaatcaaggcaacggggaagattccttcatattggtagccctgagttacagaggtttatatcctggtcttttaaagactacctgtctcatttaggtctaagcacagagaactagaggcttatggctaaaaagtgtcaaagctcaacatttattgctctagattttggatgcataggcttattgcccaggttgtagaggctcaaaaccagtggctaaagttatagattatgagtatgggtatctgaaattttggaacttcattactcagtagcttgttcaaactcttctagcaaccagagctttcagttcttgaagttcagctcctgtctttgactctccacagtttcttatcttccctatgctcaacttttctgcctctgcttcttggccattccttactttctcagtacttccatcattcttagagtattgcaagtttagcctttggtttctctctggaactcttcaactgtcgcctagtactacatctctgaactttaaagcatccagcttagagagctttgcctatgataaggaccatttatggaaagcacccagcattttttaggatcttaactgaggtttgaatggggtatatcataagaaaagccttgggcatggccccacaagattgaataactgcttgcttatatagctagggaatggatgtggtgtacgtgtggttcaactgtaattatgtaagccacagcatggtttcccagacccagttcctaagctcacataaagaccgatcagaagccttatataggaagtaatgagaagctctttgatgattcattggctaggcagccatggtaggttctgagtgagaataacatcagtgtgagcagggtcatctagagtgtaaccagattgtcctgtgcagagtctgttttcaatcattcagatgacttcccactcctataagcttttggccttttgaatgaactaagtaacagataattgactgagttgggccccagctgaggtgcctctgcagtccttttcgcctagaaaatttaggagggagatggtgctatggagtgatggttggtgggaaagactacaaaagaattggttgtcttatattggagctggatattaacacaagaaaagaaggacgatcttaagcaggggctttcccaaataagtttaggctgttttagaatccatggagaagaaatagtgagttgttgataatattggctgtcaggattagtttagatgaaagtaaaacgtttttgagatacaggtggcagtggagtgttgaataaaacattgttaatgtctaaaatagttaaatgttttatgaataatattattgaagagagtgtgtgggttggtgataggattaggacaacagaaaggtcacaaataaccctaagatcttaagaacgacctggccttgagacagggacaatgggaattttatacagaaattcagttggggctaaagaaagtaacatttaggaatttgtagtaatgtgttaagagtgttctcaaggctttgaaacttatatggggaattggataagtctttaaagttgatgaaaatggaagtaatatgtgagactctgcctgagtttgacgtgttccaagtagacaggaacagctgactagttatgaaatggaagatattggagagcagaaactatggatggtcttggtgaacttctgttgtttagggaaccatgtttgaggttagatagagtgcagatgtagtttggtccccagtttgtatataacatgtttttaactaataaatcaaggaagtccaaattaggaaggcatgactaaagtactgttctccaagaaaacaggacgaaagaggaatggccattggttggaaaatgccattgacttcaactatcaagatagaaaccagaatgacacaccttgaaaaatcatggtctgcatctaagataaaatgatacccttctttggatagtgaacactaactacactgggcttaggcaatccagtaatctaagatagggtttgttttgaccctggcttattttagtcagtctactgcaggaagcccaaaagatccttccttgtagaaacatcacccaccttgagccttaggttagaaggttagactttggttgagctgagacactctcttcgtgtgtgtgtgtgtgtgtgtgtgtgtgtgtgtgtgtgtgttagaaagagagagagagacagagacagagaatgttgttcttcctgtgtctgacctgtttacacgtttttctagatagattaggtgggagcctcttttgggaggcaaatttgatttcagtggccagcagactgtacctaaaacagaaactaagggacacctctcaaaggcccaactagtagtgaggcaaggggctgacaggcttgtcttttcatctgggatcttaaggacttaatcttttcctttctctctcatgagcttgctgattgttaaatctccaaaagactgtctgagatttcattattattattattgtctccagtaacatagtagcctagctctatgaagcttacattattaacatatattgttgctttagcacaaatgtgatattactcttttgtagtgacacatgttgcaattatatatatacatatatatataatgattattaagaacttattattattattattattatgttattaagaactcaaattcttttgtaacttgtgaaagaattgtagaacttggctcttaatttgctttctgtttgagaaagaacataaagacacacaagtgtggacaatgcctttgcctccaagtacttagaacagcaggcagttccgaactcagtagcctgaaagcagtggccagagtgggtatggagctaggagggtggaatggtcttgagtgaggggtcataaggggtttagaattaaaatgcagtggatatatctggtcagcatactcattgtaagagtgcgagtaggagttgaagggggaagggagatgaattgaggagaaagaaggggcatgcatgcaagtagggcacttactaacgtaagtgagcaagtttgaagaagtcctgaataagagaacacaaggccaatttctgcccaagtgatagcatacatggaattggaataagacactgtgattaagagaacaattttcaggccagacttcctaggcatcaaggttgaataaaggtcatgttatactacaagagaacacttaaggtcctagattcttggagactccagaatagcatacccagtctttgagagtctgtgtaaggggctacaaagattccttctaagaacataaagacagtgtccctggtggtaattaattcactgaaagattgggcaaaactagtgctaggacttttgctaaatgagaaacaaaagggaattgcctgtctgagatagtatgaaatattttctttcttgcctaaagtgtctgagttattaccccatcatttattctcaatacttatgaatgtctatttatgaatctcttcattaactgttgactactgcatatacaagcttctctgaccaatattgagagtagcactaatttaatgatagaaacatagatattttgatggcaacttcatacagtgtccattcagctaaacaacagtagtaagttcccctctagagcctatgacatttgccatctgtgggctattgaacaggtctacagtaccaggtatggattcccctcttgtgaattgggcctcaaatccaatcagaaagcaattggtcacccaataacaaacttgttgtcattttacaagtgaatatattttgcttgatatgttggtattatagcttgcagggcttacagctgattaagaccattagtgacttttccttccctcacagcctgcatagaaccttctagtactgtgaaatctaactcacaagtagggaagttccggcttagatctagcctcatttctctatgttctgcaaacaaagtatatagtatcttcagcaatagggtctcaccatgtagttatgataggttaccaaagagcaattggaacagtttgtgttgttttttgggagaaggaacaacttttggatcctccttgtccaacagctcttaagggggcatcccatacctgaaacttgtttattatttaataaatattatttaataacttatgacttctggtacctcagtttaaattatttaaaatttgtttcaatatgttatatgaatgctgaccattgataatattttaatttgtgatataatcaatggaggtgtgctatttttattaatgtgcattaattattgctttttaatatacccatacttttcttcagatgagtctaagccaggaaaccatttgttagtgatttatttcttcatgtgatactttgaaaatccttccccattctaaaattgcacagtgcttttcatgttcatcttctcttttcatgtttattttactttagaagttatatggtttgcctttaaaaataaaaagttaagtcaacagtcacttcataaataacacgacactggttcaaaatgccaaattcacagtctgtacaatttacatgggttgaagggtagtgccattcttaaacatcactttgatgttggtgccattactctgattcattaggcattaattcttggtgaaactgaagaatgttgctgaaattcttagagacggctctgcatgtagcccctctcccgacttttattaaagccttggccttccatgtgacttaactgatgcatgactcacagtcttttcctcatagagcacggatgtaatctgcccctctggttaacagctgtggtttcttcttgcagcatctgcctttgttggcacccttgcttttcagcatgcctgtggcagcacgagtcttccatcactgttaattgttgaaaagtgaaatctagatgcttcatattgattctactaaatgttggctttacagcaacttttctgcattttcatcaaatatctacaagctactcctttccctccactatactatagttcacactttatttaatcatgaaataccttagaagttctctatctcatgcatcctggtgaatcaacaaggcttagactatataaactgtttgttatttcctcgtgaatggcagcccgacacccttctagagaatactgaatgaagaaatcacttgtctttggagatggcatgtgctggaaaacagataccagagccatggggttgtcatttcccatcaggctccagcatcagaatctctaattcttcaaagacatcaatagacagctgtgctgcctcctgttttctcattgggtgttgtttctagttctgaccattctttttgatggaaaaatagataaggaagtattaaaatgtgagagcatattaaccagatttattcaacacaacttgaattgagtaatggcagtttctgaaaagttgtaaaaatgtgtttttaattttcatgttagaaaataaaacaacttgttcatttttatgtactctccaataggataattttgttatatatatatagtccatgtcataaaaacaaacataatggtctaacttatattatttttgcttattatctatacaaaccttatttttcatttattgtgcacaaattgatgaattatcttttattactattatttatatcttgtgagattttaggttgttagagaatatctactcatttttagcaaactaataatgatggattaaatgatgttggaagtctcttacaaaatcagaagtttgttctgatgtagtctactgttttcttttaagttgtttacagttctgtgacatttaaattatacattcagaaactttaccctaagaatgatggcatatgggacagtttgaagacctttataaaagttacaattttagttgaaataagtgaagatgattcttttatatttcttcagtcactgaaattgtactaatgttagcttatctaataccatctgatgctagagttgtacatgaattggtattgcctgtagttcatgtctgagcttcccttaacatgtacttcttcacccctacataatatttaatgaattcaattaaatgaatgacagcaagtctattaaagattctacctgaaaaataggaaaataagttttggaaggtgattatcacaatcttcttatgtggctacataggatttgagacttaacaatagctagataccaatttgcacaactgtggttatgctctgaccattttttcccttgatactggggatggaacccagaggctcatgcctgccagacaatcattctgctcttgacctacattcccagtttataagctgtaacttctaagccttgctggactgtggaaaggcaaggagctgaaggggtctgcaaccctataggtggaacaacaatatgaactaaccagtaccccagagctcttgactctagctgcatatgtatcaaaagatggcctagtcggccatcactgcaaagagaggcccattggtatagcaaactttatatgccccagtacagaggaacaccagggccaagaagtgggagtgggtgggtaagggagcagggtggggcggggggagggtatagggaactttcggaatagcatttgaaatttgaaatgtatataaagaaaaagttgtcaactagaaacagtgctcaaaagagggtcaaagatgtttttaatgagcatatatataattcgcaacaggccatggtagtttaagacattatatctaaacaaaggaggatgtttaaaacatttatgatgatataactttaggaatcattttaattactgtatcactttcataatgttaatgatctttctcacctagcaagaactaagctttcaaataatgcagagggtacatgatgtgtgatatattaaaaaaaacttcctgtccaaaaaaaaaaaaaaaaaaaaaaaaagaaaaagaaaagaaaagagaaaaaaaaaactatttggagacagttctcaataggcttttatgtttccatatctctttgttgtgaagcactgttttgtgtgtcagattctcttttcaaggatgtttgtatggtgagcagccttgcaagatgagcataactgcttccttcaatagcaaagatcagacgggcttgcatccttggaagaattctgttgtgtctctagggcaatgtgctaccacactgtccagtaaaataagaatacattccttaagacacagggaaggcatgcttactgctctaaatgatgtgggtattctcttatcacattcctcttataataagatgtaccacaatatgcacacctacattggctcagtaggattttaaagacaagtggaacaaatatcagtattttcttcatttcccgttgctggctgtgagttctaaagtctttcatttttcatacaggagcctcatgccttattctagcttccatacatagctttacaagtagttatgtacttacaagtagcataacatttcagactctttgtagtcccttcaataaactcagtggttctgtgtattgtgttatatgcctttagaataaattggtttacttagttttctttaatccttatttaatgaattgattaagaatattgaaacgctaataaaggcccattcattttaggagctaacaaggctgtatcttatctcagagcaaacaattgtgtattgataaaattaggaacagctgagggattatcatactgttgattactttctgggcctgactttgggacgtaagtaatactactgttcagtttcctgttataggaataagtctttgtgtatatgtttagaagagttactgtttctctgaccttgatttgtggttggaatcagaatacttgaaatgtgagacaggaggtcctattagtgggaggagaggaaaattacatagagatcattggctttgaagttgatttgagttcaaaagcccagtgctgtcattttttttttcctgtattggacatgtcattcaatctgtctttgcttcatatgtataataaggaatggtagctactgcatagaattagcataaggattagagataatctatgacaagtgcatggattctggtgtaatttatggtgtgtgtgtgtctcagtcttactgatatgaattttgaattctgactttaagtaatttatacattaatctatgtattaatcttatgttcctttaggcagaaaattctttccttcgttcttcctcctgcctacctttctgtctgtctcatgccattgtgttgtttgggttttactctaaatcatatgagctgaagatctatgattatatgatgctatctgatgatgatgaagatatgttccaacaatttatataaatattagacattttactagagagaaacatggtctgggcttcatatactagtaaggtactgtggtagtctgtaccactggatagcagtagactaaaaattactcatttctcttattttacagtttggtagtttgtatacttccactaaaaatatcagactataagtagcacaattagtgtgataatttctgaaaatctttttctgtactttggcaaaactactgctgatggaccaggcaatacgttgggcagcagatggacccatctgtgatgcttatggttgcagcttggaagatggctaacagacttccattccatctgacttcctcctcctttctccaattttcttggtctttgaagctaacagttatacaggacgccttttcgattagattatttcagaggctcgattagcatctctaaaaggctgtcagcgttttgtaaagagtgtcttgtaggaaggcaggaaacagtaaactgcaatctgtctgctgacttacagccagtaatggttgatatggcttatgtttagaaacgagacaaaggaaaagctgggtacttgttataatgtgataatgcctaaggatattaattaaatgaagtgtcaccttgaagcacaagaaaaaacacatagctatgcgttttttattatatgtgctgccaaataccacagtacgtagctattaaaatttttaaaggctttttacccaataattatagtaaatgattaatgtgagatctgtttgtttcctgtggtttctataaaaattatcataaacttagtggttcactgtagtagaacctgagtctgctatagtttggagatcaaaagtctgaagtgagttttatgagatgaaaatcaaggtttcagcgaggccctctaggaggctggaggggacattccatgtcttgttttctaactttaggtggcttctgaaactatctgtacatattactccaatggtggcttctctctttatgtggttttctcttcagtgtatctgtctagtttccttctgtctttccccttttccatttctgtgagaagtagtgtcaatatgtagttcagactgtctcaaatgtgtaccattggtctctgcttgctctgcctttttccttacaaagacatttaatctgcctttttccttacaaagacatttaatcaagtatagggcccacctagatgatctaagatatgtcattgtggcaagatttttaattatatttgcaaaatacttgccttttaaggtaatgcaggttctggtaattagacttgattaggtgtgaggactaccattcagtccacaatagaaagatgatttttaatgatgaaatgatgaacatctttatacttgtcgtttcccaagtccttactgctcccttaggaggtaccttttgaaactgttttaaatgaatctcaacaaggaatatatattaacagtttatattcttggttttgatgaaaaatttatttttctgtttatgtatttctatttttactggaactatgctgaaacaccaactttatggatatttcttgaaaatcatatgtgcattattgtgttattctagttccctgagtataaatgatgattaaatattttttactgttctgagactcttttattaggtaaataacccaagataaaattttaaaatcagtttagttttatgtatttcatctctgtaagtcagtctttactactttcaaggtaaccatgacatgttgttaagtgtgaaatagttcagagaattaagacctagattattttgtgttatttctgtgtttccttagtggtttagtattgttttggcagtgttcttttctcacccagtgcttagaaaggatgtttatactaatttacaatagaaaacacactagactagatttccttaattagggcctatgccatagttagggctttaatattatttccttatgctttgtaataatttcattcagttagagtaatcctgtaattttaactgtcttttagtaacaggaattcattcagataataatttatgaatataaatataattaaaatccagagaggcttatactattactttgtaatttaatatcttttgaaagaaaacaaacaaaatacatcatttaaaatgctattaaaatacgtaaaataatgtgttgctatcatttaaattattttttgtgtgacatattcattttttcatgatttaatccttttttacagttcaatcttcatccccctcctagtctgacccccctactgctccccatgctatacctccttccccaagcccaatccccctacgcacccctgtctctaagaggatgtccccaagcccaaccccaccccaccagacctccccactccctggggcctcaagggttaggtgcatcttctctcactgaagctagtcctctaccgtgtttggggcttcatatcagttggcgtatgctgcctggttggtggctcagtgtccgagagacactgggtgggtgtcctcagagtttcgggggtccaggttaattgagactgctggtcttcttacagggttgccctcctcagatagtccttgggaagaccaacatttggtattcaagtggggaaaaagagttaaagaaaccaagaggtgattgagattagtagacattcagaaaggtactcttctaggtcaaggaatgaaaatgtttccagataggtggagaggttaggtgtggttgaaaaatccatagtaaatttagttgtatagtggatttgtataaatctggccatgaaggaagaagaaagagactgaaagtaatgaggactcaggggatggttagggatgcgtttttattgttactatatatctaggtgtttacttgttactcaaacattgtttttattttttcagatctttccagaaatcgttttacagaaattccttcagatgtgtggctatttgcaccacttgaaacattaaacctatatcataattgcatcaaaaccattcctgaagccattaagaatttgcagatgttaacataccttaacatcaggtaagcaagcatacttttaaaaataaatcttgaaggtgctgaaaatttagctcagtagttaagaaaacagccttcttgtttcagaggaacagagtgtggtttccagaacccatatgttgacttataactatctttaagaccagtttcggggatccaatgattcctgacctcatcaggcatcaagaatacacatgatacacatacgtgaatgcagggaaatactcatatcatcatcaacaacaaaaataataataaagcaaatatgatgcattttattatatttaataacataaatattacatactagattagctataatacaaaatatatttttctatattaaaatagtatatattatatagtagtataatatgtaatatactaaaatatgtcatgtaaatataatttattattgtattattgtttaataagtaattaaaacaattttttaaatattacaatgctttatcgtgtttagtagtagaggaatgtattctgtttatgcttacattatcttgttggcttttgggattgttctttaaggcaatgtttgtcaaagtttcacacacaggaattgtctggggatcttgttaaaagattctgtcctgttagacctgctgtaggaactgcattttcgaaaaggtcccttgctgattcctctgccagcatgtgtgtttgtaattagatctcactttgagaagaggctttagaatataaatatttttttattatttgctgtccactcatctgaattgacttatataacactctggttagagtatagtgaaaaacgttttaggtgaagttttattactggtgatgttgccaattcaagaataggtagattgggatgggatagttggaaaatgagaggacagagcacctttatgattaatatgttttgtctttcagtgatggggatcaaccctgggtgttgtgggctaggcaagcattttgccaatgaatgacatttctagtcaactcatgcttaatttgtatttactgcatgccaggcaatatcccaagtatttgactcatattacttcatttaatactccaacatcattattgatatgtcttatattatacctataatacaaatgaggaaactgtgttgtttgaaaaagccatatattcatacagttgttctttggtgtctgtgggacaatgacattcaccccaaatactaatgtcaatcaatattcagtttccttacataaaatggcagagtgtatgaaggattatgagtgggacctaggacattacacatttcagaagtccttcgagattactaagtaaagatcattatccttcccttttgttacacacacacacacacacacacacacacacacacacacacaaaggacctctattttaaagccagtctagtatttctagatatactttgccaacataagatgtggtaaagggtcttttcttccctcctcattctttcttgaataacatgtagcttttattaatatatatcttatataaaacatgaggtacaggtctcttaatggcaattagaaaaataggggaaaaagtaaaattattgcttgtcagtgcctgctagtatataattggaatgttgtcttctctatattttgattgtgaggtacattgggtcaattgtctgaatttgatttttgactatagcacattaagggtaaagatacctgtgccagatagatctggtttcaaccatgactctcctgcttatcaactgtataacctgagaatgttttacttaccctctttgtagtatatttttcttttcaaaatgggactcatgatgagtgtcttcctaaagtagattgttgtgatagacagttgcgttatttcataagagctattctgaacatttactggcacatagtaagtattcaataaaatgttgttagccaagtggtggtggcagtagcacatgcctttaatcccagcactcagaaagcagagggagccagatctttggaaagcctgtctagacaatgtgtgtgtgtgtgtgtgtgtgtgtgtgtgtgtgtgtgtgtgtgtgtgtgtgtatgagtgcagtacatgtagagagtagaagatggtgtctgataccctggaaccggagttacaggagatggtaaattgacccccactaggtgctggaaactggatttggggatgcgtcaagagcagtcccacctgaaactgttggcccatctctccactttccaagctatcagtcttttaaaagataacttctttcttcatttcaagtacattttcctgggagccttaccatggttagggttatggaggcactaagtctgctaaaatttgtgctccagaagaaggttctggcattctctaatttgtgtttgaatcctttctataaactaggcaagttacttagtgcacttttgccttcagttttcattcttgtgacttgaagctaatattccctatttttttgagttaatgagcagattagacagagtgtgaaaagaatttgcatgctcttgttttaaaggaagtactcaataaatgtcactgaaagcttatgatttactactaagttgctttgtatttttttagataacattgagactcagacacatttttcataatgacactttattcttctttttttttttaaagtcgaaatcttctatcaacattgccaaaatacttatttgaccttccccttaaagttttggttgtcagcaataataaactcgtatccattcccgaagaaattggaaaattaaaagatttgatggagttggtgagttaaatattgttttaaattataacacacacacacatacacacatatatgtatatcacatataatatgtacctttttcttttggaattgtatgcattcttttgtggaatttcactgtaagttttttttttttaaggcataacttggtatatgtctaaattcaataggatagcaatctcagctacatttatttaggtctgattttagctcccagccaacaataacagaaacaaaagttcagtgattcctcagtctaagagactttaggaggcttggttatgttttcagacatatgtttcaagtgaatcactatttgttcattcactttgtggacagagaaggtcttaagcgatttccccctaaggtttacagagctgatgaggaggcttagagaagagtggtaaaggtagagaatacagctgtgggtatggtgctgcatgtatggagtctcggctcctagctactccagggaaagacagcatgatcatttgagcttatgcatttacacatcaagtcgggcaacctactgagtccccatttcatgaaaacaaacaaagggacaaataattggttctttttttattaggtattttcttcatttacatttccagtgctatcccaaaagtcccgataccctcccaccccactccccaacccacccactcccacttcttggccctggcgttcccctatactgaggcatataaagtttgtacgaccaatgggcctctctattcactgatggccgactaggccatcttctgatacatatgcagctagagacacgagctctggggggtactggttagttcatattgttgttccacctatagggttgcagatcccttcagctccttgggtactttctctagctcctccattgggggccctgtgatccatccaatagctgactatgagcatccacttctgtgtttgctaggtcccggcatagtctcacaagagacagctatatctgagtcctttcagcaaaatcttgctagtgtatgcaatggtgtcagcgtttggaggctgattatgggttggatccctggatatggcagtctctagatggtccgtcctttcatttcagctccaaactttgtctctgtaactccttccatgggtgttttgttcccaattctaagaaggggcaaagtatccacactttggtcttcattcttcttgagtttcataaattgtatcttatatcttgggtattctaagtatctgggctaatattcacttatcagtgactacatatcatgtgagcttttttgtgattaggttacctcactcaggatgatgccctccaggtccatccatttgcctaggaatttcataaattcattatttttaatagctgagtagtattccattgtgtaaatgcaccacattttctgtatccattcctcttttgagggacatctgggttctttccagcttctggctattataaataaggctgctatgaacatagtggagcatgtgtccttcttaccggttgggacatcttctggatatatgcccaggagaggtattgcgggatcctccggtagtactatgtccaattttctgaggaaccgccagactgatttccagagtggttgtacaagcttgcaatcccaccaacaatggaggagtgttcctctttctccacatcctcaccagcatctgctgtcacctgaatttttgatcttagccattctgactggtgtgaggtggaatctcagggttgttttgatttgcacttccctgatgattaaggatggtgaacattttttcaggtgcttctcagccattcggtattcctcaagtgagaattctttgttaagctctgcaccccacttttaacggggttatttgattttttggagtccaccttcttgagttctttatatctattggatattagtcccctatctgatttaggataggtaaagatcctttctcaatctgttggtggcctttttgtcttattgatggtgtcttttgccttacagaagctttgcaattttatgaggtcccatttgtcgattctcgatcttacagcacaaggcattgctgttctattcaggaatttttcccctgtgcccatatctatgaggttttcccccactttctcctctataagtttcagtgtctctggttttatgtggagttccttgatccacttagatttgaccttagtacaaggagataggaatggatcaattcgcattcttctacatgataaacgccagttgtgccagcaccatttgttgaaaatgctgtcttttttccactggatgattttagctcccttgtcaaagatcaagtgaccaaataattggttcttcaaaagcaaagaatatgatgcttacaaacaggagtagtagtgcattgttgcactgtgattggctgactccattttaattattttatgtatgtatgtatatatatgtatatctatgtatatatatatatatatacatgtatatgtatatatatatgtgtgtgtgtgtgtgtgtatttaaagaagcttctacagttgtagatttccacatgatttgtccccagaaggtatttagatgaatgccctttcaatcagggttacatttgtataaccttgagagactgcagactctggtcattttgagtagctttgagtgggatttggattactcagatccttgcttggaactttcatattcatatctcttttggaaaaaggaatttatttaaattttccttgactctggtgtctggttctctagctcacatctctgaatccttgactttttgaggtttttatcctcgtaaatagtctaaaactataataattgacagactactttagttggttgatagttatctatagtattttatcttaccttgaacatttggcttattgtaatttttgtggtgaaatttgctctttaattgagagttttacccttgtacttactaaatttaatctcagatactcacagaacaatttttattgacagtggtatattaagttatgatctaatacaaataaaaacccatcagagaggaaattagaagtaactttcttagcaatttggccatgtgctcaaagtttaaaattgaaagtatgtttgtatttctcaattttgatacactttattttcttgttttccttaggatgttagctgcaatgagattcaggtccttcctcaacaaatgggaaaattacattcacttaaagagctaaatataagaagaaataatcttcatgttttgccagatggtaagacagacagtcaccattttcactcacccgagtgatagaggaaccatacaacctttaacttttttttttcatttctgaacagaattaggagatctccccttggtcaagttggacttctcctgtaataaagtgactgagattcctgtttgctataggaaactgcatcatttacaagtaataattttggataacaatccattgcaagtaccaccggcacaggtttgtaacaagtgcatggttcttatttttctcagatgtttatggtttcatctgtgtattaaattttaaagtagtatcttatgactcaattttgtcttgtataaagcattacctagactttctataagaactgaaattttacatcttgttttgtttttgctttaagacaacatctcgtgtatacgtaggctggtctcaaagtttctcaatggtggatgaggatgacttttgatcctcctgctcctacctgtcagtgatggacttggaagcctgtgccaccatgccctgctagatgggactttttatttcaatttggtagtaattatagtgtagattacagataagcagttggaaaagctagaatcagcctttttgtgaatttgtagttctgattgtaaatattattttaagaagaaagattctgactgaatacattcaagtatacatttgcttgatatttgttgttggagtgatattataatgggtactgagatgtgggttggaatttgagttactctaggaaaattccatgctgggtgttaagatgaggttcctgctagaccaagattactttgcctgaggtaagacatctctcataaagaagactagtcacatatagcttccagcatattcttgtaactgagatagaattcatacagatagaaaaaatacaaatggaaaacattaaatttggattttaaaataataattattaaagccacaaggaatcccctaaaataataaagaataactaagatatatacccggaagggcaaagagaattcatgagaagcagacagcagaatgttgagaatgtaaaataggtgaaatggtggtaacttgtgcccccactcagaaggcagacgtttgcctgaggagcacaattcctacccgctccaagcttgggtctgtggtgtatgaagaagcatttgttggcttgtttgttttaatctttcaataatctcctcctcctcttcttcctcctcctcttcctcctcctcctcctccttctacagatttctttaatacaacatattgtgattatggttcttcacttaactctttccagtccttctcatctctccacccactgcaatctacattttcttgctctcattaaaaaacaaagaggcatctaaaataataaaacaagttaaaataaaaattaaaaatctggatagggccaatcaaaaaacccagataaacaaagaataaaagaaaaagcataagaaatatacgtaaatgtagagacatatatattaacacacagagaaatcacctaaaattacaaaatcagaaaccacaatatataagtaaaggactctacaataagaaaagaaaatgaaaaaaaaatatcctagacaaagaattatgaaacaaaaaccctccaaaaatactattaagtttattttgtgttggtgtctactgctagacatagagtctggccttcacagtggtttgtgtatccagtgagactatattagagaaactaagttttcatctgtgagtagttatcagttggagataacttttgggttagggatggggccttgtgtgtacagatctggaactttgcttggctcagaaacatgtgggtcctgtgtatactaacgcaatctctgtgaattcatatatgcattggtcccagtgtgcttagaaggccttatttccttagtgtccctcatcctgtctggctcttacaatctttccacctcctctcccacaaggttcctgtagttgtggctttctttaatcatccacatcaactgcaaaaaaaacctccaaaaacataaaaactctgaaaggaggcatgagagctcaacttatttgaatataaggatacatatttataatgttgctagaatctatactggtttaggatattggaagtagtagcttctcttttatattccatgtactcttccttttttaaaaaatatttatttattttatgtatacgagtacatactgttgctgtacagatatagttgtgagccttcatctggttgatgggaattgtatttaggacctctgctcattcaggccaaccccactctttccggttggctccacttgctcagtccctgctcacactggcccaaagatttatttattataaataagtacactgtagctgtcttcagacacaccagaagagggcatcagatctcattactggtgattgtgagccaccatgtggttgctgggatttgaactcaggaccatcagaagagcaagtcagtgctcttacccactgagccatctcaccagcccccatgccctcctcctttgtcatgaataattggctgtgtttatagtgccaagcaataactcccttctattaagtgaagtgactggtttttttttaacccctctaacgacataggttatctaacaaagcctagtttcaggcatgagagacttcctttcaagtttttggttggggacaccaaaaggaccccccccccaaaaacaatatatgctgtgtccagtgcccttagtgccttccagaaaaaaaggtaagattccattgctgaagacatcacatacatcatacactgggtttggaggaatccatctgaaattgaactggaagcatcagtgagaacttgcaatcatagtttcaggaggaaccatacatgcaagctgtcaatagatgaaaacaacagcttacccagatgtaacatcaatgaaccattacattgatcgacatggcaaggtattcttaaaggtgccacaatggcacgaatatcttggggtactaacactaacagttgataaatggacttgatgaaataaacagttttccgcgcaacaaaggacaccatcacttgtgtaaagagccagcatatagaatggggaaaaaaatcttcataagatttacctctgtgaaaaggtcagcctctagaatattaaaaacaaacaaaaaaacaaacaacccccccaaacaaacaaacaaacccttaaacaagaacctgaacatcatggaaacaaatgaacagttaaagttggagcatgacagtaaacacttaagtttcagaagaagagatacaaatacccaagaaatactttaagaatgttcactatcgtcaactatcagggaaattaaaattaggttgatatttcatcctacttacgttagaatggctattaaaacaaatcaaaacaaaacaaatcccccaaaaccctcaaaatcaagtgagcacaagtgcttgcaaggatgtgcatgaaggaaatgcatagaaacttagtgagagtacaaaatgatgcaaactctatggaaattggtgtctcaattcctcaaaaagctagaaatagatctgccacacaactcagccatatcactcctgggcatattcccaaaggattctatacccttcaacacagacacttggcctcccatgttcactggataaagaaagcagcctagatgtccatcaactgaagaatggataatgaaagcatgtcacatgtactcagtgaaagttctcttataaagaacaaggaaattctcagataaatggttggagctggaaataattatccctgctgaggtagtccagacacaaagaattgctttgtgtttcctctcacatgtggatgacactttagaagtgtatgttctaattggagtacccgtagaagtcaggaagccagtaaggactactaagggactagtaagaagccataggaagacagtttcaaggagtcctgaatagaagacaggtgggaggagacaggaagaaaaatcatggactaagtgttaaatgaagggggcagtggaagggcaggaggctggctcttctccattgtgtattgttagcttctttgtaaaaaaaataaatacataaaataaaatctggctttgtatatctgcatctgtattggtcaggctctggcagagcctcacaaggaacagccatactgggctccaatcagtaagcactttctggatcagcaatagtgtctgggtttggtatctgcagatggctacatccctaggtggggcagtctctggatggcttttccttcaggctctgctccactcttagtacctgcatttcctttcgatgggaggaattctgggttaatatttttgagagcagggaccccagtggggaagttagggcaagcatgtagaggctgaaggggtttgcagccccataggaggaacaacaatatgaaccaaccggaacccccagaactcccagggattaaacaaccaaccaaagaaaacacatagtgggactcatggctccagttgcatatgtagcacaggatggccttgttggacatcagtaggaggagtggcccttggtcctgagaaggcttgatgacccaggatagaggagcacaaggcctctgaggcaggaatgggtgggtgggtgggagagcaccctcctagagacagggggaggaagaagggggtaggaggcttgtggaggggaaactgggaaggaggataacatttgaaatgtaaataaaataatcaataaaaatgtgaaaaaaatctggtagctataggaaggtgggtttgtatgcatcatctatcaacatgtctgtttctatacaagtataatgctgattcattactattattcaataatataaattgaaatcagggatcatgattcttccagcactgttttcaatgttaagaattgtttttgctgtcctagctcctttttaatttgctatacttactttataatagtgcttagtctctctgtttttaacctctgcgtcctatttcaccatctcccttctccttccccttctccttgccctctctctgtgtgtgtttatttgtaagtgtgggtgtgcacatgccatagtagaaatgtagtggtcagaggacaatctcatgtgctcaggtgttggaccttatttttcacttgtttgaagaaggatttcttgttttctctctgcatatgtgagactaactcactgccagttttaggagtttcctctctccacattctgtcttgtcttaagagtgttaggattacagtgggggggggggtgctatatttttgttgttgttgttttataatgtggatttaaggaatcaaacataggtcatcatgcttttgtggcaagcacttgtgagtcatatctttagccagcaaaccttctttgtagatttcctctcttaacattggttttttgtatgagcaacagacatattttctccgagcattttcctagttgaactttattccaactgcattgctattatgatttttatttgtttattgtttttatttgtttctttgttcgtttttgagacagggtatctttgtgtagccctggatgtcctagaacttgctctgtactgagtgtttgaaataaaggcctatgccatcactgcctagcactttattttttaaatttgatttattacctacttatgccgtctttattagtctttctcacattttatatcatgcttttggtttggatgagattatatatgtatattttccctgttctcactagtccagtgaatagtatgtttttaatttttctaataaagacattgtggtatagatcttttagtgttcagtagtttgttcattttacttttaataagaaaatgtgagtgaaatatagaaatatgggctagagatgtagatcatcagttaagaacaatttctgctctttcagagaccccagattcagtttccagcacatgaagaaaaaaaaaaaaacactccagttccagcatctcccacaccctcttatggcttccatggtcatcagctatgcatgtggtacatttacatacatgcaggcaaacatgcatatacataaagtaaaaataaatacatttttataaaaggaaattgtttattttaaaaacaatatacacagagatcgcacaggtctaagccagataggacctgtggcgagaggatccagatacaagccccatcctaactcaggagctactttcaactgacaaccacttgcaaaggagaatttactttttatctatggattttcactgggtatgcaaaccacagtagatggccaaaataaaatgaactcaactgtatttttgaaagcttatttttaaattgtctcatgatttgtctgagctattttttaactcttatagaatttttgtttatatattgtggtttccaattttggttttattggttttatgagaatgaagcatgcatgtcagcatctttatgtgttttttgtccattttctttgtttttttctatttagtttataatcttttgtaataataataaatacataaataaatgataaataaaaagagtgtgggtttggaagtggagaggatcttggttgaattagggaaaaacatgatcagaatgtattgtttaaaaagatctattttcaattagaagaaaagaaaaactgactgcattagtaactaataaaaattaacatagaatactttttgataagatgatagcagattttgttacagtattgtcacattttcctgtcttgctccacacacttaattcatgaaaattctggttgtgataccttagcataatttgagattatttcaatatataaatcacttgatagtgtcccattttatttgcaattatggaacagagagatcgctcagcagttaagtgcacttcctctttatgaagagtacccgactttgtttcccagtacacatataggggctcataaccatctatacctaattccaggcatcctatgtcctcttctgcactctgtcatatggcgtgcacatggtgtacattcttaccggcaaagcattcagacacataaaaataaatatttgaatttaaatttgttactaaatactttacttttttgtttgcttacagatatgcttaaagggtaaagtacacatatttaagtacttaaatatacaagcttgttgtagaatggataagaaaccagactccctggatctcccatcactgaataaaagaatgccttctcagcctcttacagacaggtaacataactagtcttacagcttcagacaatgattgtgcttgttgttataaaagaaatttatcattcatgaggatactgaatatatttagcctgattaaatcagtgtttaaaaaagtcattgaattttttttcatttaataacctctgtgatgctgaacaaaatgtgagatttttctttaggtagttattattttagtacaaaatgtaaatattttacagtataagttccagcatttacagtataagtaacagcatcctctctgtgacagctgttaacctaattttgatcaccatattaataatacttgtaatggctagttggattagtctgtaaaccgactttgagagaagaggatgttattttggaggtgcctttcacccttatgctaatgatcttttctttttccaatgttgaattttcaatctaaacaagtgctctatcgctgaaccacaaccccagccgtgtgtgtgtgtgtgtgtgtgtgtgtgtgtgtgtgtgtgtgtgtgtgtgagagagagagagagagagagagagagagagagagagagagagagagagaatatgttttctttttctggagtactgggagttcagtccagagcgtgttttatactagacaagtgccctaacattcagctatacctctttatcttctggtcaaaaatgatatattattggcctttgattgtgctttaatctttaggacattttaatatggtagataaattgttcttttaagatgtagattggtctgaaaacctttttcaaaaatacaattccatccagaaatatggaaaataacatggagtgggggtaagacgacagaaagggtgactgtgaccacctaaaatatttaaaggtttgtcattgatttatatgataaatttgatgttttggatgacattgtagtaagtactgctattagcagtaaaggacttgaattcccaaatagcaccttcccatgaatctttctcttgccgccataaaatatttatgtattatattaattcctaaattgtattttggttattattagtagtacagaaactataatattctattgaagttaggattggtatctatactaatctctattaatatgcttattatttttgcagatgagatactttattattaatggtgttcttttcccccagtcatttgtgatatccatagctgttgattgcctactgttagactcaggatgtattgtgttgagagctgtacatgttggtcttggcatctcgtggacctcacagtctaggtggaagaaacagtgaagaaacaaaacaaggaaacaaataagagttcagttcactttgcactgctgtacttttaagtagtagacatttttgtggctcatagttttggagactgattaagtccaagataggggaggaataatcagtgacatgtcaaaaggtaacagatgaggaaaagaacttgagagatgtgaacatgaagtcaaatttactcctgtggcaaatctatttccaggacaagaaagtaactactacaatagaaaggttaatctcttcaaagactgtactcttatgagcaaaccccttactagaccccacaagctgatgcttttgcatcaggaattaagtttacaacacactcagacagtagcatgcctatttccttccccttactctcctccccttctccctcccctccttccccctctttcacatgcacagtcacaagtgttgcctgccatatgatgtttcatgttaccatttttcaagtattccatggtacttaagttacatgcagtcagcagaaaccattcttgagttctgaattctcatcttttctggggatgccaatatgtagtatgagcctctgcctcctgagtgctgaaattaaaggcacatggcaccaccaaccagcaacgttgaagatttttagtgtgttttgttttgttttgttttgttttgttttgttttgttttgttttgttaagacaaggtttcaccctctggactcgatgtaaaccagtatagtctgttattctgaggatcctccagttatgtcttttaagctataggctggtgccgcctggcctgcaatcacccttaaatgacatgaataaaatatttgataggattttttttttttggtatttcctcttttaagaatgtttgatatcaaaactatttattttgcattatctagggacagtttagctcaatttgctttctgtatttaagaaaaaaaaattctagctgctcaaagtatttgtctttctgcagcatggaagatttttatccaaacaaaaatcatggccctgactctggaatcggaagtgataatggagaaaagcgattgtctacaacagaagtgagatttttctcttgctggcctgtgttgttttcctatttcttagagctttaaaaaaagaggcacttcagggccaagaagtgggagtgggtgggtaggggagtgggggggggagggtatgggggacttttgggatagcatttgaaatgtaaatgaagaaaatacctaatttaaaaaaatttggaaatgaaaaaaaaatataaaaccttccaaataattgcttggaggaaaaaaaaaagaggcacttaaatgcattggattttacttttacaggcagatataattttgttatatattttatgacttcaaaagaaggaatacctactgattttttaaagtaaaacattcattgtaacatggatttttggttggaaatctggagatgtagagcagatattttgtaattcctatttaatcaaagaagcaaaagcttccttgagtgttccaaatacgtcatttatactgtgtacttgttcctttcagccatcagacgatgacacaatcagccttcactctcaagtctcagaatcaaatagagagcaaacatcaagaaatgacagtcatataacaggaagcaagcctgattctcagaaaggtaattcttgtggtgtctcttaggtttaactcatttacacagcccatattaaaaatgatatttttatttgaagtggactttgaagacttataaggttataagatatagcttatattgaaaaggtgagcttttatcttgagaactaaaataagtagaacatctataatgtcttgtaatattaatctatacctagaccaggaggtgtatgattttattgatcccaacacggaagacgtagcagttcctgaagaaggagatacacatattggatcatttgtttctttccttaaggtaaataag

SEQ ID NO: 692 - DNA, 2599 bp, mus musculus
aatcagcgagagcatgtgcaaaaggcactaaaagccctcctctggtggcgaggcttgtgcaagatggctgcggcagttcggagcgtgaaggtagactgctctgtgcctctaacctttgtttttatgcaggctaggactgcgcgggcaggaacaagagaggagatatcggtgcatggagaacgcgtggttttgcggtggttgggctcaatcggtgaacaagcaatgttcaactacatctgtgtgtgaggggtcacagaaaaaacattcctgggatgagacacgcccccgccccccaagtttcgtcgctgggggagaggaagcacatttaggtcactgaccgtccccgcttcttcttcgcagaactctagaattggcaaatgaaaaggtggggagtggtctggataatagcagtttacctagtaccttttcacagggcttggtcgcggtagtaactggaggagcctcgggccttggcctagctacggccaaaagactggtgggacaaggggccacagctgtacttctggatgtacctgactcagagggtgaagcccaagccaagaagttaggagaaagctgcatatttgccccagcaaatgtgagtcgtgactctcctcgtgcacgaggaaacttggggattccttccgtaagagtggtatctggggtcggtcagatggcttagtggttaaaggcacaggatgccatccatgacacccccgtttgatccctgggaaccacatggtataaggaaagatccaactctgacctccacacgtgtgccctggcaggaacattcctgcacacacacacacacacacacataaacggaaggcgggggggggggggtggggggtggggggtggggtgggggggagcggggcggggcgggactcatttccttttagctttggactggagtcttggatactgtgagagccctgcagtaagaaagctaaagccgggctcagcactatggggatgagaggattggacacaccaggatttcctggagaagatatgttcagttggaatgcatatcttgcccagacattttacatttacagagttaaaaaacttcaactcagcaggtagggattttttttttcttttaatgctaggtcatgttcctgttattttcagaactgatcgtattggagtacagcttggtggcagagttcttgcctagcatgtgggaggcacctgggtttagtcatcagtacttgcaagagaaaaaaaccagaagtgtttatagtgccctgatctgtattaactgagaataacccgaggcatatgaatcaagagaatacagattgggaaatgttttgcaacactcttctatagtatctaccatttcccctttcatcttcatttgttttattacaactctttcttgcccacccccctttgctcacacagttctgttcccacccaagatctgggtctgtcttcctctccaggtttagtggtgtgtgtatggtaggaaagaaatacctctccttcatctcttcctgtctaggtgacctctgagaaggagatacaagcagctttgactctagcaaaagaaaagtttggccgtatagatgtggctgtcaactgtgcaggtattgcagtggccattaagacataccaccaaaagaagaacaagatccatactttggaggacttccagcgggttatcaatgtaaggccttggcagatctccacggggaggataaagggggtgtggcagtgaatattcccaaagcgtgtaaggaaacaaaaggcagcctctgtcctagatcctacatcatggttctaccatcctccaggtgaatcttataggcactttcaatgtgatccgcctggttgctggggagatgggccagaatgaaccagaccagggaggccaacgtggagttatcattaacactgccagtgtggctgcctttgagggccaggtatgtgaacggaggagggaagctcttagctgaatgacttttgggggatctcccacatatgttctccactctttttccaggttggacaagctgcatactctgcatccaaagggggcatagtgggcatgacactgcccattgctcgagatctggctcctacaggcatccgtgtggtaacaattgctccaggtagacatttctctttcttacctttttgctatactaggactgggtgggacctgtaggcagatgagagaaggtgtccactccctaaatgtagcagcttagcactaaagtgaggaagaaccaagtaactgaaaagaagactgaacctctgattctggtactcttgtccaggtttgtttgccaccccactgcttaccacccttccagagaaagtgcgaaacttcttggccagccaggtacccttccccagccgactaggtgaccccgctgaatatgctcatctggtacagaccataatcgagaacccattcttgaatggagaggtcatccggctggatggggccattcgaatgcagccttaaagggccaaggcaggagaaacaccagctccttttcaatttgaaggaaagctaacagccactttgtaactctgctccactcaccctcggtgcctaataaattctcaaacttccaag

SEQ ID NO: 693 - DNA, 160171 bp, mus musculus; identical to SEQ ID NO: 114

SEQ ID NO: 694 - DNA, 146709 bp, mus musculus; identical to SEQ ID NO: 115

SEQ ID NO: 695 - DNA, 36551 bp, mus musculus
gcgcggtcctgcgggagtgcctcccactcgcgttggagtccctgccctgggccggtgttttcctatatgtttcgaccaatcgttggcgtcttttcctcctttctttttaggaaggcgccgggtgtgcagcactaaccgctgcgaggaggggatcctctggcgctgtctccttgtgggtcttcactgactccccctctctctctctcaactttgcgttcaagtcgtgatctaaggtttgggtgctttgctgggaccccgcccgtgctctctaggcgagggtttgaggagttctgaggtgggtggagaatgggcttggccggaactgaatcggttgaggtaaaaggggaacgcaggagcttcagcgctggccacttcgccccggagaagccgctgtatttttagcacagggaaggctgcagtgggaggattctttttaggaagtcggctccaccgccccgattcggggcttggatgcttgaaagctttgtttcccttgttctgagggtggcccagctgggtctaaatcgactccctccctttttcgttttccctatccttttccagcctggagaaaacagggaggtgggggaccaaggaagagaaggctaaagcgtgttaccaggcgcgctgtcagacatgggcgggtgcaaggggaacagctgccttgagatcagctctggagtatgagtctctgagaggactgcgtgagctccggacacttcaggagtcggcagcggctggaggcataggcggtaagtgacttgggaaaggaccactctttcagtcttcagtcagggttctaatccccgcaccccgcgtgccaaccgcacacacccacttggctttgggttttagcagtgaagtgggatgggggagacgagtaagcggaagggggtaagaacattatgtggaatcaaattcaactcaatggaaaaagacttcccttaaggatcgcggagactaagaggaagggtacttcagggggggcttgtggaagaattgaaaagggacacgaatggataggtatgtctagttcagtctgtcctgtctaggtgctctcaaccctccttaagtggtacggtttgttttaaccctgtacatgcaaagtctctgtgcgagagaagaggatttggaggagcactgaacccacttacgtcaccccctcccttcccccaagcagtagcaggtacctagagatgcttctaaaacgagggaggaggggaagggaagagttaagttgggagcctgccctctaggtactgatagcagatcccttctgtggaggagctgcttaggacatgcccctctttaagggggggggtcgtccccttggttgggggaggaagccaaagcatagccctgtctaggctcttaaggatgtggccaaggggttagctcctgtaggtggaagatcagccagaattgctgtgactactggagcaaagggacttgcttagccacaaagtgaagctttttgtactttttttgaccctaagaattttgtagaaactaaaccatgtcgtaacaggtggccaggggaacagtaccttattttctctatattgtaattgcgggaaaaatttataaagtacttgtatgtcatttagcataatagtgatggagaaaagagaaaaagagactcatctctagacttggatttaacctgaagatggtttgtgataataaaaagatctactttgaaacccttctaccagcatgaactagttatatgaccatgcaccgtgcttttctcctctgagggatgcatattaaaattcttattcagaaggtatatatgatacaggctgctccaactcgccgttcttcatgttttcttactctggggttttctctggctcactgctgatagacttcgtacttcattgtccttaaagcacatttcagatgaaggggaaagaaggcctgtgcagtttgaatcgcttgctcaaagacaggctagaatatatgccttatttgtttgtgatttaacattgttctccctggctgcaagagaaaaggccactaatctgtctatcttctgattctttggttggtttaaccacgatgatgtaaccagcaagacctttgaacagcaaaccagtggctcacaagtgacttcgtcctcttcttcaaagtctggggggaacccttatgagagagaccatccttggaaactgttggtgagacaggctaggcacagtgcctttaggttagcttagaggacagataggcaaaggatgcaggaagggtggaaatccaacttcaaatgtgtaagtgataaatataactacccagcctgtcctcaagaccaaattgcataaaagctctgcgctcatagaaagaaccctcttgctttcagagcatacaggataaaaaaaaattggtgggaaaaaatgttcagggcagccaccctcatttttgtagtgtgtgtatttcagagatgaggctcttagtggttcctgctggttgcttttttgttttgttttgttttgttttgtttttgaaatttccagggtatgaagcctagctattattagtcttcagggtgcctgtttctcatgtgaaggaggtgggtcttgacgactcatccgtttcgactctgccaggggcttattaatgtttgttacatttagatgttttctttattctcatattttattattattatttacgtgtttttttgtacgcatataaagtaaatgctgcatgtgtgaagaagctagaattatgggtaattgtgagctgcccaacatggatgctgggaatagaacctgggtcctctggaagagcaaaaagtgctcttaacctgtagctatcactccagccctgtgcatttatttatatgtttgccttagtttggagtcagttgtactttatgggctcacttaaattgttgaatgaaggaaaaatgccttcttaatacagaattcatttagcaaaatggcatactggatgttaggtactgaggggaaaaggtgtctccccacgccctcccccccagtagacattgaaaccaggagctggtgtattattggagtttttaaaaatggcaacagggtgtagtagaactggccttgaactctctcaattctcctctctcaacctcctgagtgctccagttatcatcagcatgaactgttataactactgagaagttttaaagcttgctttctgtttgaattcttttctttatcctccaaccagatttgtattcttatttaagtcctgctgatgtccctgtcctccacagatcttccttatctcctcagctattatcagattgtcttcatatgttctataagacaaataaactgtcttataatatgcttgtttttatgtgtgtcctgataagtatttatagcattccatccatctctcattcctacctaaaatgcgttactatgaaaactttattttcttttgcatctgtaaatattagtttgaagaactacatgattgttcctgaattttctaggaccttgatcattgcctgctgcattttggcttagttgtgtttataactaagcccccagtcccctttgagactcagagctagttgatgacgctccataccattgcggcttcataccacttacctttcccttacatcctttcctttgcaaacacttggtacatattttgtgagatgatgatctaaggtcttactccttgtttagtttttcagtgcagcccttgctgtcctggaacttgctttatagacccgggctggtttcagaactcacagatttgactgcctctgagtctggagtcctgggcttaaaagcattcgctaccactggtcctgtataaggtcttactctaactaaactgctttttggtaagtgaaaagaaactgatcagtgtagttgacctaattgatcagctgttcagttttctttttagcttacatatggatatcatttgtttcaattttataagtagaagttagatttctgatctgtttatgaaccataatttaactttatcccctagcctcgttcctaatttcaaaaatgatatggtacattatagttataaataatatattgaaatgaaggattttactggttttgcaattttgagtgtgttgtttactttttttttttaacagcaagtattaacaggtttctttttttttttaagatttatttatttattatatgtaagtacactgcagctgtcttcagacactccagaagagggagtcagatctcgttacggatggttgtgagccaccatgtggttgctgggatttgaactcctgaccttcggaagagcagtcgggtgctcttacccactgagccatctcaccagcccgtgttgtttactttttaacgtcattgtgtatctgaaggggaaaaatgtaaattattggtctggaagttagttataaatctctagaacgtgctacatgctctgtatcatatactaaaaatgttaactgtgtatttagattttttaaagtacaatgtggattttttttttggctgtgctaggaatgaaatttaagggtcttgtatatgccagaagtattttgccgatgaactacatccctagcctatgagagtttgaaggtacaatcgtgtaactctagtacttgctaagatatttcaaacatgccttctgataggggtagcggcatgccattaatcccaaaactccaccagaggcacaggcaggcagatctttgagttctaggataatcagttctccacagaaaaaccctgtctcaaaaacaaacaacaaaaccactcacattttgacattttgttttaaccaccagcttaccatttctgaaatagaacctattttttttttaccactagacttaccatggctcattcaacacttttccccttttcatttccttgtttctacaacttgccattatgataaccttggcgaagttacttaaactatgcatgtgagtgttctctgtgaaccagagatggtagtacaaactacttccgtggcattgaggaacataattgctttaatcttatgaaaacactttcagaatttatgaaagtatagtaagcagtgaaaaaaaatgtagttttagttgtgtttctcatatcttatgaacaatatacagccttatctgtctttcattattctcaaaattgccacaaccttaatttaggccagaggcttaaataattaccttatataccagttacaactcacataaatgttttatttttcctaaaaattttaaatgctcattgaacagattatttattttattttattttatttttttttaatttttttttttaagatttatttattattatatgtaagtacactgtagctgtcttcagacacaccagaagagggagtcagattttcttacggatggttgtgagccaccatgtggttgctgggatttgaactctggaccttcggaagagcagtcgggtgctcttacccactgagccatctcaccagcccttattttattttcttaatggacgtattttaaattggtaatgttccgtatggtccaagacctgatgtataaacaaaaggctatatggtgaaaattcttcctcttgttcatggccatttgttacttcttcttcctcaccagaggcaactaaaattactagtttttatgattctttgtggagatatttgaggtatagcaaataattaatacacatgtatatattattcaacatttttattcttttttattttttaatctgaagtcctttttaaaattttttgtttttatacattttaattaaaatataatcatatcagcttttttgcctttctgtacatgcttatttgcctttttaacccattaattttttaaaatttatttttgagagtgtaattgaattatatctcttcctttttacacacaaatactaacacatcctgcagtattgttctactgtttgttcttcctacttaaaaatctacttgggagatacttccccataggttcacaacaatgcctcgttattcttttcgactgtataggttttaactagatcgttaaggctttattgagccagttttctattgatcaacatttaggatatttgaaatttctgtagtgtgtctaataggaatgaaaactcttatgtagtatatataaggctgttataatgaaatctcactaactgggtgctttaaacaacagaagttctggttttttagttgcaggggctagaatttagggatcagggtctcagcatagccatatatatgtactgcgatggctgctttcctacctcacattgctgtattcttggctgtctattttgtgtaagtgaagagatggagaagcctcctgtgtttcttcttacgggatttctcttttgtgattagcgtgctacctagatgacctcatttactttgaattatttccataaaggccatatatctataaacaagtcacctcaggagtgacagcttccacatacaaattgggggcaggggggcatcaacccactttgtctaatctcatgatcctaaaaattggccagttgccaacattttaaagttggatttcatttaaagtctagattccattttctccaataattattagatgaaagaatatggtaaggttttatacaatattgcagatcgtggcgcacgcctttaatcccagcacttgggaggcagaggcaggcagatttctgagttcgaggccagcctggtctacaaagtgagttccaggacagccagggctatacagagaaaccctgtctagaaaacccaacccccccctcaaaaaaaatcaaaaccccacaatattacagatcaatgagtctttgcagctgtggcgtttcattctttttctcaactggaacttaactgctgtgtgccagttgcattcactgcacattttgtcttatgattcataccacaattagtgggcacctttaccctctttatcaataaccgagcttattgtgaggtacgaaagtacctctattatcgttttcaactttaccaaactattccagagtgcagggctgtatctttttcatctaaaaaaattatttttgagaattttatacaggtttatagtagaatatgatcatatccacctctcattttcctacttccaatttgcctccatctgttacccactcaacttcattttttccttttcctttttaaaaaaccaactctctaaggctaaggaacggctactacccatttgtgcatgcatgtggagccatctactggagggagcatgtgcaacctactgatggccacacccacaaagaatgctcagcctcagcaactgtagcttctgacaggccgagccttgtgggcttctccattcacactggacgttctagcaggtcatgagtgggataactagatcatgtttagaagaaagtattcaaatatgttcgggtacatcaaacctggactcagatcccagcccgacgaccatttctatcttacatggctttagcattgcttgatctctctgactgaccctgtactcctttgtgtgtatacggcatcaacagtagtacgtgttttattcttgtataaaagaaaatggggcctagagccaccatgagaaagaggagaggacaaaatggacgaaacccctcgaggctatgctactggccacctacatgactggaacttgttgaagtgacactgcagaacttcaacctctgggattgttaagatgaactgataaaaaaataatgataggtgtcgtgctagtaactggtttggatttttacaaggcgactatacttttgtaccttttgtgatttttatttttttcttctgacggaagtacacagattaaaggagtaatccttaaaacttacctggagatttttataattgctttgtgcaaattccatgtgtcattatgatatatcttcttgacaaccatatgtggggtaggttaaactcacatatctgtattttgtacagaagaagatccaggtgtatagaaagggtcaacgagtctcccaaagtcacattcattgtctcttcatttcttttcacaatgcttcactacttgaaatgtaggaagctaccatatgttagcaatctcattttccacactaacattcacccatgatatatatcgtcagcttcactatttgtcagaagagagaacggaatgatatctactcaagattctcttgaacaattaggttgttatcttaaaattaatatccttttatgaaacatttttcttttttaaaaagaaggtatcattagatttggggtatcataaagtaataaagtatattgtaattggactcaaaggacaaaagttctattaattcagtcctcctaaactctgtgagctcaggcctccaagttcattatctgtgcaatgtaatggaaattatatgaagttgttcctttacctattgtaatgttatataggtgcatatgtgattctttccattgtccaaatgctctatcctcctaaggaactaggttcttattaagcctgccagtgtcagtgatcagtggtcacagtgcacctggtctcattatgttgtcctgactgacccagacttttttgtgtagaccaggctagcctcaaactcatagagatccagttccctaaagcctgcaccaccatgcctggcccagttgaggcattctcaaatgtcagatagcctctgtatgcccttcgactaaaaaaattgtaatagacagggcaagtaagacttgactggctttttaaatttaccattagaacttttaaaggtgggcatggcctttaaattttgaagatgaagttctgtgtatgcctctacctgcattccactctgctaaatgggaggggtacagagaggagcatgactagggaatagggaaaatctgtgctaggtgttggtaaataaacacttgtatacttatttacttaagaaatcctacaataatctatgtgctggttattgttacaaggagttcagaaaccagaaactcttgccccattttttttttttttttactattacagaattttgagctggtaatggtggcacttgttaataatccaaacacttcagaagctaaggcagggggtggtgttatgagttctgggataacctgggctacagcacactgagagcctgtccaaaacaagatgcagtatgaagagggtggtttgaatatttgcagccaagatacagcaacacaaaacagaaaaaaaaaaagaatttaaaatcaattattttatctattgaaagtcaagaactgaagaaaccattcctagttgaaaaagccgtaattctcaaggacacttctttacaaaattaaaggaagaatttagagaattttgacagttgaaaccaattgtttccagtttcatttgaaaattcagaggctatactaggcaaaatactaccagtttagactctggttgagtcaagcatatatatatatatatatatatatatatatatgtatatgtatatgtatatgtatatgtatatgtatatgtatatgtatatgtatatgtatatatatataggcacaaagaaaacgcagcagagagtattgattttagagttagatgctcatgagtcacattgtataactggaaaaagtgtttttctttgtccaactcaacttgtccatctagaattataggattttacattatcatttgcagagccctactgcttctatagagcctcccagggatagggccatggaggaaaatacatactaaggaataagaacagttagggccagatgaaagagaactttgacatctacctgaatttaagcgcttacccctgcatgtcttctaaggcccgagaacattgtctgaaattatggtagatattcaacaaatttttgaatgtttatcagggtagttacaaaaaacgcaaggagtcaggtgtggtatttacctgcacttgggtgggtaaggcaggaggattgcttgtgtttgagaccaggctgtggtacaggcaagttccaggcagtgtaaaacattatcttgatctcacagaaagaaagggggagtaaagaagggaggggggctttttttgaaattaagaacaagaattgggaaaatgtacggaaccatgagaaaaaattgaagaggttatgtatgaaacacacaagtggcgtcgttaacatgaagtgagacgtgttacaaggaatagctgtttccaattcctaagttgggaaaggaggtgagttgggaaaggaggtgagatggcaggggaaaaaaaaaatccctgttcggtcagacaattctcttataatccagaggggggcgctcaatagctagaagagcttgattgttgccaggaaaacctgtaggagtgtcacaaagtttatttcctttgcagtcatactgtccttgacaaatcgttattctagtgaggacaaattacaagtcatctactgtctggtcttcggttcctaagggttaaaaccaggcagggtagaggaagcataaatgaaatctgaagtccgactagttagtttgtaggtaaactgtagatttgggtttgtatccctaacctcttttcgtctctgctgaaattgaactgtgataaacaaaacctgttgcagaggaaaacataggtactttttatgaggtgattcaaaatatttgaatgaagctactagtgccatctctttgtaagaggggcagctatttatagaggaaggtgaaaactgattttaactatgcttagcttatagatttaagatgtgtagacaaaagtggtctgttggttggctttgtacatatactgctctggtcgatatccatacagcactttaaaagtccttagcaaaaaacaagaactggaccagaaatggaaaggttttaaaaccatagaactattttgataattaccataattggacaggtcagagtggctggattcacttagatgaaggaagggaaggacttatatataggaagtaggcaactagagtctgagacaaatgatgatcttttctatgagtagatcaactcagaatgttttaatgactttctagtataaagtttgtctgaaaagctgttcatagaggacataaggtaaaacgaagtgtacatgtcatactctatgcctatattgggttcaatattttaaaaactattttccccttgtatcttttctagatatggataaattcatagacaacatggatgtccgaattaaatcagaaagtggttcgatgcaggtattcaaacaggtgagctttgtgtgttggatatccatctcttagacattagagaactgaagctccattttcaaatgacatggataggaaatgagaagggataaaggaaggtagattttcccagaatgatttgaatgtctggttgtgagttccaactaaggggtctgcctaaccttgaagaaacagcttcataatgttcctacagtctttagtgaagagccatcaccatttatttagcactgtcccatatttttggtatggtgaaaattgtgtgctttgttttatttaatgttgttggtagccttgctgaacagcgtattaggttctctctaaggaaacatcctcttgaccctatttccttgttaattgttttcctggagaaccctggctagtacactacttttggtgagtggtgagtagtgtgtggtgtggtgtgtgtgtgtgtgtgtgtctgtgtgtgtgtatgtatatatgggttatagacttgtgccaccacgtttgtttttatatgtggtggcacaagtctataatccctacaataagcagattgagccaggaaaatgggtatttctagcccaccctgggctactaaggagatcctgtccaaaacaaaatagacagaccgacaaaacagaaggaacaaagcaattccaactttcaatgtgaaaactggtcttggtgtcctagtttgcttcttctgtgctgtgataaacagcatgaccaaaaaagctactttcggaggaaagggtttatttgtttatagttcacaatcaaagaagatcaagggaggaatttgaaggcaggaatccgaggccactgagaaaacactacttgcttcttttcccttgctttgcttataacccaggcctcacctggcccctcccaaatcaatcattaagaaatgctcccactaactgctcacagggcagtctggtggggagaatttctcagttggaatttcatcttcccaggtatgtctgtgaggcttagtctttgttttatgaaggtctttaattattgattgaagcctctgcactttatgtgactggctaattccaacagtgatgtaaagtacttgctttattgaggggtaaaaagaagctggttgtggtatcccacgccttaacagtcaggaggtagcagcaatcagatctctatgagttcaaggccagcctagaccacatatcaagcaccatagtgagaccctgtctcaaaaaaaaaaattgaaaacatctagaaaaacgtttaaccagccacctgacactatagtcctgctaaattgtcacagaatattaacttatcactagtctcattgttcacgttttacagaaaagaaaactggttttaaatgatgtgaacaagtgtttgtttttgagataggctcttactattccatagaccaggctgggctggaacttgctgtataactttgggctcatagcaaaccctcaaactcatagcaaacctcctgccagactcttgagttctgggattataggcattgtatgatgcctgtttgttcagggttgagttataaggcatcatataagtaagccccagatactgtcagaattaccttgaaaaatctgtcaaaattgcatgtatattgaatatccaaatttttttatattgtactcacctgattcttttggccttagtagcatgcccataattgacggatttttgttccttaatttaggagtcatatatgccgtgtatgtgtgtgtgtgtgttatagacatgtgcacatatgtacctttttgttttcttgagatcaatcctcagtatataactcttgttggcttggtactcagtatgtagaccagcctggccttgaatttagggtaaacttcctgcttcttcctatcaagttttggaattacaggtgtatatcataatgcccagctaatgactcctatttttaatcagtgaatgattggtctatggcatataattggatctaagttacgtatgcatttggatgagactccttgtaatgttttaatgatgttaaactgaatttaataccttgtttacctttgtatttgctgccatctagaagctattagtacatcacaaacttgctagttgttgcaaattatcactggagcttggtcatagtaatacagaataatactaaaagaaagctttctaacttaggacatacatactgctgtctatttttttgatttctgtagtcatacctaataaatggagcacttggctgtcatattcttttatttctaattctggttgttttcttgaagtggaatctcttgtttgaaacttgtgtcttattgtgtcatgcatgttccttcccatatatgtcctttgactgataacattttacctatctctctctctctctctctctctctctctctctctctctctctcacacacacacacacacacacacaccacattttactttgaaagtaagctgcatcaagaaactttgccccttaatagctgggtatcacctgcaaataatcacactatcctctaaaactctgtaagaattgccacatccccaaatgaacaatattttcataatgatatcttgtatgtatgtatgcatacatacatacacacatacacacacaaacatttcagagatactttcaatggcatattttcttaaacttctttttgtctaccaggactgtaactaagtaagtctgtccaatccttaccatatttgggagcccagatttcaattctatatcttctatagaattttccctgacagtctaatgcccaaaaatacttagtacactcatactcctggaatactaatttatttctatcagtcattcatgtagtctcactcctggttttgtattgtcagtggcagcatggaaatatctcatatcttattaacaatgctttccatctcctaaacttcacatttactatcttcagttgttattatgtcacatataattaacatttctcttgcttttctacttcttttttaagatttacttttctaattgaatgtaaatgtgtgtctttatgtgactatgtgcatttgagtgcaggtgcccttggaggccagaagcatttcatccccttggagctgaagtagtttcaggtagttgtgagctggccagatggctaataagataacagagatctattcttgaagaatcctagaaacagacatctcaaagaatgttgttccactgtcctggactatcaaaatgtacatgttagagaataagttccttctcttttcacacatctggtaggtgtaggcattccttggcatgtggccctatcactctgctatctgattgtgtgttcacatcatcttattttgtagtctctataaagatactgaccactaaatcccaccatttaggtattccagaatggttgctttaagatctataattctgtctagtggtggcacacacctttaataatcccagcactccagagttagaggcaggtggatctctgtaacatcaaggccagcctggtacacagagtgagttccaggatagccagggctacagagagaccctgtcttaaaaaaatccataattctatatgcaaagatccttttccaaaattggtgatattcattgattctgggcactaagatatgagcaaatcatttttgggtgaccattcttcagcttggtataatgttacttttctaatacataatacaagaatgtagttgttaaaataattttgatcatgtatcatttaaagcaatcatacacaaaaagaaattatttgctccttttttctttactttcagtttcaagctagatactaatatttccatgctgcatacaaagcaaatacctagatttcatctatgcatatatacatatgcatatttttatattctgtggttttgtctgttttcatgctctgggaaaggctcttataggtctaggctagtctggaactgaatatcttccagctttagccccttgaattctgggattacaggtgtatgcatttctgatcttgtttttttttccccctgtgtgcttttgttagtattctagtctcttaaaattgtcacattcattagtgtgtataaagaggaattgtccaatagcgctttatttcctaataccattgagatgatggggatgtaagattcaaaattcctctaggtttagattaaatttagccttttaataatattcatctccatccatttttctcttaatactgaaacacatcatggcattattgaagaaggattggaatttcggagggtaaaactggtttttcgaccaaaataattgaatgtgcataatatatgtgtacgcacacacaagtgcacccaggcatgaaaatgattagtctaaacccagagcaaagctagaagagacctgtggacaaaaacagcttttatctttctcttggggaggagcctgggttttatcttgttaccatgacaacactccttcctctcctttctacttactgtgctgcctgcagtattttgttctttcattttctttcttgtcttgccttcctgctttaaagccccacatcagagctatttcaactaacagttggtaacagtttggtttccctcacttgattttccttactctcctgaagccaaggctgtcttcatcagatgttcaagagctaatatttatgaaagtgaccactttttctgtctggatttctttgtagaattgcctttttccatgatctctggtaatttgtcagtaacgaacttaagaaaaatgcagactcaaatactggtttttgtttgtttgtttgtttgtttgttttttataaatggattaggatcctgggcatttaaggaggacgataggaagtaaaatatcttttacaccattcccaagtttctggactggccacacatagccagaaatactggcaagctgtagctacaagcgttaacaagacaactggggaaaggcagcagccattctctctttggagagtggttaattattgactagaggacactcaaaacctgaaactggaccacagggttgaagaaggaaaagcgtatgttaacacagaaaaatctcatagagctttacattaattttcctgtgggctttcaaatctgtagtcattgtattcagtgaagaatagaatgtggcacccatccttagtcatcctagtgagtcaccaaaattctagggctgtaaacccaactaggacatgctatgtagaacaagaaaataactcaggtagtgcatggggtttttgttgttgttgttgttgttgtttcttttttttttaaattatagtgactgttttatacagaatataggataaatagtactgcatatcaggtttctttttttaaaaaatattttttattacatattttcctcaattacatttccaatgctatcccaaaagtcccccatacccccccccccacttccctacccacccattcccattttttttggccctggcgttcccctgtaatggggcatatacagtttgcgtgtccaatgggcctctctttccagtgatggccgactaggccatcttttgatacatatgcagctagagtcaagagctccggggtactggttagttcataatgttgttccacctatagggttgcagatccctttagctccttggctactttctctagctcctccattgggagccctgtgatccatccaacagctgactgtgagcatccacttctgtgtttcctaggccccggcatagtctcacaagagacagctacatctgggtcctttcgataaaatcttgctagtgtatgcaatggtgtcagtgtttggaagctgattatggggtggatccatggatatggcagtctctagatggtccatcctttcgtctcagctccaaactttgtctctgtaactccttccatgggtgttttgttcccaattctaaggaggggcatagtgtccacacttcagtcttcattcttcttgagtttcatgtgtttagcaaattatatcttatatcttgggtatcctaggttttgggctaatatccacttatcagtgagtacatattgtgtgagtttctttgtgaatgtgttacctcactcagaatgatgccctccaggtccatccatttggctaggaatttcataaattcattctttttaatagctgagtagtactccattgtgtagatgtaccacattttctgtatccattcctctgttgaggggcatctgggttctttccagcttctggctattataaataagactgctatgaacatagtggagcatgtgtccttcttaccagttggggcatcttctggataaatgcccaagagaggtattgctggatcctccggtagtactatgtccaattttctgaggaactgccagactgatttccagagtggttgtacaagcctgcaatcccaccaacaatggaggactgttcctttttctccacatccttgccagcatctgctgtcacctgaatttttgatcttagccattctgactggtgtgaggtagaatctcagggttgttttgatttgcatttccctgatgattaaggatgttgaacattttttcaggtgcttctctgccattcggtattcctcaggtgagaattctttgttcagttctgagccccattttttaatggggttatttgattttctgaagtccaccttcttgagttctttatatatgttggatattagtcccgcatatcaggattcttacttaaattattttgatcatatttaaaagataatcatcaggccgtgcaaacaaaagtattgcttatactagtgaataaatatgggttgattatcttttttttctcatatttttaaatgtaccttacatcccaattgtatcttcttgccctctgtcctttcctcccagcccctccctttcccttgcccttctccctcaccttttctccttagaaaagggcaggcctcccatgtacatcaaccagccttggcatatcaagttgcagtaagattaggtggatcttctcctcttgtgcataggcaaggcagctccgttaagggaaagggatccaaaggcaggcgatgtagtcagagacagcccctactcttactttaggagtcccacaagaagtcctaactgcacaacagttggaatgaaggtaagaagaaccttgacagctactctctagtacattctcctaagaagcttgcttggagaagcattaacacccaggaaatacttgctataggctggattcatttccgcataacaagcacacatgaaatcaatatgtccagaaggaaaacgtgatgatattctctgaggaagctactaaaacactaaggtctaaataaccacctaacatttatttcaaagccatggagcaagagagagcggtgatttaagcaccattgcggacaatttgggtgggatattgacaaatcacaaagcaggcttggtgtataaacgcacaatgcaagatggattgtttgaacagggcctgtaacattctctctcatcagagcaatgagtatgtatttgtttctattgcttctttgtttcagtttccattatggatattcttgaatagtgttttcagcaaagagagttaccgtagatcagcacaagctctcctgctgatagtgttatcgtaggcaacactctttgtcctagcaatggccttggcgaaagggaatttacatatagtttctgttttatatttaagactcagaattttggcttccttagaattctaggcctaaagcataggctctagaaaacccattacaatttttaactaggtacttccttgttgtgtctatttatacatcagtaccaatgatcttattaaagaaactgtcatgtggagggctgaggagatgcctcagtggttcattgtgtataatgtttttgcagaggatgccgagttcggttcctcctatatcaagcagctcacagccatgtgcaactccaggtccagggaattcaatctcattgcgcttctccatattcattctttcatcctttcataagcatctaatgtaatccataactcatgtgtgcattattatgtgtggattaatgcccttttgtgaaagggggtcagtaaagtcctgttagcaggagcaggtggagttgaaatggcgatgacgccaccaggaactgctttactagggctaaggagatggctctgtggttaagagcacttggtgctcatgcaaaggacttagcttcagttcccagcacctggcctccattgacacctagaattaaatgcacatacttatagctgtatacataattaaagatgaaagtaaatctttttaaaaagaataaaagagagaaaatattacatcttacaacaacacatgcttctatgataactgcagtatcattgaaagccttggtaggaaaaaaaaatcaaacaaaccaaaaaccaaaaaacaccctatggaaatgggtgctaacagattcttttgattctactttttcaaccagtgaatgaagctagtcagtcggaggcaagtaggaatgtaggaaaaatggtagcttaaattgattggggaggtccagagggcagtaaagccatgtttagtaaaacagttaattttttaaaaagtgtgtgtgtgtgtgtgtgctcacaggggccagaagaggacattggatcccctgaactggagttacagggagttgtgagtcacctgatgtgggtgctgcgaactgaagctaagtcctctgcatgagcacctctgctcttaaccacagagccatctccttagcttccctgcctcctccagtccccacccccgtacaccccctcccctgcttcccgtaaagcagttcttgatggcttcattgctttcatcttcagctgactgcatacctgctcctgctaaggattttgctgatccccctttcacaagagggcattaatccacacagattatccatggcattagatagttgtaaactggtggaagaaagcatctggaggagcacaatggaaaaaaatgaacacaaggcccaagttgacacaggggcttgcaagtcaggaaaacattgtctcagcaagcaagagagaaaagcagatggtcgtttggttaagttttggaggttgagtatagattcattttctgtccctagaatgctcttgcctgggggtggtctgtaaatgaagtcacagcaagaggtcactatctctccatattcctgaccttttgcagaattcaggcctttatttttttattagttaaacataatagttactgctatagtagtttcgtcatacctcatgtttagcaaaaactctttaataccaccatacagtagtgacacttctccgaatgtcttaccaacacggttctgtttgtgtctttttgtagtgtcctcactcctcattcactgctgacttgtcactcactggacagaaaaatctgtccatgtccctctactcttccataacccagacttttttgaacccctttttgctttatttacaaatatataactgaagactagctcagttttatgtaaagtaggcattttgaacatctcttgctctttaaaatttccataactcaaatatcgtattgtcagagactgaaggcttgctctgttatcagctgaagtggcataaccatctcaagggccgttttcatgatttatgtttcttggctattgtatacacagtacacagcatccttgacatctgattagatacagtttttacaaatattttaattaggttgggactttatatgttgatattatatattcaataaccattgattagtatttttaaatgtcttttaactggtgaatttaaaacaaagtccatacatattattatggtgccatgtaatatttggatatctgtatacattgactaatgtgcttaaattccttaaacatttatcattttatcatgacattttccaaaatcttttcctttgttttttaaatttatatttatttatatgtatgtatgtatgtatatatatatatatatatatatatatatatatatgtctgtatttatatgaatacatgcgcatgcagcgtgttggaggcagaaaacaatgttgagtgtcccttacattgaaattataggtgcctgtgagctgccatgtaggtgctgagaactgaaagcaagtcttctgcaagagcagtaaacattcttaatggctgaaccgtctctctagcccagtgttgtatgtagccacacagtagctatgagatagcattctagggttctgtgctttattaaacaagattggttccttttggacattatttgcccttccttcttccttccattttccccaagctcaggtagtcttttctgctcccaatatgtacggattgagcttttataagattccacacatgagtctgatcatggtatgcttatctttctgtgcctccattattttatttaaaataaagatctccaatttcatctatgttgaagtaatgacaagattgtattccttttgggaatgaatactatccatcattttatcaattgctagagagatttcatccatatcttggctattatgaatagaactgcactgaatatggggatgcaaatctctgcctctttctttgtgcctctctctctatctttgtgcatgtgtgggggagtgtgtgtgtgtgtgtgtgtgtgtgtgtgtgtgtgtgttgagaccaagtcttactgtatatcccaggctggctcaaactcaagatctttgacctctctttggcctttccctcctcagccttccaattgatggaattacagccatgcatgtattttttaaaaatattccataatttagaattttgcatgtaaagtcaaccattcccctgtatcacattgcctgtgcattgtacccactaatataccattgcaaatagaagtgttcctcttacctcttttctctccttgagaaagcctattaactctgactcatctaaaatgtcaccttctccttaaagccttcctctagctagaacaaagcacctaccccctcccccgccccagcaaacccttctcctgttggaaatggaacctgtgactgatttgactaggcaagtgatgtaccactgtgccacacccacttcctcttttgtttctctgaagcttcttgttcgtatgtcaaatcacttattttggcatgatttataagctactcatattatctcagcattacagttcgtatgtacttcttagctgtgtcttattcataaatgctgtcagtggacttagcacaatgcaattgcaggaagattgtgtaaaatcttccttccttccttccttccttcctttcttccttccttttttgtttgaagagctattttctaaatgaatatccttttattggatttttcaagttaaaattgaatttcattttagatctttgattgtgaaaaattatgaaaaggatttttatcaattgtgtgatgctgtaataccagttcttaacaatggtgcttaataacattctctttccttttttattctttagtgcattactgtttcatttctttcagcatcatgtatctttcccatgaagagtggagctttctttctttcattgttcccatgtctctttagactaccaacggtggctgtctccttttgtaattgtgttttaggtcactggccctgttccgaccagagatccttctgcgagagcagacagaaggaatatgacttctccatcattcctggctgccagcccaatggagaacccagctctgtttaatgatatcaagatcgagcccccagaagagctcctggagagtgatttcaacatgccccaggtggaacctgttgatctctcctttcacaaaccgaaggctccgctccagcctgctagcatgctgcaagctccaatccgtcctcccaagccaccgactgcacctcaagccattatggtgcctacttcagctgacacagtcacttcggcagccattcctactgttctcactccgggctctatcctggcctcgtctcaggggaccggtggccagccgattttacatgtgatccacaccatcccctcagtcagtttgccaaataagatgagtggactaaagacaatcccactggtggtccagtctttgcctatggtctataccagtctgcctacagatgggagccctgcagccattactgtcccactcattggaggagacggcaaaagtgctggatcgggtaagcaagcagtttaccacttcttcaactcacgaaccttctgagatcttcccttccttagtgagcctatcttgtctcttttcaccgtttgcaattttgagggacactattccaaagggaaactgtcctaatcattttttaaaagtgttttaaaaataatttctatataatgcttaagactatataatgaactctgtgtcttggcacatatctgtagtctcagattacacggctgggcagagtgattgtgaatcccaggctagctttaggttacataaggagaccctgtcacggaagaacatataattgatctcctttagaccatgtttctcaaacaggaatgcatattcttgagcgaaatagtctgtattttcctagcatcttcatatactattatctaatggaaaatcatttaaagcattatattcaaaatactgctgatttaaagcaaaatgcaaaatctgaacactgagttaaattacaaactaaagaacaaaaatgttgacactcactaagacactgtcttcccctgtgactttctagattattgtgctgggtttttttttttcctgtgctattggtagaaaactcaaccttcctatcattaccatacttaggtatgcttagctctggttatttagacactttctgtggtctctgtctaagagtctctgcagtatagtcacatttcctgtgcaggccattagttgacacctatataaccttccttttaaggtttgattgcttttaagattttatttgacttcaagaatgtgaaggacttttcctaaccgagttagatgttctccagaatcctgtgttaggatgtgcctgtgcactctccagagacacccaccacagggatctatatatttacattttgtagtcttctggttgaattgagcatctcacacatactaaacaagtactgtactactgcactctgcccccagccttcttttgatgtaaacaaacaaacaaacaaacaaacaaaaacattgtcctcaacagcacagtttcctttatataattatgtttattttagtttataatcagaaatgatcaaaggaagtctcttgcttctgacatgatttgaaatagttatcgtcaccaaagggtgttattacagtcaggtttttagggctgtaaatgttgggataatcctaggacttctctcaagccacggaactagtcatagacttcagtgcctccaggatatagtgaagctgtcttttctgtagactctttcccaggagtctgaggcctagaggtggatggatcacacttagattgtgtcctagggaaatccactagaaggacagctgcccacctttcaaagccacctctgtcccttcctatgctaaacaaggttgagaagggactgcctttctcttctttctttttgaatgatttttctattttacgtccacttctctatatggggcaaaccgggaatcccgataataatcatagagatctgtacattctggtctacagtagtagcacccctttctttgttttcagtcaaagttgaccccgcctccatgtgcccactggagtttccaagtgatagtgatgagagtgcaattgaaagtggctcttcagccttacagagtctccagggatttcatcatgagtgagtacttaaagtgtgtgtgtgtgtgtgtgtgtgtgtgtgtgtgtgtgtatacacgcccatgtgtgtgtacacatgcatgccaattatatgtgtgtacaggtatccatgtatgaaggtagaattaacaggacacaatagtaagagtttaaggaaaattaaaaaaaaaaaacaagctgctttttcccaagaactatacaagtgtgtgtacatgtgaatgtttgcacatgttcatagagttacattcaaattgtatatatcatgaattctagccatgaataaaaaggttctaatttcttataaattgtagttttgtagtgtttttctctttaagtttaaagtagcctggtcttctaatcataaaatggtttgggagcaattagcttgcattgagcaaaacatgttgtatggaaaatgtgttttgttaagcacaagaatggcacttgttgaagtgaaatgttcacactgtttgacaaggaaatattaccacctccggtcctttctcaggaagctgcatttcctcagcaaaatagcctggttcaaagaatggcttccagggtttcaactatttcttctccaggggagctagcattagaatttgcataaatgataagatggtatgaaatagcaccactgtaattggtcctgtgtctctttctttgcttaggccagcgacaatggtccacatgcagggagaagagtctcttgacttaaagagaagacggattcatcagtgtgactttgcaggatgcagcaaagtgtacaccaaaagctctcacctgaaagctcaccgcagaatccatacaggtctgccctgccccctgcctcctgccctgccccctgcctcctgcccctgcccctgcccctgccactattccaactccagtacatacttgcatacatagatacatagtgatgagcctagggagagagagaaaagctacaaggaggaggagatcacttatggggtttgcccttttgcgttgttcttacccgaaaaccactttcataaaaataaacaaacaaaaaaactagcaaaacaaaaggccgggtacgttccaagcaagtatgctactgtgcctagtttttcattgctaggtattaaacccaaggcatcatgcatgccatcctatgcaagtactctaccaactgagctacatcactagtcccatagatttttgctttgtctgccctcaaacttgctatgtagctgaggctgaccttgaatttttgatgcttttgtctccacctccaattttttgttgttgtttaagtaattcccatgctgtttgttatggactagttcacttttccacccacagtatcttaagaaatcatttttctccatattcttttcagtactttgtgattgatcaattggttgtttatttatttatttgtttgtttattcatttgtttatttgttgattatcgcccttctgaccaggctggggttgaatctcaatataggtttcttctgtgatgggtaaaagctaaccattttttcatgtatttaccggagtatttgtatttcttcttttcaatagtgtatgttcacattatcttcccatttagagagtgaattacccatttcctgttaacttttctgatttctttgtctattttggctgttgatcatctatctcacctaccttcctttttttttaattagatattttctttatttacatttcaaatgctatcccgaaagttccctcccccctccccccagccctgctcccctacccatccactccctatgaatgactagcaaaggtttttctttcattctgtaggctgttaatatcttttgttgactgtgtcctttattctacagatgcattttaatttgttatcataccatgggtcaagtcttgattttatttcctgatctattagagtcattgtgaggagattcttgctcatgcctacatcttgaagtatttcacatactttgctcaaatagtttcagtatgatgggtctgacactaatttcagtcccactttgagttgtgtgttgtttagtgaatgctaaggatatatttttaatgttttgcatgtggatataaccagtttccccagcacaatttcaggatgagctttctcaagtatatttatattagccattctcgtcattggaactaaatattgaagtaagacaactttaaggggaaaagatttattatggttcctgatttcagaggttttagtctatggccacctgcctgcctccgttgcttttggtgaagcagagcatcatggtagaagaaagtggctcacctcatggtggtgtacaagaaagagatacagagttttaagagcatgaatgtattaactgttgatcatgaccctcataatgcagtcattcctagcattaccagctagggacataacttttgtaccaaaacataacggtatgggttgtttgtttgttttgctttagtcaaagattagctggctatagatgtgtggttaatttctagattctttattctattctgttggtatgtgtgtctgattttataccagtactatgtttgttttattttgttactaatgctctgtagtatgttttgaaatgaaatattatagtgccttctattgtagtaaatctccaaccccaataagcctgaataaagaatgcacaactcagttacaatatttataaactgtaggcctagattgggcagatttactactatagtactctattccccagctatgagattccttgctacctgtggcttctccaggccacgtggttctgctccatcttccttctacctcttattcctctctctttcctccatctcctcatttctctccttcttcctttcttccattactctctaaaacccccagatctacctttctcttccactgcgcaatcacaggctctagactttatttgaccagtcaaaatgagcacaaggttcccatgaaatcacctgagtccatgatccactcctcatctgggcagctcctcttgaggaagcagaattagcatcaatatatcaatagcaccagggcaattcacaacaaccttcaacattatacatttcctcaggattgattttttaaaagacttatttattttatttatatgagtacactgtagctgtcttcagacacacaccagaagagggcatcagatcccattacagatggttgtgagccaccatgtggttgcggggaattgaactcaggacctctggaagagcagccagtgctcttaactgctgagccatctctccagccccttaggattgttttgactatttcggtcttatgctttaatataaatttcaagattttctttctattttttttaagaatgtgataggtgttacattaataagtagagattgctttcagaaatgtgatcattttataatacttatttgacctgtccaagaaactgggaggtctgtccatgttggaatagctacgggttttgtttgtttgtttgtttttgtttttcagtgttttataatttgcatttttagtcttccatcgtttggtcttctgtctccttggctagatttatttcaggataatcttcggcatttgtgattggagttcattactttaaaaatgacacttatcaatttatattgtgtgttgggtaggtgcttgtgccacaggtatttgtatggaggtcagaggacaaactgcaggagttggttctctctttccaccatatggattttcaagtgccaggcttggtagcaagcacctttaccaactgaaccttctcagcctatctttctttgtttcttctttcttatttttcttaccttattgccatgcataaaatttcagtattgtatttaaaaagagtgtggcttgtatacattttgttttagttatttattttttacaagaagctcttttagtctctcctcattcagaattatgctgattatacgcttactgtgtcctttgtcaggttgagatgtgatcctcctgttcctaatttcttccaggcttatatctgagtcctgttccacatttatcaagattatcctgggatatttatctttgatcctatttatgtactgtgttacattattcatttgtgtacattgacccatcctgacacaccaagaatgaaaacaagttaaccatggcttattatttttatatgctgtttaattcagtttgaaatactttgttggggatttttgtgtctatgttcatcaaagctgttggcctgtagcttgtttgtttgcttttttttttttttctgatgtgtcctcatcgggttttggtgtatatctagataacactgacctcagtttgaacacaagcttctttaaccacagtaagatggaacacagggtcccccaatggaggagctagagaaagcacccaaggagctgaaggggtctgcaaccctataggcgggacaacaatatgaactaaccagtacccccagagctcgtgtctctagctgcttatgtagcagaagatggcctagtcggccatcactggaaagagaggccccttggtcttacaaactttatatgccccagtacaggggaatgccagggccaaaaagtgggagtgggtgggtaggggagcagggtggagggagggtatagggaaatttcgggatagcatttgaaatgtatataaagaaaatatctaataaaaaaaattccaccagagaactcttaaacctggggggaaagaaaaaagaaaaaaagaaaaagaaatagacttcttcagggtgcagtgagctcagagtgccacatgatggcagcagtttaacaagccaattattcatttgggtgtagtgaaaataggaattcctaggagaaatccttgaacaattataataaattctacacatagtgaaactgttgtgaagtgtggagatgggctactaccatatcgaataaaagtaaaacaaaattatattccctatattctcctttttaagtgtcaatactcatgtgtaactgtctagacttttcccttttgtttggtgagagagatagacaaggtagtcctacctagtctagaactcattatgtagaccaagctggctttgaactcagagatcactctgtttcttccttatgggtctgggattaaaggtgtgtaccactacacttaggttatctttagtcttaaaatatccaggtgtgtgtcagtcttcttacaggctaatgtaaaaatttctgaatattgaaatgatcagtaactaacatttttaatcaaccaaatagtttcctggtactactccaaacctgtgaagtcagcctggaccccattctgttgtccaattatctaacaggtatacagttaattagtgaacacttgagagggttagtaggtgttagcagtaagttaaaagaaactaagaaaatctgattggcacgagacattaaaactgcaaagctgtaaatgccttggaagttttataatggggaaaggaggggtagaagaacaaagactgatagacatttttctccatttatttatttatttatttattcattcattcattcattttacatccctattgctgccccctagttccccctcatagagtccttcccccacccctccccttctcctctgagagggtggggccccctaggtatccctccccaccctgacacatcaagtctctgcagggctaggtgcatccctctcccactgaggccagataaggcagcccagttggcaaaggattccagagataggcaacagctttagggatagcctctgcaccagttgttgggggacccacatgaagactgaactgtacatctgctacataacgtgctaggggcctcagtccagcccatgtatgctctttggttggtgattcagtctctgggagcccccaaggttccaggttagttgattctgttggtctcctgtggcattcctgttcccttcatttccttcaattcttcccccaactcttccataagagtcccccagctccagtgtttggctgaggctctctgcatctgtttcagtcagcttctgggtggagcctctcagaggatagttgtgctaggcttctgtctgcaagcataacagagtatcattaatagtgtcagggattggtgcttgcccatggaatggatcccatgttgggctgattattggtcggccatttcttgaggctctgctccatctttctccctgcatttcttttaaacgggacaggactacagagtgaatctcaaaatagccagggctgcacagtggaaccttgtctagaaaaaagccgaagaaaaaattagatttatttattttcattttatgtatatgggtgttttgcccatgtgtatgtctatacaccatgtcacatggcatcaacagagcccagaagaaggcatcagatcccctgcaactggagttacagatagtagtgagccacatctgggtgctgggaattgagcctaggtcttctgtaagagtagccagtgctctgaacaactgtgccatctctctaaccccaattaattaacttttgcaacagaagctcacttagaaacctagtttagcctcaaattcttgaccctcctacgtaagtttctttagtacgtgttgtgtgtgtgtgtatttgtatgtatatataacacacacacacacacacacacacacacacacacactgtgctgtggtagttcttcttatactaatcccctcttttcctttccttagcatgcaggtctcatgatacaatccagctataacctgaagtctccaagcatggagctatctaaaatacttgggcttaacaactctcccgttcctttttatgtatacatttctgaccttacacagaagcaagcttttgctgagtgctctttccactgagtcacctgttcttattgtagatgactttgtttcagattgttcattaggaagtatcagatgagagaacagagttataatagggtggaaagtgtcagcaacctggatctctgttacagtttgcatgtagaattccgcgtatgggctcatgtgtttgaaatcttgctctccagctagttgtgctgtttcagggaggttacggaaattcttgcagttggaggttgactgtaggaggtgaatctctgggactaggcttatagcccatgcatactttctatcctctttctgcttcttgatctatagagatgtgagtcaagctcctgacttaatggagcctctcatcaccttgtctactttgccataatggactatattcattcctcaaactgtgagccaaaataagtccttttttccctaatgtgtctttccaggcatttggttccagaaatgggaaatgtaatgaatattgttcagattgtactgtttactaacaatctaggtttccttttgtttgaggttttttcctactcctttttgagacaatgccttactatagttgcatagcctggaactcactatgtagactagcctgaccttaaacttgcactgttcctcccgcctctggccactactgtctcccttttaaaatgctttgaacaaccttttgagatatttttaccttgatttagtagtgttgagaaattgacttggccaggggaaagcgattacttaatatacggttagcgtggtaaaggtagaattcgagcagaattcaataactctttgagagcctgtgttcttcactgtgttctacactgtcttcagcctaacttcagaacttcaagcagcagtatgtagaggcgttttaaaagttttttaccacaaaaacaaaacaaacaaacaaaaacaatatgtgaaataatacatatgctagttaactgtatttaaccagtcccatagtgtgtacaaatcatgaaactagaagacgtgcaatatgatgttcatttgtcaaactaattaatttaaaaggtgaataacacgtacttcttcaaggcgactgtcttactttaatacatttaataatgtatttctgctgtttttctgattaccttcaatatcatcatgtttttcctgcaggagagaagccttacaagtgcacctgggatggctgttcctggaaatttgctcgctcggatgagcttactcgccatttccgtaagcacacgggcatcaagccattccggtgcacagactgcaaccgcagtttttctcgatctgaccacttgtccctccaccgccggcgtcatgacaccatgtgaatatcacaggccacagcaggcacgctgcaatggcctcctgagtgtgtgctgaagttgtaactacgtttgcctctttgactacaacttgcccccatgattggggtccgaacagcctactgagccaggttaatgagactggaaaacaagttagctggtctcccatgcggctcttcatattccactttcacctcttcactgtccagacttcagtttttgcaacctcttcctgggttgaattcagtgcggcgcccatggctgccctccctgatccctcatgctacattatagacatttttcctacaataacaaacaaaacaggaatcaaactcaaggctgtgaacaaacatccgctgctctcccctcccccctggtttctcttgttttctaaagattttattcacatgtgtgtatatatatatacacatatatgtgtatgtatatatatatatatatatatactgtaaccagtacttaatatcacttagcaatgtcctaaaatgagggttttttttcaaagttgtagctacaaggggcataacagtagagttggttgatcaaatttacatagaattgagtctgaaatacagagtctcatgctaaccgtgaaggttttgtagatccagttttacttgttcttaacagtttggtttacaggcagtgccagccctccttttgaagttcatcaagagcaatgaagggattccttgacctccttttcctcctcatgctcctttagaataaaaggttttatggcacaattccattctttttaggttaagtttggacaaatattcaaagcacagaaagatagatcagtagggagaagtattctaggaaaatacgtgggcagtgacaggcaagagcagacctgggagcaccctgtgaacaattacttggataaggtgttagaactgctgttaatcccaagcctcgttcagagggcagcctgttgaaacatcactttcgatgggctccactgtactgttgattcttttgtttacataaggcaaccattcagcgtattacctgatgagaaattgcacactgagcacgttatagagaggtgaggggttgcactaaaggaattttgtttacttcatgccattttgggcatttgttcttctctttctaatgggatggaagaggttttctttctgacactgacatatagaaagcatttttttggatgttttacaacttctattaatacccaagccatttattttatttagatataacaacaagatgcttaatatacatttggttgcccaatcagactgttcataatattctctggggcataaaaccttctgttcctggccctggacctcatatctacctcttcgtggcatatttcctctcctggggaaaaaggagaggggctttgtattagtaggattggacacagcctctcgcctaaaggttttcttcatatgaaacctttatttcttggcagatattcaaaatgttctggcttgaacaatttaggttactacctcctgtggctgtactttctaactaaagcctagaattctaccatccagaaggggtcctgtctacttctacccatccctcacgttttacagatgaggcaaatacgggtcagattctttctccagataattccttgaggccttacagacctgtatacaccgtctcccagggatcacactagtaaaccaaattaaagaaaaagaagttatgtgattggttgcaatatttgtccaattttatgttacacttcagaaaactttaaattcatgtatatttggtgacaaagtaagtagggtgtgcttatggtcatgaccacttaacaccaggcacacagtgtttcaagtcacattttttgataattctagatttgttttaatttaccttgtttcaagtttcaatgtctttgcagagcataaattctccataagttaaggcctacttgtacttttcaacgtggcatgtaggttttactgttactgctttggtaagggatctgtcctgactctgggtgtacaagttccaggctgtatactaattactaagcactaatcaatatctagggctagtctactaatggggaccacaatgtaaaacagattgaaaaatgtatattcctaccatatatgggcttaagcttataattgagtagttggtacaatactatagaacagagtccaaagggttatgtacttctgttccactttggatcctaaatttgttttccagagattggaattggcatgtgccccttagacttcaggatattgagacatatgtttattaatgagcactatgaaattatagtactcataagggtgatcagctgaggatcccagatactgatgttcctagcatctctgagcctttattcaagtatgtttctgcagagtcttaatagactttgcaaatgctttgtccattgtctttagccaagaaccaattctaaccatattctctttgctctttttgttcccaaatggcaaaaatctttccagttacaagcatagtctttacaaatgtgtcatgattaagagaacttcgcagagtaaatgaactcaaacagtacagtgcagaattactgcaccaaaagcacatacgtttgctacatagtgggatataaaggaaaccattccacttctcttggttaacatctgaggtttaactaagtgtaatgggcttacaacagccaaagactgttaggatgacatttgcctaggatatggaaattgtgtctggatggataatattcaggagtttattgtagtgaagtttctccctctgtagacatctggcagctgaacataattgttggtaattgccattgtaaagtgtaagaaatgtaaactggtttgatggattagtggagttcattatgtacaaacccacgaatgtttgtaaagagaatttctttttaaataaactttacatgttggaactctttttttgagattttcaggaaaatgtgaaggtagaacagagttcctgctgactctacattatatatttgtttggtatacttgttacaattagtgaaattataccgatacattaatattaactacaatcaatgctttcgtcagactaccttggcttttatctgctgttctttttttctgttttaataccgccttcaaaatacaacattgtattaataataacagctccttattctcctcgttgtgatagcttcttggagttctttgttctcaaggaccttggagtatgtttttcagttggggtgtattttatattcttctcatgaaaattttctcattaaaaaaaaaaaaaacgaggtcaatgaaagctaggcatggtggcaaacactttccttttaatcccagcacttgggaggcaaaggcaagtggatctctggtctacagagtgagttccaggacagccagggctacacagaggaaaacc

SEQ ID NO: 696 - DNA, 37006 bp, mus musculus
ttccttctacgttccggtgtcacgcgaccccctccccccctccctcccttcttgatctacctttgggctgggctggctggtgatgagacacttggctgcaggctgtggaaggagcgacgggtacaaccacaataggttccgcgactgtgaccatggccgaggtgagcagcacctcatcgctgcctgggccgtgagcctggaagacagcttccaggcccagggcccgtgcgctccggtgcaggtgagctgtgttgggagtgatctgggtaaggaccgagagcatcttaaggttttgttgtgtctcctatccagaataacgctcagaataaagccaagctaatctcagagacccggcggagattcgaagctgagtatgtgacaggtaagcatgctttctgtgacttaaagtggggtgtgcagtgagcatatccaacttttactggtgtgtttgtgggtgttttgacgggagatgttaagagacctttccaaccttcactggaaagatgctgtacatgtttcaaaggttttgccatactgtgtgcgctgctttacttgggcagatggtgggcttcctttaaacggttagtgaaagttagaaatcaaaatgcctagcatctccttatatccatgggcctcacaggctatgaacatattggccaatgacataggtgacactgttcagttcatggctccttcgctggcctttcaccagaaaacgaacctggaaactgccattgtactgttgccatatagtttgtacataatttggtaatccagttccttttattttgcttaattccgcttcttaaaaccaaaagtgctacgcacaagttctcgctccacactgtacttaaaagtttctgtaagtgcagaactggtttattggttgaataatctggtcactgtcatagaatcttgtcaagtacttaatctgctgacttagtgcttgtacattgtttttaaacatttggaataagttgccttgattgatactaatgtagcccccttccacaaaatagcttacttccatgttccgagttcctgtttccatatctatgaaatgcaagtaaggttaagaattaagtgaagaaacgtgtatcagaccatcaagtgtggaactaaatccagtaggtggtcaatttagattttgcctcagtcattggttaccatggaaagaactaaactgttgtattttgattgtagtgcttggcagaagagtcatacacctttatactgttctgtgctatatatcagttcatgacctagaacaaataactaagtccattccaagtagcctggcccgtaaatcttttcatgcctcctggccaattttcttcatgtaccaaactttgtaccagagagttgcaaaagcactctattaacttttagcacagagatcttattcatgtctattatcatctctggttacagtaaagaagtacttctaaaataactttctataggagtatacttcatcgctatgtggtttatagtaagttgagatataactcataactaatgaattggccattctacaatcatcatttacttatgctcaaggaaacaagcagaaaatagatgaattatgcaatctccaaggtcttaaaaggtcaccgtgatgccactgtctcatctttaaatgagggaagtgatgtgtagtacgattaagcaatttgctcagaatctcgggtgttagagtcttagcttggcttgctattcaagccttttggatttcaactttagtaatctttcagcaacgttgtgatgtcaaattagatcatgtcattccccagcttgaaacccttcactgtcttcccactgtatgtatttagaataaagtccccattcttctcagtggcctacaattgggaagccatatgttttatagctcctagctacctgctacttcctttcctgttatttctctctttgcttagtacagatttgaccactccctgcattaaggaagatacaaatagtaacccagtacacacacacacacacaaaaccaaacttgaatacttagtctaaaacaatgtagctgatgtattttctatttgacttcctttaaaaaaaatgcagtgacctacaaagttgacatcacaatccaaaccatgacccacagtttgaaaaatataaacacactaaacacactgcctcatttgtgtgcttcaagcagaatgagtttgtttgtatcttgggacatttccatttctcttcctctgggatgcttttccccagttagtatgtaaggctaggtctttttttttttttttcccttttgtctttttagaatttaaatgtatctgtgaggcttttaaatgtatctgtcaggccttcactggttattaagtagcttcctgccctgcttactttccatcctagcctgtaattgtctgatttgtttattgttcattccctccagtagctaatggatgggttgggttagtagcagctatagaagttggaggcagaagccttttattcatcttactcctcagtaccttgcacagtgctcagtacctactctttaagtgcatatagcactactttaagatatgcattagaaaaccattggaagaattgacattttaaaccaagaactatctaaccagctccccttacctaccaaaagcctggcaaacaaaacaaagacaaaaacaaaaacaagaaaacagccttcatcatatatattataaagacaagcttcctttcccccagaatcaggcactgtgtatggtattaagtattggggtggttttacccttaaatatacacaatgaggtataggtgaactggtgtgtgagttttctccacagaagttgtaactgttaaacacttctgttagtaaggaaagcagaaaccgtgaaaggccttcctcacctgaaagttgcacttgtattctgaaatacgataaggctctttagttcatatgcattctcccttctaagtttggcttatagaaattaagtttggtaaagctgatggggttcatttgcgcatgtaatcctagaattgaagaggctgaaggaggaggacatttaagttccaaagtaacatggtctgttatggtgacttccgggtaggcacgaactaaaagggaaatcctgattaaaacatataaatatataaacatataaatagacaaatagatagataaaataagaaaaagtaactttgtatttagaacattcacttgctttgcagtctctattttcattagtaatattttgtttcataaaaggtttaaagcaaacaaaccataatgatgtttttcctaaataaaactatttattttccccaaggactttcctttcagacattcagttgaaaacaggttcttgggaatcccaagctcatttatttttcatgccttcagaaaatattaccaaatatggatagatttttttgagcagacaaaaaagaagaaaatacaggttcataattaattttctccttcattgttactgtgagaaattccatgctgagtctcaaatgagaaacatgttttattctttttactttctctttgtgacaataatttattcagtcctgaaagtactcattatctgcttaattctataaagcagtttgtcagtattagagaaagtggaatgatagagccatttttctaacttgtacaatctagtgaaagtattcgaacaaagacaatccgccaaagaaggtgaattccattctgagcaataggaactgaagaagtcccttggcgaggcagtatgcacctgtaatcctagaaagtgggaggatgtgcaattcaaagaagctaattatctctgcctacctagtgatgtgcactccagcctaagacccatgaaaccttttctcaaagaacttctttgagtgagaagtgctaaggagagagagatacctcttggtgatcaggttaggactgagtgagaagcaacttcatggccaagcttggcagctcccaaactgtagaaaaacttgctctaaaacatggtgctattgggaaatggcagaatctttaagagctgtttaccgagtaagggagtcttagattattgggagtgatgcctttaaaggtggttatgataccctgcttttttccttttccttgttttgctcccttgtttgggcctgctacatgcccactgccttatgtccctcttcattccaggcccgatggcatctaggccaactgatcacaaacggaactgctaaccctctgagacaaaataaacctttactttcttcatctcagagacttgcgatgccaggaagctgactaacccaggtggtatttcttaggaatgtaggcagaacttcgcccggtagagaagtgatcacccagggtcagagagtctgaggaaaggcactgaggtgaaaagatatgcagctccgtaaggaagcagtagaagcttgctgtggtgagcctcgacgagaagtgagcacagggatggaaacagaagaaatgtgctgggaccttggatgtcagtgtttgtactcaggacatgttgagaggcagctgagctcaaggactgggtctgatatttacaggcatatgaatcgatttaaaggaattccgttgatagcagaaaagtcaaaagcctccataccatctagaaatagtgctaccaacactagatagatttttttcctaatctttttgtctatatgcttatgaaagtaaagttaaatgaccatcctgtttattacttgtatgctatatttttattaggatatcatctatttttaatatttggatctattaataaaaaacagttaccatttaatttcgataatcacttattggacatttagattgcttccatgtttttgctagtacaactttatgaagcagttaaaatgatttcctttggatatatgttgtactggctggttttgtgtgtcaacttgacacaggctggagttatcacagagaaaggagcttcagttgaggaaatgcctccatgagatccagctgtaaggcattttctcaattagtgatcaaggtggaaaggccccttttaggtggtgccatctctgggctggtagtcttggttctataagagagcaggctgagcaagccaggggaagcacgccagtaaggaacatccctccatggcctctgcatcaactcttgctttctgacctgcttgagttccagtcctgacttccttggtgataaacagcagtatggaagtgtaagtcgaataaaccctttcctccccaacttgtttcttggtcatgatgtttgtgcagaaatagaaaccctaagacacatgtcttgaaatcagattattatgtccacaaataaacactcgggactcacttgataatctataccaaactcccatcatataagtcatataagctgcaagagttcattgctactggccctgtagaataatgtttgtctaaccccaccttatccacatttagtgtcataattccttaaatggtagttttttagttttcatttgattgctagtttgcctaaacttcttttcatatgcttatattcagttatatagtgtttttagtttatgccactattactgatttgggcagaattttaatgtattcagaattacccattgtattgtggtttcttcagttgctatttgattgctctcacccagggacaattctgcacttttaatttttattttgttttaattgaatgctgatgtttttaatggacataatgtctgaagctggaaagagtaagcagccgtgtgtgaaaggtctcctcagccaaatgtctagatccactgtcgtcaatgctttctatgtcctgtgacgtttgagagacacttttcctgccctttggtcttgctcattctcttgctttgtattagatctatgaagtttccttcaccaacactttattagatttttgtctctctctttctttcttttttttacctttattatagaggctaaagtcagctttttaaaaggatcaagttttatccttatgatagatctaaaattaccaagcttgagttataaacttagatgagaataaagaattggtagacgtgcttacagtttaatcatcaatctcagtaatgaccccctccccctccccccacccctcctcctctttcagtgggcaaaggctcccctgggtatccccctaccctggcactgtcccctgagtggctccacccagcagtggactcagacagatacagacacctacagccaaacagtggatggagcttggggattcttatagaagagtttggggaaggattgtgggccccacaggggatagaaactccatagaaagaccaagagattcaactaacctggacccttgggactttcagcgatggtaccaccaaccaaagaacatacatgggcacagatgtaccagatgtgcagctcatacttcatgtgggtttctgtgggctttttaaaattcatatgtgtatgttatttatccctattcaattttcagtgtctagtgacagtttcacttttaaaccatctaataatggaaaggtgtcacttctaggatggtggttttttttgtttgtgtcacagttattttagaagcttggacaagaagagtacagtatgcttatctaattaacagtataaccttcatttattgtgtggtactagggagcccagacccttccttgggctagacaagtacagtaccagtagcccacatctccaaagttaacatgtgctcctgacaatagggtatagcagagatttttttcatttctgaaattttaatatcttaactaataagtctgatttggtaagtgttttagtttcttttaattactataataaaacaccctgaagaaaagacaatagaagggaaaaaacactttattttacttaaaatccaatattatgggtaaagggagacgagaacctcaaattgcaagtcacattacatttacaaacaagacaagagaaaaatgtatgcatacaggcttatttgcttccttccatttgctcaattcctctactcttacagagttctaaactccttgccaagggaatagtgctgcctacagtgggttagacattgccacattcattaacttaattaaaacagtcctccacaaacatgccacagtccaacccaatgtagagagtccctcatcgagactcatcctagatgattccaggttgtatcaagatgacaattaaacctgatcatcataataaagtgtccaaaagaaccgagtgtgatagttcatgtctagtatccctgcacttgaggtgaagatcgagcgttgaaagccagcctcagcttcataatatatctgaggccgtgttgggatggatccctgtctcaaaataaattaaaaaaagaaaaaaaaagaaacaacagaagatccctacatgattaaatagaatagtaagaatccccaaaggacttttcctcttctttcaccatttttcaaaagggatatacatttgttacatttcagtaaacaatgttacaacatttatgttctttgttggacttgttatttatattactttttctaattagaattggttcttttttttgttgtactgctgtatattctcagtgaacaagtcatttaacaactcaaaagctacttatatagccttaaaaatgctaagttccaggaattataaaggaaacttgagaaatccatgcacctgtgaaagaatctattcctgtacatttccttcactactagaacacagcacacttaagatttcagagtttaacaccacagtgaactaacttgactgtagatatgcatatgtatgtatagaggggtatgtgtgtgtgtgtgtgtaagttttgtaccaaacaaatagaaaataagtattttaaaatatatctttctactcttgtcatgcttacaaaacttatcatgtgatcaataataaaaagtctcagaaaatctaaagcagctagatcataaaggccaggttctcacaccattatatttgaattcataatattatatttgaagtcataataaacaggtacttaaaagtaaattaaattttaggaagccgaaacaaccaacatatctctctggattactaatgttgcagcaatgtgtgtaattcttacttctactaagtagcccatatttttaatgagggtatcacaatggaaattaccaattatatgtcaaaactaatagaaaactaatatggaaagatcaaggtaattttagctgaagtcattaagctaggttttgcttggttgattttttttttttggggtaggtttttggttgttgttttgttgttgttgttgttataatactttgtgatctttgctggctaggtatttgataagtttattttctgtaaatctttgacttataaagagcaagaacaatgtaatgtattattaaagatctgggctatgaggaacatcaggggtggtgggagccagactttcatggagataatcattctatatcaaaaatgtactgtgcatcaatttttggtaaggattaggaaggtggggaagtgacattccaaactgcctgacctcttggagctcagcagtggaggtcagtggtagccctactcatctcgtacctgctccctcattacacagggactctgtgggtgtgacttaaggagctgttcctgctcggttttcatgaacaatatttccatatggtatgtgtgtgtgtgtgtgtgtgtgtgtgtgtgtgtgtgtgcacgcgcgcgcacgcgcgcatgtatgctggagattgaatgcagggcttcacacatgctagctggcacactgctattgagttgtatagctcagcctttcttttctcagttcttagtttgaaaaagtatctcgttaagtttcctggctgtcattgaattcactgtgtcactggtgtaggtcttggccttgtgatcttcctaccttggcttcctgagtaactggaattacaggcttgtgttgccaggcctggatttttaatgaagtgggccccacactctcccatttgacctgggctaagaagaacaaacacaagattgtacacaatgagcccacaaggaggcccggacagagtccatgataatgtaggaatggccaaaatgcattaagtctgtttagcctgggtattagctggtgactggtgagaatttagcccttgtgctcttgatggatagcaactgaaatagaaagttccaccttccatgcacctgaccggtgatcatttaaggcctgcttctatacagcccttgcctgagaatttttttttccagtttatgttttaaagggattttaaataagcatacaatgtatcagcaacagaggttatctatttccctctaggtatgagttcttttttaatctaacttgccatggggtagggtggtgagaattgccaggtcctgcagtaggacagaggttcactaaatcaattcctaatttagattgttgattcttggatacccccacccacacacacacaaatttcatgatctagacacagaacccaagaatgcctgtgttagcatcctcttgtgactctgatacatattctgtcatagaagatcacttttcactcagtcttccagatagcttgacagataccgagaattttggagtagattgtggccaagtgctaaggaagtggtttttggtttggtttggtttggtttggtttttgcccaattgtggggcaaaaatagggtcccgtgatcgcttcggggctagggccactgggcgaggtggactcaggagtttgactgcgctgtagagcccacagaactgagggcaggtattggactgtgagaagccatgggatccagttccaggggtgaggaaagggcacagtctggggtcccccagaactgctgggctctgaccctcgggcaccacagatccctgggcaccgcggaagagctggttctggggtcgaggaagagctgagaactaaatggggacccttgggcagactctggcctgggaggggggtggcaaaggaaaaagagcaggaaggagagcttccgcaggttgccctggggaggagagagtctggctagctcaggcggcttgctcaggggggtggcttagggtggtggcagctgtggctggagtatagggaggcctcttggagggaggttagacccttagcttgttaggggaagacctgctccattgctccagcacgctgtcaggatgagcagagaaggtccatggttttaaggtgtttattgtagaaaggtagagagaggggagaagtgtagagaagtagagggcagccatggcaacatggagagagggtggaagggagtgggggagaggggaagaaagagggcaagagagaagcaagagagtaagagagcaagcaagagagtgaggaggagccgggcatggtggcgcacgcctttaatcccagcactccggaggcagaggcaggcggatttctgagttcgaggccagcctggtctacagagtgagttccagaaggacagccagggctatacagagaaaccctgtctcgaaaaacaaacaaacaaacaaataaataaagagagcgaggagggggcaagctacctggctgttatggggagtaatgctgttgccaggtaactgtggaggtggagcatacctggctgttgccaggtaactgtgggggtggagtccagacagaataccaggagcttggggcattgcctacatgacattgccacacacctctctggtggggcggggtgggggtgctgtggaaggctatagctgcaacaggagccaggagccaggagccaaggaggagtggctgaactcctaccgtcccatgaaggaggaagtcattgcccatctctggggttccaggccaagaccaggctgtctgtacatagctcaccaccccacacccaatgccccatacccaatgacttccattcttaacacatccacagttctctcccaaacccctatcaggcctttcatgtaacctatactaaagattcatggaggaatctaaggcctaggaggaggtttcctctggccagcacacatgcacctgtgcacagtataaataattcaaataaataagaatttgtaataaattaaaaaaaagaaaggtggattttgttgtactaaatatagctaataatgtcccttgttcatgctgtccgtcctaagccatgggatgctgacctttcgctttcttctctgttctcattattctccttctgtctgccttgtatccctggtctgtctctttcctctgctgctctcttgtgttctctcccactttcctcccttggccttttccctctttccttttgtcgctacttttctcctgcctctctctgccaaactcttcccctttccagctatctcttctcatttctttccccttctctgatttcatttttgcatgcccaggattaaagggttaaaacagcaacaacagaatttcctatgtaaatatgttcctattaataataatcatgctcaatggagatcttcgatttcagagactggtgtacatgacaactacagaaggaagcagactttaaatttctagtagtagtctgtgtcttgttaatgatggggctaccggtagcagtcatgttaacaataatggtttccttttattttttaattgtagttcattttaactgagcttgcatcacttgccaaatatcgttctaagaaagtatatttcagtgtaggctgggaccctagtggatatctaagactcttgtgggagccagtgaggtcaaaattctcatcataatcctaaatatcatttgcttctttcattgtgctgacatttgtactggttatacaaaagcaatgggaggtgagactgctgactctatgacccgagccagggcaaggcatcactgtagtgtttgtcttaatcatgaacaaaaggggacagaaaaagccagatttgtctttgaaagtttctaacaatggagcaaattttaaaccttgacctttgaacacatgtccatttaatgtctcctatgaaaccatggggatgaagctatagaatatttctacatgcttagtgtgtttgacttgggaacttacttagtctcccttttcactgaatatcacttttattgggaagaagaactaggaaactctgcttatgcaaacttgggtacttgacagacattttcctgcaagaggatgaaggcaactgtaattttaaggaacatatcctacaggtacaatggccaaactaaatgatccctccttaatgagacagaaggtcatgttatctcttttaaagtcatcttattctctcaaatgtcatttataattaaagggaaaatgtgcttggaatacaaattaattttcaaattacagagcttaaacagttttccaaggttgatgtagtatgagccctctcattttataaattagaaaaatagagcccatatattgaaaattttaccccagatgacatttcacaaatggatgatttatagagtcctattttatggtggtttaaatttccaggcactttcatgcattcttttttatctgaccctcacacaggcctcggagtatataaaacagtataaagatcaagaaagtggagactcaaagaagttaatcggctcaaaagcattttctacttcctgccctttcttctcttagctcaaggtcctgaacgaaaggcagtgcaaatgtagaggagatggacattgtacaactcagcaactaaatatttgtgaaagatgaggaaatggagaagccagggaaattcctgaaactgctgtagcacttggaggagaatggatagttgagaaactgaaaataaaaacagaatagagtctttctctcaataaatgttgtgtcatctgctttggagaattcttcgatgtagagattctgagcctttactgttttttgggagagatagcatgcataccagtaactcaaacttgttgagggttgatctgttactatgtattttagtgttagatactggccctcaaggtctacttaaccccaaggaggaggagatccgtactacttaacctagctccttattttaaaaccattggtaaaataaagaagcctacagcctgggcagaagagaggtgggcgaggttttggttcctgagcttggagtctaaagcaggaccaggagggagaagatggatagaagagaagacaccatggggtaatggatcctgagaactggccatgagggctagccagttggacagagtaagagcatcccaggtagaccgtggcaagttatatctcagggttattggcaggaagtagacatatagcatagaagttagacatctgcccaactctagtgctttttcacattatagttttattattattattttatttacattctagctgttattcccctctttgtcccccctcctacagtttctcatcccattcctccttccccttgcctcggaaagggtgctccccccgccagcccacttccttccctggggcctttagtctcccaaggattaggtacatcatcttctccctctgacaccagcccagcccacgtatgctgcctggtaggtggcacagtctctggtagctccctggggtgtgagttagttaagactgttggtcttcctatggggttgccctccccttcagcttcttcagtctctcccttaattcaaccatatgggtttctgacctcaatccaatggttgggtgtaaatatctgtgtctgtctcagttatctgctggttgggactctcagaggacagccatgccaggttcctgtcagtaaacaaatcatagcatcagtaatagtgtcagcccttgataccttactccccccacccataagatagatcccaagttggagcagccattggagctcctttccttcagtctcttctccattttttgtccctgcagttcttttagacaggaaacaactgccagctctagtgctttaaagggttaagttttacatcatttatctgggaactgaatgatcaaaggtgggatagaaacctctgattgagatgaactatttactacaacgctaactcatgataaaaattgttccgtgcctaaacaaacaaacaaaccaaccttaaatgaagttctgttgcttgctcactgaagaattacttttggtcacaggaaatgtttgtgtaaagaggaagtatctgaaaagagtgttaccaaatggtagaatttgggtatgtaaaggtgattacatggaaacaagaagaattcaccacagtaaactagtgagagtagtatatagggaggaatatctgctatagaggctagtggagaatatgacgtgtatatgaaaaatgatacacaattacaactgaatataattactccactaaattgttggaaaatttccctcagaatctggcaatgtgataatgttgcatgctatgtttacatgtgaagtagttcctgaaaaaccttgtatgttgaaggcttggtcccctgccagtgacagttgagaagtgactggatcatgggagcacttacttcattagggcacaaatccattgatgtctagctgaatggtctgttaggagacagggccctgctgaaagaaattagtatacccattccctggccccttgatggctgcctctgcttcctgtctgccatgatatgatcagttcttttccctagtaccattctgctatagcatactacctcatcacaggaggaagaataatagagacagttggcacagactaagacctcagaaactgtgagccacatcagtgtttcctcagctggtcttattggtgcacacctgtgatcctaggacttaattgaggatgaaggatgacaagttagaaagcatcctataatcaaaaaaaaaaaaaaatctttccttccttggttaattttgtcacagcaacatagtattagctaattcactctagatttggacagttctctatttgaatttttttttaaagtgatactctgtgggatgtatagaagtgtatgactgtaggtccagctacttagactgaggcaggaagatcagttgagcctccaagaattgcaagacatcctggacagcacagttagacatctcctcaaattctgtagcctttcgataactttagtctgatctcactgagaaatccagtcaattctttcaagtgcattttcacctgaaaacatccttagtgtgccttggagaagcttggattggtcttccagatctttcttctcctttgccaatatgttacttttttttttttttttgccagcgtaattaacctgatttagatgttctttcctcctttcccctagaaaagtcagaaaaatatgattcacgtgatgttgaaaggcttcagcaagatgataactgggttgaaagttacttatactggagacataacgttgtggatgaaaccctgaagatgcttgacgagagttttcagtggaggaaagagttctctgtcaatggtaagctggccgacttagcctggccaaggcaggagcatctgtataattgttactgttagatgtttgtctgcacttgcactcagtcctagcagtcagcataaacattacaagattacctctagaagcctaatcatactttcaaagggacagtttatgacaaattcttaggaggcgaatcactcataagaaaatcagatgacaaggaactgagtcacacagtgtcactaaaagcatgattacctagtctgtgtttggtttggttctgttaaacaacaaacatagccttccacctcaggcctaaatagaaaaactcattgctgcgctgttttttttcccagttgtttctcatatgtttctatatctccagagtaccttatgcctattgattattctaaaattgaatgggaacccccagaaagaaagtttcttagtgttgttaacacgtgttgacacgtcaagtcgttatttgaaacccacccagaatctacagaggcagccataaaaataagagcctttcctgcactttccattatctgtaaatcttttgttacttgttttctctggaaatcctttgcccattgttttctcagaagcaactctttctagttttttgtttgtttttttttaatttataatccagccattgcccccccccccctgccccgttcccagtccaccccacaaagttcctcatcccattcctccttccccctgttccccgagaggatgctctcccaccagcaggcctccgccctccctggctcttcaagtctctggaggattcaggcatgtctcccagtgagctgggaccaggcataagttatattttattcaagacttaagtaaattgtatcttgttcaagtctaagtgagaagaaactactatgtgacatttcctttacagtgtgagttttctttttagaaccatgaattactaccatgactgatccaagtttatcactttctagaccttagtgaatcctctattccaagatggttattagaacttggtggtatttatctccatggttatgacaaagaaggtaacaaattatgtaagtatatgtgattcatactctagactttcaagaccttgcaatatacatctgtatatatactttccatatgcatatataactagttttctgcaactggagataggtggccatctttactcctgccaaatactatcaaggcatagtttgcattattataaattaagcagtaaacacaaatgctgtgctttagtttcttgtctatccaaggaaatgtatagaagaggttttggggggacttagggtttcagagggttagccttcaccaccataatggccagaagtatggtaataggcaggcaggcatgacactgaagcagtagttactcagtcataggcattttaggtagtcatgatcttcttctcccttgttgctagtgctccacctagtatgtctttttatggagactctttggaccattgctaaatagccaaaacagacatgtaagtgtctcctggtctcctcttagccttttctgaaatatgtgtagtagtgggcattaagttgtctgttgttcaggtgccttttttttatcccctcttccacttgcgcaaatctcggttgagtttgtactacagtatcggagcttatgggcatcctgctcgccttttccttagcttgttaacctcactgtattttgacagcacactgcacagtcttcttatttctctgcctcttctttcttagtttctttttctcatacttcttctgtggtttgcccctgaaacatgtttcccaaagcctgctcgagctgataatgtccccatggggtcatctcaaacacatcagccttgccaacttcccaattcatggggcagatcctgtgcgatttccaaacagctcgcacatgcccagctggtgtctcttgactgtgatctgtcttcatcatgatctacagctcacacctactgctcgtcctccttccctcttgctcagctctggcccatgtgttggctctccctgcaatttagctttcattgtggccccgtttctcttcagcagccactcccacagttcagtcctgcctgtcctgttcccctgatgtcagctccttccctggttgtgaccagataggttcctccttcacctcttccactccaacatctatggcattgcccaagctaggctttgaaatgggaagaccaaatggaagggaggacttcagaattatttagctagtctattctctgtctcttttctacttcttttcttgccacccatcccattttagtcttagctgccaccacctggagcatttgcatggtccactcgcctgcaccacactctcccaggcctcctgcccgcctgcctgtgtctcttctctgtgtggaatgtgttttctagcaatttatcaaagcattggctttcctcttgagcatagtgaagaacacttctgctttattacatgtttgttcacctgcagttctcttttcagagagaatgtcacttaaatgtgaagtctgtgtatttcctaaaggagaaaaaaatagtttgcctctcttctgctttcatttaaagctaccaagtgcaactgttttttattttaaaggggggagaggtgtttttattcaaaacaatttgaattataactgaaggaatatgtcaaaggaaagaatatatatatgcatatatttcatatatataaatatatatttcatatgtgtgtgtgaaaatgccataaattatatgcttatttttttatctgtttttctgcataagtctggatcagagtgaagtatcacataaaagatcagaaaaccataatggacaagaagaagctcatagcattctggttggaacgatatgccaagagagaaaacgggaaacctatcacagtgatgtttgacatgtccgaaactggactcaatagcatagtaagcattctgcattaattctgagtcattctttgttcccattccctccatccttgctgtctttttgccaaccaaatattgtaaaatgaagctagcagaatgcaaaaggattcatttcccccttgcattgcctgtgaagttagacatggactagggtttgcagagaatgacatttgcttctgtatttggcaatattccctgtctagtgtataacatggagaggtaagacttgaaggatggcaaggtacatggcactgtgatggatgctgaactttattttttgccatgttaaagtccccccacaccaacctccatgactggcacagagtaacacactcactaaatatcgaagaagcacatgcatgatcgctatgaccttgtatttttaccttgttttgaagttgcatgtgagtttacccagtgtcacgctctgtgtattcttcttggatttttaaaaatttgtttactttatttggtaaggttgagaaaccagctttcttcagatgacttttggcagcttgaaaacagagtttaattaggagttgcagtatcaatacttttttacatacacacggatagccccagcacctcatggagctgaggcctaaacatcatttgaacttaggagttcagggatagcccaggcagcagagtgagaatgtctgaaaaaataatggaggattagaaaaagtctcaatatccaacaggacaaaatggtaaattatattatacctaattggtagccatatatgttggtgtctgtgaagaatgtgtaataatattggagaatacatttttaagaggaaaagaactgcgttacgatagtatattgctgtgtaacccaaaatggtgatgtcttagatttaaacagcaaaacgagttagagagaacaattcaaacgagctttaggggagggagatggaagcatgttttttcacattaagaatctaatacccatcgctactcggccttttggctaagatcaagtgaagaatctaataccctgtattttttaaatgtagttgccgttgagtggattttgagttataaagtaaaatgttttatatcataaattaaactcaaattatttaaataagactatactcaataaagttagactatgattctattgtcctttaggcgccacagtcacctatttattaccttgcgactacaaataatgtatgctaatgatttctgatccctaatatagggagagggaattgacaagcgctatctgatgagttttcaacagactcacatgttgtcatttctaatttgtaaagaaagtctattggttctattggatacctcattctttatcaatgttataaagcacctgagtctttattggataatttggtttattatataacactcatgattcgcaaagtcagtttataaagatgcatatagctgaaaggggtttgcagccccacaggaggaacaacaatatgaactaaccagtacccatttgattggactaaaccaccaatcaaagaaaacaaatggtgggactcatgtctctagctgcatatgtagcagaggatggcctagttggtcatcaatgagaggagaggcccttggtcctgtgaaggttctatgccccagtataggggaacaccagggccaggaagcgggagtgggtgggttggggagccaggggaggggaggggggttttggagggggaaacaggaacagggatagcatttaaactgcaaatgaagaaaatatctaataaaaaattttaaaaaagaaaaaaatgatgcacatatgggacataaaatgctttagtaagaattggactaccatgttgcctgtaaccttttggcttcctagctaaaaagaatggaatcatttaatattctacaaatagctgaattttaataatttaggaaaatgcattctcagcagttgaactagaaagaaaaaccttgtatttgtcatcaagaggatgaacactgtaaatgacacagataccattctgaaagcatccttagagattgtacaatggtctatttcatggaggtgtgttgtgtaatacccagtgtagacatacaccactgacttgaaatcccccaaaatgaccttttatgaacaaggacagcctactgaataaatgatggtaatgactactagataaagactagtaatagctgagagtagtcacagattaaattaggtaaccagtattttatacagcaagtttttaagtccttttatctgacttttaattaactgtagattttttaaactatgcctactgcatataaagactatttataaaggtattactatatactaggacttctcacagaataaatagttatagttaaggatgcttgatttcagtttactgcaattaaaggcactgcaactcatatgctaggaaagactttatagcctctcctgtctagaattaccagcctttcaatagctgtgctggattgcagcttgtctacttagcacttcaaactagaagtgtttataaggctgctgaacaggatgaatggattaatataggggatggaacatgactaatatccctgatggcctcatttcctgttgttgtgtatgaagcaagaaaactaacgaggcagctgtttaatacagtctcctaaaaattggaatgaataaacagctcttgatcataaactaaaaaacaacaacaacaaactaatgcagggcatcttaaataagaagtaaattggcaggtcagatcaatgggatccttgtatagagaaataatacagcatattttattgaaatttgtataaggtaaaaattagatttaggaagtaaatactataccataatgggtgtgtttgtgtgtgtgcatatatattatttaagttagttatgttgtaaactgtatatccttttcaatagttctttaattgttcaatagaaattttagagtctctctgtggggattgcttttatatccattgcatgccccatggcttttatagcttgaagcatatgactaatttgaagtaatccaaataaattttaaaatacccatgagtatatgacttcttcaactcaattttagggccaattcttagcttaataacctaaaaccataacccttagggctatagatacttatattagcttattttttaagaaaaatagttgtctcagttacatttaataatttatcactgttcaaaatgtataatttaatgttgtctgatacggacagtcttaaaatttaaatatttattttaggacatggactttgtacgatttatcatcaactgctttaaggtgtattaccccaaatacctctgtaagtaacttaatcctttataaaaatataatatattgagattgtagatggtatccaaaaatggtagttttatgttatagactctcctccctgaaacactgggttcctatgaagtactttaagtgtattcctaggtagacacgtaacaccttatctcagtagatgcatacttttctgaagtcgttttccttcagggttgttgttatgagtgaagtgctagactccaaaagagcctgcaacactgctcacccagctgtctgcaattatatatatatgtatttgcaacatgagcccatgtggcctgatctttgtctaaaattatatttctcatacggaacttgctgcatgcaagagcagataagcggtactaataaagttcattgtaaggcaaataatgcacagtgtgttactacttgctgctttagaactagcagtaagagaatactaaaccagaatgtactacattcaactctggtatctagagggtttctcgttgttctgttttcttatggtgctggggattgaacacggggcctttgtccttgccaggcaagtgttggttctaccactgaactaacatccacagcattgtttggtttgtttttaattttaactctccctttaatgatgggagttcaaattatggactctttctaagccttagaagctcatttttcatttgttggatttatgtaatagattacccattgggaaagtaagtgaccaacccatgcaaacagtcgattttatttcgccccagtgtgatacaagccaaaaaggcagaagaggcaaagggctatcaaaaatggaaattcacagagctgcctgcatgcattcctggcagataccacagttatggtctcttggggagcaaaagcataatggaagtctagagtcaacgccacttgcagccttatattgaaaacccttcggaggctattgttgaatgtttatagataaagaaaatgacagtattcaggttgggaaacttgaatattctacaattccttatatatctggcacatgccctgattcattaaatcttgctaagcggtgcccatgaatggatactaaagaaatactacttcacgatatcaacttgcttcttttatggacaaaacaaaactgaaatattgaacaatctaaaggataagccatgtagaaatagtactaataacagtataatattactttataaaatacattcagccttctaaaacacctgttggctgaatatttaagtttgtgatgagcctctgaggggaaaaagtgtaattatttgttatctataaaatatgtccaggattattttgaaagaactgttcattgattcacagatttatataatggtacatagaaatatcgctcatctagctaattgcaaatgatgtctctgtcctatcgaaattgtgtggttttgcagacataaggttttatagggtcttaaacttactgttcaaaagctgtcatgaactccaactattagaccttagttatatccctgctccaaagcagaaatactaagcactgagctacctcttactggtaccaagttctttttgtatattttactttgtgctagttttacataatagtctaggggattctcattttggacaagagtgaaattgcgtattgattcatctgcaatagaagaaagaatcggctatcacaaatcccctttgtggtttctgatttctttctcacatttgcttatagggctacttaacattctcagctccatatgtaaataacagttgtgtatacttcagaatttttggcttcctagagttcattaacaattaagaaaagaaacaatttctgtgtctcagagtcaaagggaagggacagcagtatgactagtcaacggtgtaatctcaaggaaatgtataagtgaagccatacattagacatggaaatcttgtttttaaagtctagcacatcatacccatgaccccttaactattttcttttgtaccttcgttaaactagcaagtgaacagagggatggatgggttgtttgccaaagaccagggacagtgcattactgggactcctccccattgtgagtcagtggttcagttccagccccactcacacattcctgaattagaccctaagcagccagcttcatagttctcatatgctagtccttttctaggtcaggtcaaactgatagactattgtagagggactaagtcacatgaagtgattttttttttttttttggtctttcagcaaaaatagtgatctttgatatgccttggataatgaatggtgagtatgttattatgttttttgattttcgtttgtcttacttggccaactcaactatgtgtctaatgccgtttaggaacatgttcatattatccttgtggactcttaaaaggctggagccaaagttctcagaggttgttttgtgaagatacaggactgcctgccattctctcctcagagcttgggagttcttcttcttgttttttctaaaatcagcaggaagccattccaacacctgggtaaaacaatgataaggaaccccccagaggtgaattacaaaacatgcattggctaggttttctcttggttcaagtgttgagggacaaagtgggagaaatctgaaagtcaccccagatcactgaagtcacatggccctttttgacagccataattttgctaagagtcttttgaagtggctattgaaaaaaaaaatccctagtgatttgaaaggcaattcttttcttcacattgattttgttggtgttccatacagataggacagagactactgttacatacacagccaacaacagggaaactctgtaaactgaaatttggtgctttcaaaagttctttattggcaagccttttaatactggtaaagactaaccaaataaaacacttatattattaaaatattagatcaaaaaaaaaaaaaagcccaggtcactactgactcatggaaataaaaaaatagttatagcaatgaacttcaaaaatgagatgaaattgataaattattagaaagacctagactgccaaagctgactcgaatcagaagtattggccaaaagtaaattaatcaatcaattaattgattgattgattgatttaaaaaaagtaaaaataaaattttaaatcccacaaagaaacattcaggccctggtgaattttctggcaaattctatgaaatagttaaagaatttaccctgaccctttgtaaacagttctaaaaataggccccaaaggaaaacattaactcatttataagtaaatacaatcctgctaccaaatatccgacaacaggaaaactggagatggcaaccccttccaactacagatgcaccaatgctctgatgtacatgctgaaggtacagcactggcctggcctgtgtggagccctgagttccacactgcagaaggacaaaactatcaaaccatagccaaagaaacataaaaagtattacaggtggcagagtgcttgagaactgagtttaatccctaagaatctatacaaagaagccagtcatagtagcaacacgcgcttatatccctcagctctgagaagtgagggttgggagaaggaataagcagagctctggagctctctgcccagccgttctaatgtaatcaatgatcttaggacagcgagaccctgtcccaaaaagacaaggtagaaaactattgagctgtgacaactaaggttgtcttctggcttctacatacatgcatatacatgtaagcacaacacacacacacatacacacaccaccaccaccaccaccaccatacaccaaaaagcattataagccatgacaaaataggacttgtcttagtgatgcaaagttggttcaaagtaaaaaaaaaaaattcggtataatatatcatattaataaaatgaagagtccaaactacagaatcatctcagtagagtaaaacacacacacacacacacacacacacacacacacacacatgccaaaaatctaataccctttcatgataaaactcttttaaaagtagcaacagttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggttgcacaagcctgcaatcccaccaacaatggaggagtgttcctctttctccacatcctcgccagcatctgctgtcacctgaatttttgatcttagccattctcactggtgtgaggtggaatggatacccacgatataagatacaatttcctaaacacatgaaactcaagaaaaatgaagactgaagtgtggacactatgcccctccttagaagtgggaacaaaacacccatggaaggagttacagaaacaaagtatggagctgagatgaaaggatggaccatgtagagactgccatatccagggatccaccccataatcagcttccaaatgctgacaccattgcatacactagcaagattttactgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacaagcagactttgtgtgccccggtacaggggaacgccagggccaaagggggggagtgggtgggtaggggagtgggggtgggtgggtaagggggacttttggtatagcattggaaatgtaaatgagctaaatacctaataaaaaaaaatgaaaaagaaaaaaaaaaaaaaaaaaaagaactctaaaaaaaaaaaaaagtagcaacagaaagtactgttgaaacaagtcgattttaaagggatctgatcaatctataggactgccatcaacaaattcaagaagttccctaaatggctttcaaatgtttgatcactagctagagctcactgaaaacaactgtgctcgtcattgttatttattgcaaggaaaagatttagaaagacgttccaaatgtgaaacagatcacgctcactatcgatgtgaccagcacacagggaatattgccaaccaaggaaatactgaagtgaaggctgcatgccttggttatcagaaattgtcttggggcttcattatgtaggcatgagtgattttgcctgagcctagtcccaactagtgctccatggcctactgccctaccttaaatcacacttggttcttctctcatagccaagtcctattctaatccgaggtcatgttgttcccactacaccaaggctcccaggccaacaaaaagagacaatcctaccaaacaggaaggcttcctcccagaagctgggagcaaaagccagacctctctttaggtaagggtaatttttttaactgcatctgccagagctctttggcctgacaaagggcttttatggtaacccacagctagaaacagttgtgaattatttcaataaagctggcatgaaaaaaaaatcagacttaacacttcgtttaattccaagaacataacttcaatcctgtcaaggcacaggctgttttaaattaaaagggaaagtttaaatagtacttgaacaaaagcctaaatcatagggagccagaataaagaaaaaaacatgattttctaaaccacactttaagggttctattattctggtttctgctttcttgtctactgccacttttgcatatttactgccacattatacttttaggttttttttttcaaaataggttaaaatgtcccattagaaataatattttaattaagtctaaaactaataacacgacataggacagaattgtagctgtcaagtagctacatttggtagcagtttattcttgtagcctctttctcgtggttatataaactgcgcagcctgggaaaaaggcagagttctgagtcaggaaggaagctggttctggctcacacccataatgagcaggccccttcctcctgtttctgcctttccctttgaggagggattttatattgagggtttatcagaagagccacaccgtaaaggactcttcacaacatcgtgcagttccttcctgagacacagagccatttagttcattgtctaaaagtcatagttgttgaggccactgatggatgtggtcacaggtcaggaccctgagaagcttttcggtgagcatcagggtaatttaggcttcctggatctccgtggagcagtcgaagcgttgtgaggggcatgcataccacaaagcctgctggatttaaaggatagcaagagtccagcctcagaaaaaaggcagaacagctccaagttctaacgctttcagaagggctgggctagtgcatacagtaaagtgcttgacaaagccagtgtggtgacttgcttgtttttcctcagctgctttcaaaattgtgaaaagctggcttggccccgaagcagtaagcttgttgaagtttacaagtaagaatgaaatccaggagtatgtcagtgtggaatacctgcctccccacatgggtgggacagtaagtaccatccttgaaacttgttaaggtagaacaccgaacaatgctaggcttctatactatgtattcaaaaggaaaagggcaaatcttttttgtctgtttgtttgtttaatttttattcttctcccatacaatacatctcaatcacgattcaatttcccctacccaaggagatgtaggccctatcttaatgcaaaaagaaggattagtgatacccctaaaataagatgcagtggtgtggatattttcatgttttaaagtttactttttgaataggctatgtgtacatatgattctaaactgggggggggggaggtgcattcaatattcaaaagtatatttagaagcagttctttataaaatgtctcctcctcgtgtctcaagcaccctattgtcttctgtggttgcatttcttagattaatttctagagatgtgcctagcatgtgtagacaggtgtaggcaaagacacagaagccttcctcctactcatctcttttttatataatatcattttttattaatttattttttacactccatattttatccaccccacccccgtccacccttccactgtttcacatcccacacctcctctccacccaccctgtctccatgttgatttcttcaccccccaccccacctgacctctaaactccctggggcctccggtctcttgagggttaggtgtatcatctctgaatgaacacagacttggaagtcctctgctgtatgtgtgttgggggcctcatatcagctggtgtatgctgcctgtttggtggcccagtgtttgataaatcttggggaacaattaattgagactgctggtcctcctacagggtcgcccttctcctcagcttctttcaaccttacctaatttcaacaacaggggtcaactgctttctgtccattggttgggtgcaaatatctgcatctgactctttcagatgtttattgggtctttgggagggcagtcatgctaggtccctatttgtgagctctccatagcctcagtaatagtgtcaggccttgggacctccccttgagctggatcccactttgagcctgtggctggaccttcttttcctcaggctcctctccatttccagccctgtatttctttcagacagaaacaattatgggtcagagatgtgactgtgggatggcaaccccatccctcacttgatgccctgtcttcctgctggaggtgggctctacaagttccctctccctactgtcaggcatttcatctaaggtccctccctttgattcctgagagtctctcacctcccaggtctctggtatatgctgtagggtccccccaacctcctatttcctaaggttacctgtttccattctttctgctggccttcaaggcttcagtccttttcccttacccaataccagatcaggttcccctctcccccgcctccctttcattttcccactttccctccctactcatctcttttaagtaggtagtgtgttgggacagcactgtacctctccggtttcccttcacaacctcgtttaaagatcattctaagtcagtgtatggctgcagtcctccagtttcatgaactataagttactgaatttgattttgatgtgtgcccttggttttcttccctgcctttcctacccagtggtccttttaatgtaatgcaaccttaaaaacgtgctgccaaagtttagaagggttgtttgacttgcactctaaggatcaaaccctgagtcagattcatgctaggcaaatggtattgcccagccctcagaattttttttttgaactgagttttatttcttaaaacataggtcagaaatgagtgggtatgtttagaaatattaatgttgtgactaggtgtggtagtgcacacctgtacccagcactcaagaggcaaaaataagatcaaaagttctgggccagccgggactgcatggtgattctttgtttcaattaagtttggtttttttttttttttttttttttttttggtttggtttggtttggttgttgttgttttagaatttacatagctgtaaaaatgaatgcgaaagcgaatattcttaaagtgtgaaacctctgtaaatgattgtaagcatattttgcctgcctgacaaaattggatttaaagagaagcaaggattaacaacattcgcttttggtgtcactgttagttttcattaattagaagagacttgaaccaataaatttaatttgaagtctgaacctttcttattcggaaactttacactttgtatttgaacctaggaaaactgtatgctacgtcggatactatattacacctgtagttaaagcaaaaccatggttgcaattttccccttttttatattttatttttgaggcacagtctgttgtagcccaagattgcctcaaacttccaattcttcaacctctaaagtactcagattataggcatatagctgtcatactcacctctcctgttaaacacatgagttttgtttatccacatgagttttgttttttaaaatgtgtgtgtgtgtgtgtgtgtgtgtatgtgtgtgtgtgtgtgtgtgtgtgcacttttgtacatatatgtgcaggtatccatgggggccaaaagacactttaaaaaataccttcgagctggagtcaggagtgcaattttctgtgagctgcctaatgttggtgcagggatctgaactctggtctctgataaagcagtagacactctaccaccgaaccacatctctatcctttggctttctttttgcttgattctgtgttgtgtataaggctgtgtgcacatttgtaagtgcatgtgtttacatatggaggctacagatcaacagtagatgtcttcctctattgctttccaccttattttttgcatctataacttacggattagctaaactgcatctataacttacggattagctaaactggctggcatttgatcccctagggtcctcctgtctgtacctcccagtactagaattaaaagcaagtataaccaaccacacatggcttttcacatgggatctaagttcagctcttcatgctagctcaacaatcactatgcccactgagccatattttttaatatatattttgtttgggttttgggatttttttaacttggttagttgatttgggtttgttctgttttgtggtgctaggaattgaagccaagatctcaaacatgctagcgaattactctacccttgaaccacatcgagaaccaattatcaatattattgcactgcctgtgttctgtgctgtgtgtggatgagtctgccctacttagatatttattcatttcattcctcttctggttttatggtttaaaaatcgcacaagatatatacagtacacttcatgcgtttagtcatctgaccttttttgtgtggagtaagctaaagatctaacttgagttgtttcttacatggcttagtctttatttactgctctttcccttttctagtttgaaatgaatcccattttttctttatagttatgcttattttcttggccaaagtagtccagttttcagtataccataagagaattatttctctccacagtaagagcagactgataacgaacgttgtctcatgtaggatccattcaagtatagctacccaccactggtagatgatgacttccagacaccactttgtgaaaatgggccaattgccagtgaggatgaaacctcaagtaaggaagatatagaaggtgatggtaaggaaaccttggaaacgatttctaatgaggagccaccagctctgtctgaaaaggtaattttaggaaccaagtataatggaatcaaaagctgccagctaaagcttgggacatagctcgttggtacagtacttgcccagcatatatgatgccctaggttcagtccccagcacaggggaaagtactgtgctgtcttccaagctctgccaggggtgagtgcttgagccaatccagttaccttgcctctacacttttcttgaaaaaaaatgggatgaggggaactgaattacagcatcatatatttataaagagctaactctgtgctttgtacaaaacacggtgaagtacatctggaaggaatctttgtcaaaaatgtatttaaggttaaaaataaaaatgattaatttgaaatttcaccagatccagttcttctgaatttcattttgaaggacttgttaattgctgttcttcacaaaacttagcaagagcttgcttgataagtacattataatttagagcagaaactaccatcaagtctgtcctgtttataagggcatcgtacaagtatttccccatggtcagtcatgtcagtatacattaaacatgtcatttagacatgctaaacatgttttaaaaaaacctttgttttgctttgaatctagatggttatttgttttcccagtgccttgttcaactagaactaaaacatcttcatcttttctaccttgtttctgtttctttctttcttttgttgttttttatgtatagagtaacccaactgagtctgtttccaaaaaagatgaaaatgaaaaagttgattcaaagacgaaaacttttaaaaagccattgagtgtttttaaaggacccttattacacatcaggtaacaaagcttgtattggctgccttcttgtaacaggtcttgatcatcttggccgaggatggggtactagacgattaagaagattaagaaaacttctaccctggcattaagagtacagtacaatttgtgcagagtacaatgtgccttgttttccagacttagtgaccatttctatctttttttattattattattgattgcagtgtgtgtctcatagccctcgtcacactttggataggagtattgaatattgactaaatcttaatgatgcttggaaaaataaaaataaggggatgagtttgttgatctgaccttctgaaagaccagcttgctcttgaagaatgaggctttaactaaaccctaaaggaagacatgtttctctctgttccaatttattaattcagaggagtcagatagggagctagggatgtagctcatagttaggctgctttcctgcattatgtgaagccctgaatttgatccctaacactgaaaagtaaaagaagcccagagctatttcctgtattattctggtcagtattgctatagcaacactagtcagtgatgacctaatgtgaccttttggtccctttcctttaaacttttcatatgtaactatgtttcgagtatatcatccctcaacaattcagccagactgctacagaatttaatctcaaagtctctaattgacgaaactgtttcttctacatatgggttgagtactattggagtgggatgtatagccattgtctgtgtagatatctgagtaaggagagacacataacataaattttgtctcccatgttgtttctttgccattttcctcctttggagtttgtatgtttgcacttttttgtctgctactttggaagtcagtgttccatgcttctccgtagacccatccgaagcataaatcctcacctgcaactcttgagggttaatggtgacagaagccagtaaggcaggttagaataggacaacttccaggattgcactgtaaacatgactctaatacctgtgccctgatcagagtcacagaacgtctccttcacatgcacaaggtcctcaccagtgtcatctccccatgctgcctgtgatatttctactgtttactgggaggtactctgacatctataacattgctgtgccttcatgtctcctgttctttgagctccaaaaaggactgagcagttctacacttttaatgtcttgcccaaaggtgggcaaggtcatccttaaacatgaatatccttgatgtgtatgacatgtctaatgtaacataacagacagaaacatacctgcagctaggactaccaatgcaaggtttcaattccagcagtcttaggaggcaagaggctcacacttgaaggctagtctaggctacctagagagtctgaaaaccttcctgttggaagtgtgtgtgtgtgtgtgtcccaccacttaaagcaaaatcactagcccagatgtccttctggttgttttgaggcacttgatctgtccggctaatgctattaaactacacaacaatttttccagagagttgagtcttttcattttaggttgtagatcttccagtagccactaatggcaaacttggaagcttgagtctttaatagttttactagtttaactgccctctggaactactctaaatttctttccatgtctatttttttcttctccattctcagaaaagccattctatagtaagaaattattctgttacttaaatgtatccctaataatctttctctgagcttatgttcttctctgtttgtataaaaaggatgctcgtggctaatctgtttgtaattagggaacactgaagcagcagtgccttctgtgtttttgataataatctataacctcccaaggagtttaaactgagccaccttagattgtgttgattgtaggattaattcagcagcttcgtaattctcttctttcccttttctatttttcttctgaccttagggaaaaccatagggcttcccagcatgcatagcatcaggaagtttaatatataaaatggtattaggtaactgttttggccaccatcttttgtaaggaagtctcttgagcataaactaccggccaaacatgtttttagactcatgaatccagtgctgtttagtctgagtactgcaaatgccttctttgttttcctcctagcccagcagaggaattatattttggaagcattgaatctggagagaagaaaactctgatagtgttgacaaatgtcacaaaaaatattgtggcctttaaggtaaaaaagaaaatcttaaagtcataataaatgacgagggtgggtcaatggcagatgatttggggcattcctaaaggagacagttatagttaaacaatgtgttgtgtgtcctgtcccccacccccatcctgtactccctcctagtagaagggctgataagtgagcttagtctcctacacttcgtatttggtgacacattagtattcagtagaaactacactcccagctatatcacgtgtgagggaaaaggcacatttgattcgattgttttgtccttcagggttgtggtaaattagatgttttatctaataaagattggcctctggcctgcacacacatgtgcatcatacaacaagaggaaaactagggacaagtgtaatatagtgcatgtccttaatcccagtccataagaggcagaggcaggtgtgtcagtatgagttggaggccagcctagtctacatagccagcttgggaccagcaatggctacaaagacctgtctcaaaaaggtggggaaaagccaagtgctgatagagcttaaaagtagttacttttatctttttggtgatttgtttattcgctgctcttctttttgaaagccgttcttaagccttgcccccaaaacagcatgtgattagggggtaactatgtttctaaataggtgagaaccacagctccagaaaaatacagggtcaagcctagcaacagcagctgcgatcccggagcttccattgatatcatcgtttctccacacggaggtgagctgttgtctctctctctctctctctctctctctccctgtctctctctgtctctgtctctctgtctctctccctgtctctctctctctttctctctctctctctctctctcttcctctctctctctctctctctctctctctccctgtctctctctctctctgtctctgtctctctccctgtctctctctctctttctctctctctctcttcctctctctctctctctctctctctctctctctctctctttctctctctctcatatgttcagaagtagttgaccaccaaataatggactccagaggatttttgagtgcttttatttggttacagtttgggggtgggggtggggtgtttgttttctgagtggtggtttattttgttttcttggttgcggggagtgttgttatattggggttttgtttgatttttgagaaaaaacttaaagtttggcagggtagggatgggagaggatctggaaggacttgggggaggggaagagtatggtcaaaatgtttcaacttaaactgtttttctataataaactatattttaaatagtaataacgctttaagccacaaatccagccccccacccccaccccagtggcagttcgagttcataggtcaaattactcttttgaaatgcaggtttaaccgtctcagctcaagaccggttcctgatcatggctgccgaaatggagcagtcatctggcactgggcctgcagaactgagtcagttctggaaagaggttccaagaaacaaggtgatggagcacaggtaagtgtgtctgctagcagcctctccgctgtgatggaagacccagagtcagacctgcctc

SEQ ID NO: 697 - DNA, 50673 bp, mus musculus; identical to SEQ ID NO: 124

SEQ ID NO: 698 - DNA, 96803 bp, mus musculus
agcttggcgcagccctggccaggcgcgagcagcgggaggaggagctgcggctgtggccaccggggtaagtccgcggcaccgctggaagctgccgacggcgcgagctggtccccgcgtggaagaggcacgggcgacccggagtcatggagcctagtgacgcggcgcgcccgggtcccgggagagcttttcgggggctgtcgccgcggctgctgctgctgccactgttgcctgtgctgctgggtcgggggctgcgggctggggccgcggcctcctctggggcggcggctgaggacagcagcgccatggaggagcttgccaccgagaaggaggcggaggagagccaccggcaggacagcgtgagcctgctcaccttcatcctgctgctcaccctcaccatcctcaccatctggcttttcaagcaccgccgggtgcgtttccttcatgagaccgggctggccatgatttatggtgagtcccctgctactgccacggcccaggtccctagggcagctggccgtactcctcccggtgccgcgcagtgctcctgcttcacttccaaatgagtttcttcatttgcgtttcccgctgagacgctgtgggtttccaaggtcaactgtctgcatttttctggctttctgcaacggttaaaaagcattttgtgtgtgtgtgtgtgtgtgtgtgtgtgggggggggggtgttcccgtttcgacgtttctttactaggaactaagatgaaagatacagaggtggctccttgatccctttgcttcattttatctcggttgtgctgctctccatcagcattgattccccactccccgccccagtttagatctgcaaaaggtattgggggatttcccagggagctgtgccaccccaggggacaggccacagagcgtgagaaagagggctgaatgtaaatcttgacttgggttgctcatggtggtcatcgcaggttggtgcccacttctgatgtttgtgttctttcatttcttgttaataaagtgcaatgaggaatacagagaaagatgagcgtggtttaggacccagactgatgacaccacaatgtcaggcctaactagagacaggtacccttatgtctcattgggaagttatgccttttgcaagtcaagggtagctcttataaccctaaaatataacatacatttctgagttcgtggagagaaaagtgatggttttaatcttggagtcagtcctcttttgttaaggatgggctgatcccactatcctttctggatttagtgatttagtagtatacagcatattacatgggcaaggctaggacatggataataacagccacaatctgagtcatcctgttttctctctgtgtgcctcctgtcacctccacccccaatggactccaaactagagccaagcattctttttaatttaattcagagatgttaactccctcaaagcagcatcctatagtggagagagaaggagggagccagggaggaagggagggagggagagagagggagagagggagagagagactgactgagactctgatggactgtttcacaagctagagcatgttacttcatcacagtatatactccactcaatttctattcagggatctctgacagagaatggaaagcaggtagcttaatctttaatgtggaaattactcttggtcctgggccttacaggtcttatggttcctgtttagttattaataaccagggcttatggctaccaaaccctttcagaaaaattgtatgagggactagtgctgtcaggaatcttccagtatggaagtagtggcctaaatagatcttgaaaccagaaaaccataaacctagttggttatcggaaagcacaggtctcaggacagactttggcctccatacctgctcatggagcctttgtagtttgtgttatttggtcacaaatgagtgacatgaggaaagcaggtaaactgagatgtttcctagcagatagtgaggaactgaagtacgttgccattttaggttattgactcagagccacgttggaaatgaagactgcctttgtatgtttatacaaatctatgagaatatatttattttacaaaattcagagcccactccttaaagaacaatgtgaaataggaagtacatttggtgggctcataaatgcatgttcaaagatacaaaaaataaatggggataaaaatatattctgaggattatcctatgttcatagaaattcagtaatagttatctttggcctttgtttcgttcaagacagggtctcacacaatagcttaggctgtcctaaaactcactgtgtagccgtggttggccttgcatttcagggcagttctgcctcagcctgggatgacaagcatgagctagcacacacagctccagtcatctttattttaatgcttaaagcaatagtgggattttcttttgctgatatatactttaaaatttcacctcggtgttttagccactgggaccacatgccagtatgctgtttcattttgtggatagttgtgctataaatgataaatctcataatatacctgtataattttgtcctttgtctttagatcttcttgctgcttttaaatgtattgagaggtttattttgtcagtgtgcgatgtgctgagatatgtcaaatatttatatgttgtatgatgtgggttgtttgtaattgtgagaaaacatttttctgcaggatattttatcttccgtttcaatcttctcctcgatccaactctgaattctaatgttacttgattagctaatctttcattatatacttaagattattagtgataaggcaggagactctgacctgcacatgcatattggtgtgcacacctgaacatacctgtgcacgcacatgtatctactcacagacaaagaaatcagattttatttctccgcggcaatagaggaagtgagtagttctcctgtctctgagtaatgcagggcaggaaggctcaggggaagcactggttgagtatctgtctgctgtgtgatagggatgcatagtaatttctggaaactacaatttaaatttaaaatgcttgttatgtttttgtaagtgaagatgttcaattgtgaaatccccaaaccctaaagtctttttaaagtctcattcttctcatctattttattggcatatattcgtagtacacagtcctggatttcatgagaacattttaacacaagtgtttggtacacattgacagtattctcttcataccctgctgtatcctccaggtttttttcctcctgcattctgccatttacctttttttttcattgagcaacgttttttcaaccttccgaatcctgtgacccttttatatacttccttatgctgtggtgatccccaaccataaaattatttttgttgctacttcataactggaattttgttactattctgaatggtaaatattatgaatgtaaatatttttggaaaaagaggttttcaaaggagttgtggccacaggttgagaactcctgctttagacattcaagcttccattttcatgtcatgaatatatgcataattttatgttatatctatgaagtctgggatttgcaaatgagagaaaatatgcaatatctgttttttgagtctgacttaatttacttattgcgataatatgcagctgcacacattttcctacacagcacataatttcatcattcttggatgagtaaaattccattatgtatgtataccacattctctttatccatttgacagatacgtaggttggttccatagtttagctcttgggaatcctgctgcagtaaacatggatgtgcaagtatcttgtcttggaatcctttgagtaaatatccaggagtcttccaccttttttctattgaactgatatttaatttgacagaagtatcttagtattaaacaaataaactagtgtagttataaatacctctggaagtatatgtaacaaactaggccttggttccttaggggacagaacctcaatggctgtgacttgtgagtcaaggcagatgtcaccatgaacttttttgtccattttgatttttgaactgtaaaagtggtgtaaaattatttacttactaccacatctatgccttctttctgtaggacttgtgatgcatgtgcgtcttacatcactcactttaacacccacatctccctatttaaatcatagtatgtcattccactgtccccaaggaatagttattacagtagaaatttacaccaatagatcctgtagtagtaagtacttgctcaggtacaaaagacctaaagataaaaagagacacattgtgaatggttagcatttgtggtaaaagacaaggaccaaaagacacttatgatcattttccctgataggccaaggcagctacaaggcaaagtgttctcaggcccaactttccagggattttgaaagtagcccccagaccttgacatgttagctgtagacatgtgggtaaggacttagcacagcaatagtctaactgtgttgttaggctagggagctcctggttgtctctgtaggcgatttagcaccattttgaagttactggctcctacatgtctggctgtatagtccaaaataaactgtcagttaattgtggttctctctcacatttacagtagttctacttcctctatagtgtttttgtgtcaactcatgtgtatccataataatataattgtgccatagtagcctaccacatgctttctttttttattagatattttctttatttacatttcaaatgctatcccgaaagtcccctataccctcccccgccctgctcccctacccacccactcccacttcttggccctggcgttcccctgtactggggcatataaagtttgctagaccaaggggcctctcttcccaatgatggccgactaggccatcttctgctacatatgcagctagagacacgagttctgggggtactggttagttcatattgttgttccacctatagggttgcagttccctttagctccttgggtactttctctagcttctccattgggggccctgtgatccatcctatagatgactgtaccatatgttttcttaattctcccttctccatgtttgccctgccagctttctgaagatttactggtcagccattttaagttctatggcttttgggttctgtgctgcatctctgttgctgattagaccttgattggtaagtgcagtctgagagagggcgttacaaagtatgaaaggggaaatatgacttaaagtcatgttaagtgtccatttgggaatctgttttggtgagactttctcaaattgctctcaccagataccagagagaaactagttaagagagggagcattggtttcctcttgtggtttcaccctgtcacagtgtggagcatagggcttcccatcacgttgttcaggaaacagagagactatgcttgcttccttggctagttctccccaccatctttttttttttttgtaaagctttatttatttgttatatgtaagtacactgtagctgtcttcagacactccagaagagggagtcagatcttgttatagatggttgtgagccaccatgtggttgctgggatttgaagtccggaccttcggaagagcagtcgggtgctcttacccactgagccgtctcaccagccccccaccatcttttttatttcatccagatccccagccatgaaatagtgttgcctactttcggggaaagcctttcttccttagattatcctctctggaaacaccttcacagccacaggcacaggcacattcacttcacagactacatttcagtagctaaggcgcttctcagtcttcacaccccacccccagtctcaggagttccagcactgctcaaaagttcaagtacaaaattttctctgaataattaaatcaacttctacatgtgagcccctgtaaaaacaaaacaaaacaaagccaaaaaaacccaagttatgtactttcaagggaaaaaatggcacaaaagtaactgcctattctaaaagagaggatcaggaaatagaaaagaaggaccagaaggactgagaccctgtgggggagcattaagttctatagctttaagtccagcatgtggtgctgtgacgtgagctctaagggttttgcggcccttcctacccctatcctatagtcttttttttttttttctagatagggtttctctgtgtagccctggctgtcctggaactcagtctgtagatcaggctggcctcgaactcagagatctgcctgtctttgcttcccaagtactgggattaaaggtgtgtgccaccacacccagcctatcctctagttttgccggttgtagtccacatgggtttttctcttgagctggccctgctttctgctcgcagctgtgcttggctctccattgcatctttgatttcatttatccagtttcatacactgccctctcaggggctgcctgccatacattagctagtttcccagaaattcctttgaagtctgggaggaaatttcaatgaccctgaagctcattctgcttgcatgtaaaactagaatcacttggacaacaccaaagtccatcacttttgagactccaatttgtcagggtatagtcaatccttaagatatcccctgcgctattcttattgtcctgttacaaaatacttggctgcttttgaaagacttttatttatttatttttctgaattgctctggctgttctggaactggttctgtagaccaggctggcttcaatctcacagagatccaagtgcctcccttttgcctccagagtgctgggactgaagagatgcaccaccactgcccagcttgaaagacttattaaaatatagttatttttttgttaagatttttgtttttatatgtatttgtgtctgggtatcacatttgtgtaagtgcatgaggaggctagaaagagtgtgttggattctctgaagctgaaatttcaggctgttgtgaactacctgaaatgggtgctgggaactgaactcaggtcatctggaaactctggaaacactcttaactgcagagcaatttcttttcttttcttttttttaaagatttatttatttttatttatgtgagtatactgtagttatcttcagacacacactagaagagtgcatcagacccctttacagatggttgtgagccaccatgtggttgctgggaattgaactcaggacatctggaagagcactcagtgttcttaaccactgagccacctctccagccccagagcaatgtttaaaaattttttaaattatttttaaagttgttttaatcttttcggacagcattccttcctgggtaatatcttctcatggacttttcttggagtactggaaggtttttcagacttttctgtttttcacttttcttcccattctcattgtaaacctggctaagagcttccagaagcttccatactacagcttgaatggtgttgatgctttctaatgtcttctcttagattaattggtttgttgttgtaaaagaaagtttcccacaaaaatatcaggacaggtataaaaatatagacaagatatttgtcagaatgtaacatgaatgccttatagcccaatttctaatagagtctttgtttccatatgaaactttgcttcattctgtatgcacaatggtcttctgacctcctattgtacttacccccaaactctgcttacagcagtctagggtttctcagcccacagcttcaaatgttttcatattcctgtcacaaacccaatggcttctgaactgcattatcaggtagtcatggtaacagcctcacttctctagtaccacatttgtgtgagactttctgtgtgtgtgtgtgtgtgtgtgtgtgtgtgagagagagagagagagagagagagagatagagagagagattcttattgctgtttttgagagagagagagagagagagagattcttattgctgtttttgagagacatagcttagaggaggaaggatttattttggatcacggttttagaaatttttatcatggcgggtaggacattgcatggtaaagcagcttacattatagagggggagggacagggagagagtcactgcacttgcgagagttttcccttttcctcttttattccatctggatctccagcctatgaggtggtgctgcccgcatttggtgtagatcttgacctcttagtagttagtttcccaccctggaattgcacttatagacatactcagctgtgttctaccaatatcctagcttgtgaatccattcaggctgagaatcaagaacctgtgaccaaatattgcactacctatctctgggttaataaggtgttctcatcaaaagaacctcctgccttggcccaagtttagagtagtcccactttggtaacaaatgtctctggattcaaattgctggtctgctatttataaagttgtatggatttgggtaagttctctgaaccttagtttcctcttttgggaaatggataaaattgctcacctcatagggatgatgcattctaaaagattaaaatgcagagcttgatgcttaataacttggtaagtattagtttccattctcacttaacacttttgtgatttctttggcaagctttgcttcttgaagtttgttcagtagaggcctgacatcgttttaaaatccatgaagcacagttagtggtgaggagaattgcatattgctttatattttttgtgtgctatttgctaatacctagaagaaagttgcactgcacctaccttccctttcatctatctatttccctccttgtcctctgtcctccagaaatttgtgttaataatattacattgtatatttgttgaaggaaaaatgctcaccaagaatggactagctaaatgatgctgcattctaattaaagaatattatacagcaagtgaaaagagatgtttgagacttttttgttgttttagtttttttttgtttttgtttttagagacagggtttctctgtatagccctggctgtcctggaactcactttgtagaccaggctggcctcgaactcagaaacccgcctacctctgcctcctgagtgctgggatcaaaggcgtgcgccaccacgcctggtttgtttgagatattcttataaggcacctgttcacataatagtgttgtggaagaagataaggtacagaatattatatgtaacattgtgtttgatctatcaataattatataatatatacacataaacactatgtataatgagtgagattttttttagggatacatatatttggttgcgaacctatacatgtctccaccatgaaaacatatattctagcttaaatgttaactttttgccaggcctggtagtgtaggcccttagtttcagatacttaggaggttggcataagagaattttcagtttaaggactgcctagactacagaatgagatcaactccagactgggaagcttataaaactctgtctcaaaatacaaaagttaaaagagctggggatatagcttagtggtacaggccctgcctaccatgggcaaagaccttggtcaaaccatagtaccacaaaaagttagccttttagaaatgagttatcattaggaaattgctatttgtagctcttaatgataactgatttggatgaacattttcagtaaatttcagtcataggtgaaagccagttgtgtacccatctgcagagcattcccacctccaaagcatagcttcaagcccatgatcacttagacagtcctggttaaactcagaggatcatagagcaaaaagacgtgagtgtgggagagggacttagaaggtgtagggtagggtcttcaggacaggagagagataaaagagagtgggggggtgacagtaatgagagtgcaatgtgtgtgtgtgtgtgtgtgtacgtgtgtgtgtgtgtattcgtatgaaattgctgaagaacaaatttcataagagataaaaaataataaagtgaaaaaaattctactcaaaggagaaaacaacaaaaccaaattcataagagtagtgttacatgaagttagagttgactgtactggttaattactagtctggcatctcctctgcattgtagtcgactgtgaagtgaacaacactttgacaagatggagtatttattcctgcatttttccctacttgagagcacttggagtttcattacatgtgccaggagctgggctgattgattggataggcacaaatctttagtgaagaccaggaaaatataacagggagaaactgaagtatgtttccatacttcatgaattaactgccttttgagtaactacatctagagtttctttcttttttaatattcattcattcattcattcattcactttacatcccattggcagccccactccctcctctcctcccagtcctatcctcaaatctcccttacctcattatcccctcctctttttctcagagaaggggaaacccctcagagtaccaacccactctggctaatcaagtcacagcaggactaattgtatccttttcaactgaggccagacaagacaggccagttaggggaaggagatccaaagacaggtaacagaatcagacacagccccctctacaattgttcaggaacccacaggaagaccaagcttcacatctgctacaaatgtgtagggcttctaggtccattccttgcatgctctttggttggtgggtcagtctctgtgagctcccataggcccagggtagttgcctctgtaggtcctcttgtggtgttcttgactcctctggcttcttcaatcctttccccaactcttccacaagactttctgagatgttcaatgtttggctgtgggtctctgcatctgttttggtcagctgctgagtggagtctctcagaggacagttatgttaggctcctgtatacaagcataacagagtaccattaatagtgtcaggggttggctctctcccatgagatgggtctcaagttgggccagtcattggttggccattccctcagtctctgctccatctttattcatgcacattttgtaggcagaacagattttgggttgaaggttttatgagtgggttggtgttcccctctttccactggaagtcctcacctggctacaggatatggccactttaggctccataccttcagctgctagaggtctcagctaggaggattacctctataaacccccaggacccttctctgtccccaatcccagagatgcctccccaccgatttccattctctctcccagccctctcctgcccctccccatgcctgattcctatccccattcccctccccaccttctcttccatccagttccctccctccctctccacctccaatgtctattttatagctccttctgagtgagattcaatcatactcccttgggtcctccctgttacttaagcttctttgggtctgtggtggagtttatttcttaatggagtaaagacaatataagtgaattaaggtctcgtgcccatcaaaatgtaaaatctatagcttttaataaaatcaccgatataataatatagtaaattattgtgtgcttgatttctttcattcttttcttaaatccttagtgctagtgaagtcatggctgttagaagagaatccacaaatactaatttcttttagaaggatatcatctcaacatgagattctagctctagattggtgcttctcacccttcctaatgctgtgaccctttaatacagtacctcatgttgtgctgaccagaaccattttgttgctatttcacaactgtaattttgctagtgtcatgaatgtaaataattttggagatagaagtttgcaaaggtgtctcgacccacaggttgagaactgctgttctagctgatgctatatggatagttttttactttaagtatattctttatttagtaaagaattatatcatttcaaaatttaacctgagtttaatctaggattagacttttctttttaagtttacaggaaataaaggagctagagaagttataacatggaatgagaaatgaaaaaataatcagacaaattgagaacgcaagccatcctcacattctcatctctttaagaagtcagtggtgagggggaaatggacagggttggggttctgcgttagggagaccaaagcaagctagatacccgtgtcacaggaaacttgacaaagcaagctagatacccgtgtcacaggaaacttgacaaagcaagctagatacccgtgtcacaggaaacttgatagctcttggtccgttataagtgtttgttttggggcagttagtgttacatgaatatggacttgcataaatgatttcatattagaaaattatcattcttttcataagacaattggaaaaatgtggaggaacatacttattctctcttaagaggtaggctaaattctttagaggtgaagtagcctggatcctaatatattcaacctttgtaaaacttcagtcaaaaaccaaacatagcatatttatgtatgtatagatacataaacaaaaaaagtaaatatggcaatatactgtcaattgttaaatgcaggttgtgttggtttgagtatgcctagccagggagtggcactattaaaaggtgtgaccctgttggagtaggtgtgtcactgtgggtgtgggctttaagactctcatcctagctgcctggaagccagtattctgctagcagctcctcctgcgccatgcctgcctggatgcagccatgccctaatctcgatgataatagactgaacctttgaatctgtaagccagccccaattaagtgtccttataagagttgccttggtcatggtgtctgttcacagcagtaaaaccctaagacataggtggacggtaaaatggtgtgtattatattgcttaaatttttctgtatgttttgaaaatttaaaaagtaaaatatgttgagaaaggttttgggatataactcagttggtaggatgcttgcctagctgcatgaatctttggggttgattctaagcactgtataaacagatgtgtacatgtccgtaatccgaggaattcaggaagttggaggagaagtagttctgggtcatccccaaaaacacggagttcagatcagcctgggctatatgaagctgtctcaataaaattgagctagagtagccaacctgttaacctgaaaactagattgagctgtacacgtggtggttgtaattctagctgaggtttttgacactaattctgacattagttaacatgctggacgtggtggcgcatgcctttaatcccagcactcaggaggcagaggcaggcagatttctgagttcgaggccagcctggtctacaaagtgagttccaggacagccagggctacacagagaaatgctgtctcgaaaaataaaaacaaacaaaaaacaaaacaaaacaaaacaaaaacatgagatgttggacctaactgacttgagaatcagttagttcttttaatttcactttatgttttattctaaattcatgtgtctttaaaagaatgtctgggctctgccaggtgtggtagagtatacttatagtctcagcacttggaagatggaggcaggggaatctgttgaaggtcttccctagctacatagcaagttagaaaccagcttagactacacgagaccctgtctcaaaaacaaacaactaaccaactgtcttagttagagttttactgttgtgaacagacatcatgaccaaggcaagtcttataaaggacagcatttaattggggctggcttacaggttcaaggcaggaacatggcagcatacagtcaggcatggtgcaggagctgagagttttaaatcttcatctgaaggctgctagtggaagactgacttccaggcaactaggatagggatcttaaagccgacacccacagtgacacacctactccaataaggccacacccactccaaaaggaccataccctctaatagttccactccctgggctgagcatatacaaaccatcacaccaaccatccaaaaacccaacaaaaaatggggctgaaaagatgacttaattagtagtgtctgtcacataagtatgaggacttgagtttggatccccagaacacacttaaaaatcgggcatagtggtaattgtttgtgaccctagtactggggttggggtgtggctgacacatgtccagagatcagtggctaaccagtttatcccagtcaagctagggtggtggaaagtagtagagaaagacagctggcatgactctctctctctctctctctctctctctctctctctctctctctctcacacacacacacacacacacacacaaaacacaaaaaacacatttgcacatacagaagcataaaaagtatgttagagtaaaaaccaatgaaaaattgcctgtgctctgcttacaagagaatatatgtgtgtggagctttctcctttaattaaagcattaaagcatgctatttggctttaagtcagtatgagtatttgtgttgggatgataatgttcattgttaaaatcaaccaactaaccaataccacattttcatgatcatctcaagagaagtttattttcatccagtaatgggccagaggaaggctcttccatcttgtaccttttaatctccccttccaggtgacaaatgtagaaaggaaaagaggatcacacaggggagatatttatgccacacaagcaaatgttgcttatcactttgcttacttccattgggtagaaagtctaactggaaaggagcaagggaaatgtgctgtagttggaggaagaagagcaggctggaaagcagccattcactctctgttgcagaatatgatgagtattgtcataccaaattcagaaaagagaagtaggtagtaggaattgcaagtatttttggtgtctgttgtcagttgttaataaactaaattctgtattctaagtaatccagttggaattgcatatttgtattaattctgtgaagctacttctatggctccacttattgttgctacacaaatgtggtcccagagctagcagcatgtggatcacttgagtgctttttgggaatggtgaactatgaccctgccttagaatttctagggctggggcctagaagtcttgttgtaacacattatcaggattttgtttgtttgaattgaagttgcagagttactggctgacagcaaacagattcctcatctattcccctcccaaacatgtatatagcctttcccatttggtaatgggagaactccaatttgatgtgttttaaagattttatttttaaagttttgtttatgaatatgtgtctttgttagtatatgctttgagtgtctgtatctatagagccgttagagggtaaagggttagagttacaggcatttgtgagctacctaacgtggatgcagggaaatgaattctggtcctctggaagaaaaaaaagaaaaaaatttcaaattacaagactgctccccagaacggttttttaaaatcacttttttttttcttgatgggtcaatgtgacaaatatattaccaagtctagaataatcatatctaatttctattgcactaatggttggtttatagggatttatgtaggtaaataacagtagaaaatgatgtttctatcatcttttggaatagccatatattgtgttaagtactctgcctacactgagccatttaagtgtttcatcaaatgtatgagaaccattaatactggtcccattttccagttgaagaaaatggaacttggttcaagattgttcgtttttttcacagtcacatgtttgaaattgggcactgggtcttttaaatgatgaggtcaatatgtaggatgtgtttggccaaggcatagtataacctgaatcctaccccattacctgatccagaaaggctcaggaagatttatacctgaaatataagacaaaggaaaatgaccctctttagtaggggctttactcccaaactccagtgcagaattgcaaggggtgtggtagcctagaaggcttatctaagtgggagcaaattgtctacctggttttagcttaaaggtcttgttcctggtgttactccattgatgtgacagaggctatgagtgttttaggtgggaacacctttaagagatgttcagaatgagtgtaccaggccttcttggcttggcctagtggttttcaattttcttgattttagacctcactgtcaataaaggtgggctgcagatgtggtggggcctgttgttctctcaggcctcttcctgataattgtggcaggcttatcagaatctcttgggggagattttacaagatatactgaattgtaagccatgggtaactgaagataactgtcttgtttgctgctgtttctccaactcttagaacagtgccaggcatattgaaggtgctctgtaaacaatcattgtagtctatagagaaccattatactgtaacagtatttagcattaaatgtctttgctctaaggtcttgtgcctcagattcataccaacaggaaacatttaaagacattaatgtgcaaaaatatctacatgaatgggaacagactgtttaggacaatgaaaggacaggcgacataaatatgtgtgtttctagaaaatggtgtgtttggttgataaagcacatggtagttttatttttgaaagctagggatgaacacagtgccttgtacatgctgctgctggagtatattcctagcctttgatttcttttctgagacaatctcactatgtagtctagagtagttttgaacttgtaatcctccttactcaacctccttagtgctggcattgtaggtgtctgcttattttaaaactttttggcattgtaggtgtctgcttattttaaaacttttataaaatatgtcttaaaattaatttcaccatttgaatttaccatttagtaacatttataatgtgtacaaagtcaggtggccatcaccactattttgaaaaaaaaaaaagtcaacatcctgaacaaagtctctatatcccttaagtagtaacttcatatattgtcttactctttagtctacatctaatctattattgtctccatgaacttgtttattttagatatttcatttaactagattcctgtaatatttgtgtttggtttattttacttagcataaggttttttttttctttttctttcttgtttttttttttttttcaagacagagtttctctgtgtagccctggctgtcctggagctcactctgtagaccaggctggcctcgaactcagaaatccgcctgcctctgcctcccaagtgctgggattaaaggcatgcgccaccacgcccggctcttttttttctttttctggtggcagtagggattaagctttgagcttttttgtgcatactactgaagtgttctatcactgaactagcccgctaatcctgaacataatgctttcaagagtccatgttgttaaatgaatgagcgtcatacctttctgtggatgaatgatattccaatctatatatacataccacattctattcatcagttgatggatctttaggctgtataataaatgttaaactgctatgaacattcacatacaaatatctgtttgagtatctgttttcagttctcttgggaatataccaaagaatagaattgctggttcatatggtgtttctctgtttgacattttaaggaagcactaaactgttttgattagcagcaacattatgttgtagtcctacctaccccaaggtacaaggactcatatttcttcacatcctctccaacacttgttattgaacttcctcttttgtgcttacagttcatttgcatttttatttagagaaacagctattgggttagtttgttgttgtgaattgtatgaattctttacatagtctgcatatcaatcattggtcagatagttggactgccaatatttattcctattctatgggttgccttctcactttatgagtggagtcatatcatatgtagggaaaaaaattctaccctaaaacaatagtatacaaatactcaactccaatctacttatgcttttgtccttttatattattgtccaaaactgtatcattacatagtattccattaacatatatttatgatgacttttaaatttgcatttttaatcatataggaatggggagttataagccaaaagcttttacagttactatatttttaaagcagtagtttttatttcttctcataattttgagttaccccatagtgtctttcatttgagcctgagaaatcgttcattatttcttgtttattattaagtagttaaagttccttagtttttgtttacctttgaatttttttaactttttcacttttgaggaatagttttatcagatgcagattttcaggttaatagtttttctcatgtagcattttaaatatgtcatctcattatttatcttatcttcaaggtttctgctaaaattagttttaatcatattaagaagccctaatatgtaacaaataatttcttttcctgattttaaggttgtctttaataaattcagttacaatgtactttgatgtggggcatttggattactccttcttggtgattccttgttaaaaattattttatcttgtctttttatgtgtatggttacttttgcctgcatgcatgtctctgtacctcatgtgtccagtgctcgaggctagaagagggtgttagattctcagggataggagttacaggaggttctgagctaccatatgggtgccggaatttgtacccaggtcctctggaagaacatccagtactcctaactgctgagatgtttctccagtctatgcttggaggctcttgagctttgcagaggtctaattcacaaatttcattaaatattggaaatttccagcatttatgttttcaaatattataacctcttttatcttcttcctctggaatttccataatgtggttgtcagtctactttatattgtgatacaattccattggctttctttatttctctacatatttttctctttttgtttcttctcagactcaacaatttcaattcttttacctgaaagttcactaattctttcagctacctgcttacatactccagtgaaccctcttagtcaagctttcagttttagcatttgcatactttcttttcataatctgcattttcattttcttcatgttcatacattgaacattcttaatttccttttttgtctttgttcatagcttcctttaatttttcaatcatattcaatacttataatttctgtttaatatgttcaggatcttgacctctccagatgatttctgtcatttttctttcctttgaataggccatactacccattccaagtagctatgagtttttcatttaccttacagtttttgttgttgtagtcgagcaatacattctggttctctactatgaatgggggaaatgagtgcctagagctattcatttaaatagtttcccaaaacagtcacacaaacgcaaaaagcactaaataaagtcttctcttcttctggagccaacaccaggattttatactgggagtgtgagttgctgtctcacagccactagaactcacagacatctgcctgtctctgacaccagagtgctgggatttgaggtgtaaaccaccacacccaagctgctcttgcttcttaaccacatcctatttttaaaaattaaggttctttgcattttcagagacatcaaaatctccaaagaatagtgttaagccttgcattttattaaccactgttactaagagagtaaatatcctgtggtcagtctattgtttacttttggctcctatcacatgttttttgctgagaacctggaaagtaagaaagaaacttcttttttatatatatactttttattaggtattttcctcatttacatttccaatgctatcccaaaagtcccccataccctccccccccactcctctacccacccactcccactttttggccctgacagaaagaaacttctaatgggggtataagtttaggtttatacccaatagattttctccaattttgcttctccagttttactcctaaaacacattttatgtaaaactacatttttctcatttttttctgggttattgaaaggattggctccagattactttgtattaaaagtagaattaactaggtacagcagagattgcagtcacctctcaatattgattgtgcctttcttagcagaatcctgatctttcagctttccatgttgctgtgcagtgaaaagtgcttctgccactaggtacagacatgtgactaagttctggctggaagtagaaggcaaaatgaagtgctggatgggttgtataaaatattcttattgggcacttgctatctctctggttcttggagtatagatgtaactacttgagttccagcaaccatattggatcaagagatgaccttgggaatgagggacacttctgacaatacagtaaagtagaatttgccagaatctgtgaaagcacagagctaccatgctgggcttggattccatgcttttgtactccatgtgagagaggaatgcaggttttctatctgctgctgaacccagctgtaatgtttatatcaagctcttcgagttccttgaattgaaatgtgagacatggggtgttttgaggcactgatgcagatgcatatggcacttcctggagttctggaaaatgaaaagcagacaacagagcttggggaaaggcttcagattttaagcacaacttacatttggcacctgttttaggtacctgaatattaagtgaaatggcttagaattcagacagtttcactcatagctgtgacttagtacagtgaaaggagtcacaggcagagcagtaaaggaaaaagccaatgactagattcttggatgtgaacttctcaagttcttccataggagaattgagagcgagtttattgctatagccaaacagaacaagcttcattatctggcaacacacacatttctgtttttctgtttaggtaggcttgctctattcctgcagggtgtgaggtctaattcaggatcttgcacatgctaggcaggtgccttaccattgagccctctctgaagtttctggcactcagatggaaaacaggtgtttactataaatgacatttgtgagccttgctaggataatatagcagagtttagtgttccaggcacacaaaatcaccttgtctatcaattagccacatagaaaacatttcacagaccagagtcccaggaactattgcaaggattgctcatgtaaagtactactcctttttagggggagcaagatcaggactgttgtgtgaattctttcctgtagactaaggtgatgtcagctgactgttagatatttctatctatgatgctttcttagttttttacctacactccttttacttattactgttttttagttctcaattttatatctaaagtgttcacaacaaaacttttactttgacatgtagttttgaaaatttattattatgatgatgatgtcgtcccaaatgcagtttctcctccctcttcttcttctcgtccctgcctcttgcactctctctttatctcctctttgcaccctcatctacttctccatttctcttcagaaaagggaaggcccccagggatatcaggcaaacatggcataacaagttggaataagactaggcacttcccgtggtattaaggctggacaaggcaacccagaagaggaaagggtcccaaacataggcaaaagagtcagagacagcccccactcccactgtttgaagttccacaagaagaccaagctatacaactataccatatgtgttgagggcctaggtcagacctatgtaggctccctgattgtcaactcagtctctgtgaggccctatgagtcttagttgattctgtgggccatattcttgtggtgttcttgacttccccaggatcctacaattcttcctccccctttcccgaaggataccctaagctctgcctaatgtttgcctgtgggtctctccatctgctccgatcagttgctgaatgaagtgtctctgatgacaattatgctaggcaccaatctatgagtatagcagaataggaataattttattgttttttttcggctattcgtgtttggttctattgtgggtctctgggctctccagcctctggctcctggccctccaggcagtgtcagaggtaggctccctctcatggcatggttctcaagctggaccagtaattggttggccactcccatactttttgtgtcacctttaccccagcacatcttgtaggcaggacaaatgtaagtcaaaagttttgtagctggattggtattccaatccctccactggaagtcttgtctggttataggagatggcctgtacaggctttatatttccccaaataccccatgtctcacatttcaactcaaggaactcgaagagcttggacattacagttgggttcagcagcagatagaaaacctgcattcctctctcacatggagtacaaaagcatggaatccaagcccagcatggtagctctgtgctttcacagattctggcaaattctactttactgtattgtcagaagtgtttctcatttccaaggtcatctcttgatccaatattgctaggggtcttagctagggtcaccctcatcgatttttggaagtttgtattgcccttgttttctagcttgtcccagagaagccctccaatttcaatcgtctctctcaggattctcccccatcatcttccgctccacctgatttgtcctgttcctgtctcccccaacctcttccaccttcgatgtctattctatttctccttcccagggagatttcgtgtgtcttcccttgagccctctttattacttagcttctctgagtctgaagattgtagcatggttatcctttactttacagctaatatctacttataagtgaatacatatatttgtctttttgggttggggttacttcactcaggataattttctctagttccatccatttgcctgcaaaattcatgatgtcattgtttttaacagctgattaatactccattgtgtaaatgtaccacattttaatccattctacagttgataaacatctaggttgtttccattttctggctattatgaataaagctgctctgaacacagttgagcaagcatctttgtgataggttggaacatcctttgggtatctgcctaggtataggtcttgaagtagatcaatttccagcttcctggcaaatagccaaattgatttctagagtggtcgtaccagtttgcactcccaccagcaatgaagaagtgctctccttgccccacatcctgaccagcatgtgctatcacatgagcttttgatcttagccattctgattggtgtaagacagaatctcagagtcattttgattttgatttcccagatggctaaggatattgaacatttctttaagtaagtgcttcttggccatttgaaattcctctcttgagaatcctctgtttagatctatattccattttaaaactggactatcctgttttgttttgttttttttatctctagtttcttgagttctttatatgtttttgaaaattagccctctttcagatgtggagttgaagattttttcccattctgtaggtgctgtttttgacatacatgtagatatgtgtaacaacaaatgttacaaagatcaaggctagttacattactcttaaaaaaaaaaaaaccaccatacaccatactaagctggagaaatggcttagtggtttagagcctttgctgatcttccaatgaacctgagtttgggttctagcacccatatttgatacttgtaacttcagctttcttctggattcttctgataccttccctctcacatgtgaaattcgcacgcacacgcgcgtgcgcgcgcataaacacacacacacacacacacacacacacacactctctacaaaggaactatcatactatgggctcacacagttcatcacttcagttttgtgttctcatgtacattatgtaaatgggaccaaatagtatgttatgttttaggattaacattttcagttagtgcagtgctattaggaatcattctgccatgtggttctctgatcagtgaacattgtcatatgggattgtatgtggtggttaatcaacagttgacagatacaggattatttccagtttggagtggtaaagaatagggctatttttattaattgttgtatgaatgagtttaagttttcatatttttaattgtaagttataaagaatgaagttgggtggtagattagttgttggtttcacttcacatgaaaactgcagaactgttttctggagtagctgtacagctcgcctagcaccaccacacccagcctaaccacgtctctttttagaactaaacttttacattgtgatggacttgctaacattatctgtttgtctaaaaatctctagttgactaaccgtgggtttaaaagattgtcttttttgttttcatctaaatgtttgatacctttgtatctagatctaccgtttgttttcaggtaattttttgtagatagtatgacactttggttgagattcaattttttttgtacaggaatactaaattgtttttagcaattttgttgaaaatatgttgtttctattgagttacatttgcagtgttgtcaaaatcagtttcctacatttgtgtagctctgcctctggtttcccttgtagtcttctgacctgtgtatctatctgtctttggcagagccacattttccttctgctctttaataatgggccttccaaattgagtagtatgagtttttattcgtcctttgtaagattgattgggctgctccagttcttttacctttccatgtgaattttagagtcagctttatttcactctgcaacatgtccgtggtgttttgattgacatattcaattggtacttaatttgaggagaatgagttatgtgtgacacagctcacatttacttggggtttctttagttcatcttagcatggttttctagttttaaatatacaggtcttcacaaattttataatctttatccttcagtatttcaggtttgtggtaccattataattgctgctgtttttataattttaatgtccagtcatttgttgcaaatgtacagaactataatatatttttttgcatctgaatcttgtatcctgtagcattgctaaattcatgcttttatcttagtagctttttaattattccatcagattttatacatattcaatcatatatatgagtaatgatagttctacttttctctttctaatctgcaggatattttttgttgtcttttttttttttgagacaaaagtatcactattcagccatggctagcctagaactcactatgtagaccaggctggcctcaaagtcatagagatctgcctgcctctgccacccaagtgctgggattaaaggcgacctttttagcagacttaggtgtgtcaggtggagcttattattatagtattagagtgtgttagacttggtgtggtaaaaaatgggcatttctgacttttcttgaactattaatgttagctgtatatttttatagatatttaccagatagaggaaacacctttctatttctactctgctaagagttcttagcaggagtggctgtgagaggttttcaagtgctccttgtgtgtatgttgagatgattgtgtatttttaaaactctggattcctagtataaatcccacttggttattatatatcactgttttaatatattattggaatggtgtgttaaaattttggctcgaatttttgtattgtgcttatgaatgatatggtctgctttgatgtgttagggtaacattagctttatcgaatgagttgagtattcctttgtcttgagctttgacttgtttatttgtgcgtttcaacacagtgtctaaatatgtagctcaaactgggctcacagttgggatcttcctgccatagcctccccagtgctagaattataggcatatgccaccttgcctggccctgtgtgtttcattttggacggtgtctgtgatttgccctccagttaatgtttgtctgtaacttaattgtcatgagtgttatcacgtatattaatccttaaacattctggtcttatactccaaagttctatttagatctcttttaaatctctacttaactttttgaatatatgggtatcttagtttttaccttcctctgcttacttctagtatctgggtcagttttaactagatagtttttgtaggttttattttcctgccttcttacatgcccagaaatctttgtgaattttactttgttggatagtagaatttggccttctacaaatcatttggactttatctctagatgcagtgaatttgcttggaaatgatttggatcccttatgacttactcgatgggtgtgtaacaacccttggttgcaggctgattaccctcactgctggagcaggaccatgttgattttgtttgcacaatgacctgtgaattaaacattgcttacatttgttcagtaaggacaaggacttttgctggctctgtgggtgctagatattgtttcctttaattagttttgctctagtatataaatctgccttcaatacctgaaggagagcccctctgtggatttccagacttctgtccttgtgtcattaggttgtgtttctcatcctttgtcctgtgaaatgtaggtggttttgtagctgtactcttggggaactgccagacttcacttacatccccactgttctgtggcctgcaaactttctcagtgtagtagactgggacatcacaacgtttgcctcagatttcccttctcccacggaccatttggcatccattgcctgatggttactgtcttgaaaaccaccatttcatatatttcgtataaaaaaggattaatccagttccattttctatcttctctggaagtggaagcttttgttttacagaggaattttgatctctcagttttgaaaccctgtacacgtacactctgtcacttgatatttatttttcttcaactgtggacttggcatatgtgtgtttatgtggttagaaatgattatgtacacacagatacacttaaaacaagcttgcttgccatggagtgtctttttctagtttaggctctgttggctgcggctgcacatttttgctctgagaaaactagagaaaggaaagatggctttcattcaagagtgtaggctatgaactagccagaatgattttcttcagtagtatgaatgagagaattgtctgttttcaatggcacttctgtgcagattgtttttgatgacacagaagagagacagacaaggtggtaatagtgtggtgattttttttgatacttggttgagaaatttcatgtaattgaagagaaatctgattacaatttcaaacaaaatatagaagaacatcaaattatacagcttaaatagattgttgacacatttttttttctcctgaaaaaaaaaaaacttgtgtgttggctgtagatcttaccaaatcctttatagtcatagattccctttagtgtggttccttacatcctcaaagattactgtgatatgcaaagaatttaagactgattatacactgaacatattacttttgtataaaggaaccttaaagtgcaaaatgttaccacactgactacaaatatgggttcttctgcagtatgactttttctcatggtatttgagactatggctacatgcaaatgaattaccatttgattatttataggataccttccagtatgtgttatttttgtgaataactatgttataaaaatgacttaacacattaattccattggtaagacttctctccaatgtggttattttctttatctttatattagatacattctttatttacatttcaagtgttgtcctctttcctggtttccccttcaaaaactccctccccctatgtcctccctcctccccatgctcaccaatctacccactcccccttcctggccctggcattctcctacactggggcatagagccttcaagggatcaagggcctctcctactgatgactgactaggccatcctctgctacatatgcagctggagccatgagtcccaccatgtgtactctttggttggtggtttagtccctgagagctctggggagtactggctagttcatcttgttgttcctcttatagggctgcaaaccccttcaactccttgggtcctttctctagctccttcattggggaccctgtgctcattccaatggatgactgtgagcatccacttctgtatttgtcaggcactgtcagagccttgcaggagaaatctatatcaggctcctgtcagcaagcacttgttggcatccacaatagtgtctgggtttgataattgtatatgggatggattcccaggtggggcagtctctgcatggtcattccttcagactttgctccacactttatctctgtaactccttccatgagtattttgttcccccttctaagacggaacgaagtatccacactttggtcttcctacttcttgagtttcatgtgttttgtgaattgtatcttgggtattctgagtttctggcctaatatccacttatcagtgaacacatatcatgtgtgttcttttgtgattgggttacctcattcaggatgatatcctccagctccatccatttgcaaaagaatttcattaattcattgtttttaatagctgagtagtactccattgtgtaaatgtaccacattttctgtatccattcctctgttgagggacatctaggttctttccagtttccaactattataaataaggctgctatgaacatagtggagcatgtgtccttattacacgttggaacatcttccaggcatatgcccaggagtggtattgctgggtcctcaagtagtaatatgtccaattttcggaggaaccaccaaactgatttccagagtggctgttccagtttgtagtcccaccagcaatggaggagtgttcctctttctccacatcctcaccagcatctgctgtcacctaagtttttgatctcagatattctgactggtgtgaggtgaaatctcagggttgttttgattttcatttccctggtgattaaagatgtggaacatttttttaaggtgcttctcagccatttggtattcctcagttgaggattctttgtttagccctgtaccccatttttaatagggttatttggtttgttggagtctaactttttgagttttttgtatatattggatattagccctgcattggatgtaggattggtaaagacattttcccaatctgttgattgcctttttgtcctattgataatgtcctttgccttacagaagctttgcaattttatttggtctcatttgtcgattcatttttttttcttttttaatatttttattaggtattttcctcatttacatttccaatgctatcccaaaagtcccccataccctcccccaccattcccctaccctccccccccattcccctacccacccactcccactttttggccctggcgttcccctgtaccggggcatataaagtttgcatgaccaatgggcctctctttccagtgatggccgactaggccatcttttgatacatatgcaggtagagacaagagctccggggtactggttagttcatattgttgttccacttatagggttgcagttccctttagctccttgggtaatttctctagctcctccattcgggtccctgtgatccatccaatagctgactgtgagcattcacttctgtgtttgccaggccccggcatagtctcacaagagacagctatattagggtcctttcagcaaaatcttgctagtatatgcaatggtgtcagcgtttggaggctgattatgggatgggtccccgggtatggcagtctctagatggtccatccttttgtctcagctccaaactttgtctctgtaactccttccatgggtgttttgttcccaattctaagaaggggcaaaatgtccacactttggtcttcgttcttcttgagtttcatgtgtttcgcaaattgtatcttatatcttgggtattccaagtttctgggctaatatccacatatcagtgagtacatattgtgctagttcttttgtgattgggttacctcatttgttgattcttgatcttacagcacaagccactggtgttctgtttggaaatatttcccatgtgtccacatgttcaaggttcttccgcaatttctcctctataagtttcagtgtatctggttttatatggaggtcgttgatgcacttgtacttgagctttgcacaaggagataagaatggatccatttccattcttctacatgctaaccgccagttgagccagcaccatttgttgaaaattctgtcttttttccgctggataaccatcttagctcctttgtcaaagatcaagtgagcataggtgtgtgggttcatttctgggtcttcaattctattccattgatatacctgcctgtcactgtaccataccatgtagttttttatcacatgtgctctgtagtacatcttgagatcagggttggtgattctgctagaagttcttttattcttgagaatagttttcgctatcctaggtttttgttattcaagatgaacttgcaaattgctctttcttactctgtgaagaattgagttggaagtttgatggggattgcattgaatctgtagattgctttcagtaagatggacatttttactatattaatcctgccaatccatgagcatgggagatttttccatcttctgagatcttctttagtttctttcttcagagacttgaagttcttatcatatagatctttcacttccttagttagagtcacaccaaggtattttatattatttgtgactattgtgaagggtgttgtttccctaatttctttctcagcctgtttatcctttgtgtagaggaaggccactgagttaattttatatccagctacttttctgaattatcaggcttaggagttctctggtggaatttttggggtcacttaaatatactatcatatcatctgcaaatagtgatattttgacttcttcctttctgatttgtatccctttgacctccttttgttgtctagttgctctagctagaacttcaagtactatattaaatagatgggggagagagaggacagccttttctagtccctgattttagtgggattgcttccagcttctcaccatttactttgatgttggctactggtttgctgtagattgcttttatcatgtttaggtatgtgccttgaattcctgatctttccaagacttttaacatgaagggatgttgaattttgtcaaatgctttctcagcatcttatgagatcatcatatgttttttctttctttgagttcgcttatacagtggattacgttgatggatttccatatattaaaccatctctgcatccctgggatgaagcctacttgatcatgatggatcattcttttgatgtgttcttatatttggtttgcaagaattttattgagtattttttgcattgatattcataaaggaaattgatctgaagttctcattctttgttgggtctttgtgtggtttaggtttcagagtaattgtcacttcatagaacaaattggatagagtaccttctgttactattttgtggaatagtttgaggagtattggtattaggtcttctttgaaggtctgatagaactctgcactaaacctgtctagtcctggacttttcttgattgggagactattaatgactgtttttatttctttaggggatatgggactgttaagattgttaatctgttcctgatttaactttggtacctggtctagaaaattgtccatttcatccaagttttccagttttgttgagtgtagacttttgtattagtatctgatgatttttttttgatttcctcaatttctcttgttatttctccctttctgtttctgattttgttaattaggatactgtctctgtgccctctagtgagtctggctaagggtttatctattttcttgattttctcaaagaaccagctcctggtttggttgattctttgtatagttccttttgtttccatttggttgttttcagccaagtttgatttttttcttgctgtctactcctcttgggtgaatttgcttcttattgttctagagagttcaggtgtgctatcaagcttctagtgtatgttctatccagtttcttttttggaggcacacagagctttgagttttcctcttaggactgcttacattgtgttccataagtttgggtatgtgtggcttcattttcattaaactctaaaaagtctttaatttcttcctttatttctttttgtttctttgtttgttttttgaaacagggtttctctgtatagccctggctctcctggaactttgtagactaggctggcctcgacctcagaaaacctcctgcctcttcctcccaagtgctgggattaaagacatgtgccaccactggtcagttttggagaaggtaccatgaggtgctgagaagaagacatattcttttgctttaggatgaagtgttctacaaatatctgtttgatcaattaggttcataacttctgttagtttttactgtgtttctctttagtttatgtttccatgatatgtccattgctaaaagtggggtgttgaagtttcctcctattattgtgtgggatgtggtgtgtgctttgaactctcttttctgaatgtggttgtccttgcacttggagcatagatgctcagaattgagagttcatcttggtagattctttctttgatgagtatgaagtgtccttctttattttttggataatttttgtttgaaagttgattttattcaatattagagtgattactccagcttgtttcttgggaacatttgcttggaaaattcttttccagccttttactctgaggtagtgtctgtctttgtccctgaggtgggtttcctgtatgcagcaaaatgttaggtcctgtttgtgtagccaatctgctagtgtatgtctttttattggacaattgaatccattgatattaagagatattaaggaaaagtaattgttgcttcctgttatttttgtggttagagttgtaattctgttcaggggggtatcttcttttaggtttgttgaaagattactttcttgctttttctagggtatagtttccctccttgtgttagagtttttcctttattatcctttgaagggctggatttgtggaaagatattgtgtaagtttggttttgtcatggatatcttgttttctccatcaatggtaattgagagttttgctaggtataatggcctgggctggcacttgtgttttttaagggtctgtatgacatcttcacaggaccctcttgctttcatagtctctggtgagaagtccagcataattctggtaggagtgcctttatatgttactttaccattttcccttaatgcttgaaaattcttgatttgtttagtgcatttggtgttttgattattatgtaatgggaggaatttcttttctggtccaaactatttggagttctgtaggcttcttgtatgatcattggcatctctttctttaggttaggcaagttttcttttataattttgttgaagatatttactggccctttaagttggaaatcttcactttcttctatatctattaatttcaccttctgattgtgtcctggatttcctggatgttttgggttaggagctttttgaattttgcattttctttgactgctgtgtcaatgttttctagggtatcttctccacctgagatcctctcttctatcccttgtattctgttggtgatgcttgcatctttggctcctgatttctttcctaggttttctatctccagagttgtctttctttttgatttctttattgtttctacttccgtttttagatcctagatggctttgttcctttcctttgcctgtttaattgtattttcctgtaattcttaagggatttttgtgtttcctcttcaagggcttctacctgttttcctgtctttctttaagggagttatttatgtccttcttaaagttctccatcatcatcatgaggagtgactttagatccatatcttacttttgtggtgtgatggtgtatccaggacttgctatggtgggagaattgtgttctgatgatgccaagtaaccttggtttctgttgctcctcttcttaaggttgcctctcagcatctgattatctcaagtgctggagcctgttcttcctgtaatcctggttgagtcagaactcctcagagttcagctttctctgtgatcatgtgcttcagggatcctgtttcctgagattctgggtgtgcaagagttcctgggggtcaacttgtctttgagaccctgagatcctgttgtgaccaaggtcctgacatcctgggatcctgggatcctaagatcctgggtatgctagcatgcctgggagtggtacctcctttgagggctgtgggactgttcgctgagttcgagaccaaagcagactggaaggaacctgagccgggtggtgttcttgcatccctgtatcctgctgatcccagtcactcctggtggtcttgttacagatgctgtattctactcactggtgatcgtaagatcttgggtgtggtagagtgcctgggagtggagactcctctggtgactgtgggacgtccgccaagtttgcgcccaaagggttattgtttcatttattgaaaaatgactgataggcaaatattgggtgtaatggtaattggttaattccctgtactccctgatagtggagtgcaagtgtgccaaatagaatcagctgaggataggaatccacagcatctcaaatgtgttatcctcatgcaacttgagaactgatctaacacaagtcgcattagaaccaatccacaatatttcaccctttttgttaattaaaaagaccttttctctcagatatacattgactgtagttgtaatagttatgtaaaccataaggtatgatatacactaacaacattcagcccatcagttttgccaatatatgtacatccgtctagcatctatcctagcttaaagagtttacaattctatacctgaattatgttttgattttgatttgcattaccatctgaaaaccatcctttcaattctatatcatcttactaaatgctaaacaacttttaagtttgatttgtgtagtgtgttgatttttatctattgcagagtaacctggtacaaggtagagatctgttgtggctgatgaagacctatcagtccagccaggagaaaagctgcaggtagctcagtaggaggtaaccattagctaaaaacctggacgagtggtgatgctaggtagactgctgaaaccaccaagagactgacaccagaacaggttgattgtgtttatccagagctcaaggataaggtctcctgtgagaactggagcactaggagagataactaggaaagtatggaacctggggagaggactgtgttgtgggaacttcagctatgagaacatgagagcaagaaggaggtggaaactggtagggagaggggcagagaagggacagagaggaagaatgacctgccttgggttgtacgtctctactatcttctagtgtcttcctcatgactctcatggactgactataagtggcagccactttgaaggagaccttaacatatagttggcaggagtctccttgccacttctccttgcaacgtatagctgagcaagaaaaggcagaaaattagctggggtccttaagcccaaggctggcataaacgtccactgttgagggcttggtctgttgtgactgactcacataagggactggggatgtgtctcagtcatagggcatttaccatatattcaaggctctgggttggattctcaataccacaaaaacaaacaaaaatccttactggtgctattgtataaacttacctattaatgctatattttttaaacttcttatctattatttagggagagagtgtgttggtagatgggacagaaggagagaccttttatagtgtaactaacattgtaatttcatgtttacattaaccagaataagcagaatgatagccatttttattacaatggcttcctgtcatggagccatgctaacagtgataacctggtaccttcaagacctcctctggaggagctcagtcagagagactgcatggggaagggagggactgatctctttgaattgctgttatttgcctttatagtgatgtaactgtcatttctgcagttcaggtactactagaagatttttctgattaatagctgggtttctgtgagagacaatccaggggagggcagcttagcccctggtgttttcagactccgctattgttatggatgacctggctgggccagtgatacaacttcaagatgttaaggtacaggtttggattattttgctccccttagatgccaagttgaaatcaagacttttgtgtattgcaacgatatagcaattaataaaaataagtgttgtctttaattgcaactgaaacttactagaatccattattagctattaatactattgagcttttcaaattttcagtgtttgtctgtctgaatagcagagcattcagtgaattgttattttgtatatttgctctttcaatactgtcaatatccagtccttgtggggaaacaccaagaaaatcttaatgagaggctgtgaatgtggctcaggcatgcagtatttgccatatatatgtatgtgtgtatatatttgaaaaactaatacacagacatctggttgtgactcagagagagatgttggtatggagagctcacattcttacagttaaaagctcctaaacaagtagcaaattaaagactttctagaatccaagcaaaaaaagggtttcagagcaaaaaagccaaaattgagtgggagacacaggtggcagatcagcatttgcttagctggggcagatactgctgaaagctgtgtaaaccattaagaaggttaaagcaggattttaaagactttccagagaatgaggttgcatagattctcactttcttgcaagcttttcctctaggatccccaccaggtgctggtttttttttttttaagattgtcttttagcttatgtgcattggtgttttgcctgcatgcatgactgtgaaggcaccagatcccctggaattggagttacagacagttgtgaactgccactcgggtgctgggaattgaattctaggttttctggaagagcagctagtactctcaccactgagccatctcgccagcacttcactctctccccacactaggtgctcttaatgaaggtcagcacacctttaatcccccagtacttggaaggcagaggcaggcagagggaggcagatctctgagttggaggccagcctggtctacagagcgagttccaggacagcgacgcagggagatccctgtcttgaaaacaaaaaacccagaaaacataaaacaaaaacaaagcaaagaaaaattagacaaggctgaggagtggcacagcccagcactgacagctcccaagaaccagtcttactccttgggaagaaaggtaacagcatggagggtactggtggaaacccactggccacaaggcagtgcaataggggaaataattctgcctgtatcagcattgcacatggagggacacttgtgagggcccaaaacttagattccatatctgtctaattgacgatttatcagaataccagggaaattttccccaggctccctattaccaaggcaacaaacatcaagtaataaaacacaggtgactgcaggagggagatgggcaacagggcacagacctcagagccagtggaaggtttaaagccaaggaaggaaaagaagacattgagaaaagccttgtggcaagttaccctactccataaagatgaggcatctgaaagctctggtactttgaaagtaaccatggaaaccaatgctttcaaaccagtctgcatcctaattgtattaatagaaagctcaacaacaaaaaagcaatctgacaatgtagaaatagtcgttataggtttatgatgtgtgggcggctttaaataatatattttttattcttacctgttgcgtccttccctgagtctttattggaatatttttcttttgggtttggagccttacttcgttgtccaggctagctctgagttcttgggctcaagtgattcttctgctttagactcctgaggcacatacccctggcatataccagtgtgttcaaaaaaaggattattttaaaaataggtaatacattcatatgatcatcatgtaaaaagaaacttaaaaggaatatgtccccttctttccatttcttcttgctactgttattgatttgttattcctgtgttttctttgtttatttttcttttctttttttaaagatttatttatttatttattatatgtaagtacactgtagctgtcttcagatactccagaagagggcgtcagatcttgttacggatggttgtgagccaccatgtggttgctgggatttgaactcaggacctctggaagagcagtcagtgctcttaaccactgagccatctcaccagccctattttgcttttcataaatgcaagcaaatagaagcacatatgctaacctccacctcttatagaccctggactgattttctcatttaagctgttctggtggtggtgtcctctttcatccaaggagttgattcttatcattttcttcttttttatagttgcatgatgttctgtgaggataagctataaatgagtcctctgttggtggacactaggattgtttcctgtgttacaataaacaataccacatagataacgttgagcttgttattcatattcaggtgtatcctgagatagaggtatagacatgagattatgggattgagggggaaatggcttgtaatttgaggtgatatagcagattcttttcattcaaggttagctatttatttgttggtttatttctgtcactcactggaagttttctggtttggtagttcttgctaacagctatgctgtcacattttttggattttttttgtcatcatgagagagtaataccgtctttttagaatttgctctttttttaagcaacgattgatttaagttttgggttattcatgtgcttttctatgtaatgtttatagtttttgtagttttcctataaaatctttcgtgtgagaatctttctcttgaatctaggagctttctgtacattggagaggttagctacacatctgtcgtgattgaaactttttcttggtgtgccccagcttatgtgttttctgctctcctagacttctgttgtcaggctctcagcattttcatgctttcaattctgtctggactttgtccttagatatttgtacttgctggttttgtgtgtccacttgacacaagctggagttatcacagagaaaggatctttccttgagaaaatgcctccatgagatccagctgtaaggcattttctcaattagtgatcaaggggggaggtccccttgtgggtggtgccatctctgggttggtagtcttggttctataaaagagcaggctgagcaagctaggggaagcaaggcagtaagaaacatccctccatggcctctgcatcagctcctgcttcctgacctgcttgagttccaagtcctgacttcctttggtgatcaacagcaatgtggaagtgtaagttgaataaaccctttcctccccaacttgcttcttggtcatgatgttttgtacaggaatagaaaccctgactcagacaaattggtaccagcatagtggggtattcctgtgataacctgactatgttttgggaaggactgtggaaggactttggaactttgggctagaaaagctattgggtgttaagagctctgtgggatgctctgtaggagcttggaagataatgttgagaatagtgcagaagatggaggcctggcttgtgaaatttgagagggaagattaaagacttatcagggccgttgcttttttaattgtaaacattgtgtagttttggttatctggagctgaagaatcacctgtgaataacaagataccagaactactaaaacaaaacttttgtgttactgggataattgatgctggttagctggagctaagaaattagcagtgattaagaagagaccagcatcattgaggagaaatcttctgggaagtgttttctgagagcacaaagaagctgtgttccagaggtagccaaggttgtacctcgtgctgcagctggacttggtaatgtgtgtgagtcacccaggtgatactggttttgaagtcatgcaggggtcattgaagaactcctgaggctcggcactgtgagaggccacggaaggccattggtgaaggtgcagccttagttgcagttgatggcccaggactaaaagggtcatgcaaaggatttgaggctcagcaccgtgaagagagcctatgagcggcttggctattaatgaagcctagttgcagcagaagactctagtgtattggagatgccaataccatgggatgactaccaagaacagcagtgtcagtgaagtggatcaacctgagcttagagtgctacaagagggcagaactggagaagtgacgacagtcctttggaggagctcagaagatcttgaatgaatcccagacattgagttggattttgcttttgattgtgactgtgccttgatattttccctcttgaagtaagaagtattttagtggagcccacagttaagagactttgaattataaaaagactttaaattttaaaagatactggatattttaaaggaattgaaattttaatatgtaaacactgttgggacttttaaagttacttagatcttggggactcaataaaaatgtaaggggaggggccgggctctgaggaaaccttgggcgcaaactccatagccagctccacaacacccagaggcagctccactcccaggtgttctaacatggccaggatcccaggatcccagaatcccaggatcttggtcacaccaggatcccaggatcccaggatcccaaaggcagcttgactcccaggagcttggacacacccaggacctcaggatcccaggatcccagaatcacaggatcacagagacagcttgactctgagtagttttgacagaaccaggatcacaggaaggacaggctccagtcagacatagtgagggcaggtagcactagagataaccagatggcaggaggcaagcataagaacaaaagcaacagaaaccaagattatttggcatcatcagaacccagttctcccaccatagcaagtcctgggtacaccaacacatcggaaaagcaagattcagatctaaaatcacttctcatgatgatgatagaggacattaagaagaacataaataactcaaagtaatacaggagaacacaggtaaacagctagaagcccttaaagaggaaacacaaaaaaaatctcttcaagagttacaggcaaaggaaaggaacaaaaccatccaggatctaaaatggaactagaaacagtaaagaaatcacaaacggagacaaccctggagttagaaaacctaggaaagagatcaggactcatagatgcaagcatcaccaatagaatacaagagatagaagagagaatctcaggtgtagaagataccatagaaaacattgacacaacagtgaaagaaaaaagcaaaaatctcctaacacaaaacatccaggaaatccaggacacaatgagaagaccaaacctaagtataataggtaaagaagagagtgaagattcccaacttaaagggccagtaaatatcttcaataaaattatagaagaaaacttgcctaacctaaagaaagagattcccatgaacatacaagaagcctacagaacttcaaatagtttggaccagaaaagaaattcctcctgtcacataataatcaaaactccaaatgcactaaacaaagaattttaaaagcattaagggaaaaggtcaagtaccatataaaggcagacctatcagaattataccagacttctcactagagactatgaaagccagaagatcccgggcagatgtcctatagacccttagagaacacaaatgccagcccaggctactatacccagaaaaactcaatcaccatagatggagaaaacaagacattctgtgacaaaaccaaatttatgcagtatctttccacaaatgcagccctacaaaggataatagaaggaaaacaccaacacaaggagtgaaactataccctagaagcaagactgtcatctttcaacaaacccacacaaacaattccacctctaacaagaaaattcacaggaaaaatcacttttccttaatatctcttaatatgaaaattaatattaccaacatatcctaattgattgaaattcaaaaatatgaggaattagaaatttgttggttgttatccagtggtctctaatttggtaatgggagaaataggtccaatattgtacaatccatattcactttctgcttgtttgtacatgacagggtctttctctgtgccacataatggtcttgaaatcatgcttctcttatctcagcctctctattagtaggattgtttatttgatgtttttacactatactatggttttcagaacagcttacctatttcaaatttatttatacagccgaaagaaatgtagacaattaatttggaaggtggcctgtaagagaacagccaagagtgagactgaaggctttgcttgatatttataattactgtatcaattttgaagaagaggactttataagttaatcttattctgagatgactgctttccaaaatcatcacagcccatgtaccagaatcttacccttgcctaacgtctgtgccaccctccaagcagaactgtgcttcattaaaacagttgataaatgacttcactggatagaccatcttaacacacacaccacttattaaatgaatgtaacctgttccctgtgggctgagaatgatgacaagtgttcaagtcaaatagctttgaccatagcaggaaatgtgttcccaaaaactgtgcctacaattcattccttggcgcagcagaactgtcaactcttagcttatctactatggaggtaaaatcatttggtgatgtgacagacactgaagtacagttttattgcagtgaactccaatgttcaatatttgttcttattttgtgtttgtaccacagtaagagccaagattttaagccctattaaaaacaaaacaaacaaaaagactttatgttcattaaaaaacctaatagtgatatattattttaaaatatcatatagttcatatatttggaattatttaaaacttatattgagaatagcgtatgtattttcagtattgctgtagacaagcatctacagaagactgttcaattaattgttgttttatatcaaacaacttttataatactcatttttattgttacaacattttataaattttaaagaatatgataaaaatgaaagtattgcaggctttgaagggggtgtctccgggaggaattggggtacaaaaatgaaagaatgtgattcaactctatttactcaaaatatgtttttaaatgttaacaaattcagataaattgaaattatgtatcttttctcatcataatgcaataaaacttaaataaaaaaataataaagtaagggttgaggcttaatagtgatgtatttatgtgtcaggttgacaagaggtcagttgtactggctggtttagtgtgtcaataagctggagttaacacagagaaaggagcctcagtttaggaaaagcctccatgagatccagctttttctcaattagtgatcaagggggaaaggccccttgtgggtgggaccatctctgggctggtagtcctggggttctataagagagcaggctgagcgagccaggggaagcaagcaggtaagtaacatccctccatggcctctgcatcaggtcatttcctggcctgcttgagttccagtcctgactttctttggtgatggacaacaatgtggaagtgtaagctgaataaatcctttcctccccaacttgcttcttggtcatgatattttgtgtatgaatagaaaccttgactaagacaatgttcctcaacacatttactctttgttttaacacagtagcaaatgactatgttagctagatgctgcatggcaacattaaaaatcaatatttgatcaaagttaaatgaaatatcaacagaaggaatctataaattaaagaaaacagaaattttattcataggtctattattatattaaaatattaataatcatggttttaaagtttgaaattacagagtaaaacaatttctgttaggttgtacgtgtgcaatactaaagagggaacatgcatttaagtttctgttgtaacattataaatgctaacattataaacacaccaaatgcttctgatggaatcagaattatgttgcaatataatacacattattttattagtttatttaaattcttggtatttggtagcttacactacagctacactgttttctttaagttctttaacgaccaagctcccagttcattgattcattcaacaaatatttactatttacttattttaatgtatgctttaaaattatatttctgtaattattctgtctttgtgcttgttttgattgtgtatatatgtatatgtgtgggcacatgtgtcacagtacttattataaaacttataagacaacttttgagagtagatcatctcttttatctcctttcaccattagggttcaggatattaaaaaaaggcagataccttaccaactcagctatttactggctctttaaaaagatgcttattatctcccatgctcatggattggcaggatcaatatagtcaaaatggctatcctgccaaaagcaatgtacagattcaatgcaatgcccatcaaaattcttcacagagttagaaagggcaatttgcaaattcatctagaataacaaaaaacctacgatagcaaaacctcttctcaaccataaaagaacctatggtggaatcaccgtgcctgaccttaagctgtactaacaattgagataaaaactgcatggtactggtacagtgacagacaggtagatcaatggaatagaactgaagacccagaaatgaacccacacacttatggtcacttgatctttgacaagagagctaaaactatccagttgaaaaaagacagcattttcaataaatggtgctgacacaatcggcggttatcatgtccaagaatgcaaattgatccattcttatctgcgtgtacaaagctcaagtctaagtggatcaaagaactccatataaaaccagagacactgaaatttatagaggagaaagtggggaaaagcctcgaagatattagccccgggggaaaaattcctgaatagaacagcaatggcttgtgctgtaagatggagaattgacaaatgggacctcataaaattgcaaagcttctgtaaggcaaaagacactatcaataagtcaaaaaggccaccaccaggttgggaaagaatttttaccaatcttaaatctgataggggactaaaatccaatatatacaaagagctcaagaagctgaactccagaaattcaaataaccccattaaaaaatggggcacagagctaaacaaagaattctcatctgaggaatactgaaggactgagaagcacttgaaaaaatgttcaacatccttaatcatcaaggaaatgcaaaccaaaacaatcctgagattccacctcacaccagtcagaatggctaagatcaaaaattcaggtgacagcagatgctggagaggatgtggagaaaaaggaacactcctccattgttggtgggattgcaagcttgtacaaccactctggaagtcagtctggtggttcctcagaaaactggacatagtattaccggcagatccagcaatacctctcctgggcatatacccagaagttgttccaactggtaataaggacacatgctccactctgttcatagcagccttatttataatagccagaagaagctggaaagaacccagatgtccttcaacagaggaatggatacagaaaatgtagtacatttacacaatggagtactactcagctattaaaaacaatcaatttatgaaattcttaggcaaatggatatatctggaggatatcatcctgagtgagttaacccaatcacaaaagaactcactttatatgcactcactgataagtggatattagcccagaaacctagaataaccaagatacaatttgcaaaacacaagaaactcaagaagaaggaagatcaacacatggatacttcattcctccctagaatagggaataaaatacccatggaaggagttgcagagacaaagtttggagctaagataaaaggatgcagtgactgccccacccgggggtccatcccataatcagccaccagatgcagacactattgtataatgtcagcatgattttgctgaaaggaccctgatatagctgtctcctgtgaggctatgccagtgcctggcaaatacagaaatggatgctcacagtcatctataggatgcaacacagggcccccaatggagaagctagagaaagcacccaaagagctgaaggggtctgtaaccctataggtggaacaacaatatgaactaaccagtatccctcagagctcgtgtctcttgctgcagatgtagcagaagatggcctagtcggccatcattgggaagagaaaccccttggtcttgcaaattttatatatcccagtacaggagaatgccagggccaagaagtggaagtggctgggtaggggagcagggcggaggggagggtatagggatctttcgggatagcatttgaaatgtaaataaagaaaatatctaataaaaaagaaaaaaataagtcaataaatataagatttaagtaaaaaaaaaaaaagaaaaagaaatattgtccgtacttgggcagggcatgttagacagcaaaagaaaagaattgttttttttgtaagatgaaccttgtgacatgtgcacaattagcccttattctagccctcagattccatgcagtggagattattttctacccatccttgctagctgggtagagtaacttactttctcatcatggttgtcattccttgctgtaaagcactggttttgtttctaggtcagcatgataagcaacctaatattttattacagctctctagcctcttccaattgctaagtggacagaagctgcagaaatagaacacattatccccctcctgttttattcttctctgtaaagcagcattactgagacagaagctgtgagtgacaattgggtctgtgtggtggctgaaaatgacagcatattacttgctaactaagaaagcacctatgctttgaatccataattgagctggcataaagcaggtagtattttgcacacctggtgttacctggagtcacaaataaggactcattttgtcacataaaacagtgcaattctcagatcagcgatttagtattatttaagcatccagttctcatttggctactgtaatgcttcagttctttatgtgtagcacagatgtgaaacagcatacatggcatgataaaaggctttcttgttgcaaagaattttaggttttacaaataaccttagaataattcagggagctaaaaggtagagagggaaatgttgattacttatacacaatgggctctctagcaccatatacattatatatatatatgttggaaatagttgtattatctagattcttttaaaaactggttttcttcttttttttttttttgttttgttttgagatagtctcacttagctgctctggaatccaccatgtagacctagaactcatagatatcagtctgcctatgccagttgaatgctgtggctgaaggcatttagaaccacacctgacagaaaatgctttttattttttttagatattttctttatttacatttcaaatgctatcccgaatgttccctatacccccccccaccctgctcccttacccacccactcccccttcttggccctggcattcccctgtactggggcatataaagtttgcaagacctaggggcctctcttccacatgatttcaaatgctatccccaaaacctcctataccctacccccgccctgctccccaacccaccactcccacttcctggccctggcagtcccctgtactggggcatatgatcttcaaaagaccaagggcctctcctcccattgatggccgactagggaatcctctgctacttatgcaactagagacacagctctggggagtattggttagttcatattgttgttcctcctatagggttgcagacccctttagctccttgggtactttctctagctacttcattcggggccctgagttccatccaatagatgactgtgagcattcacttctgtatttgccaggccccggcatagtctcacaagagacagctatatcagggtccattcagcaaaatctttctggcatatgcaatagtgtctgggtttgttagttgtataagggatggaacaccaggcggggcagtgtcttgatggtccttctttccgtctcagctccgacctttgtctctgtaactccttccatgggtagtttgttccccattctaagaaggaacgaagtatctacactttggtattccttcttcttgagtttcttgtgttttgcaaattgtatcttgggtagtctaagtttctgggctactatccacttatcagtgagtatatatcatgtgtgttcttttgtgatttgtttacctcactcaggatgatatcctccagatccatccatttgcctaagaatttcatgaattgattgtttttaatagctgagtagtactccattgtgtaaatgtaccacattttctgtatccattcctcagttgagggacatctgggttcttttcagcttctggctattataaataaggctgctatgaacagagtggagcatgagtccttactacaagttggaacatcttctgggtatatgcccaagagaggtattgatggatcttccggtagtattatgtccagttttctgaggaaccaccagactgatttccagagtggtgtacaagcttgcaatcccaccagcaatggaggtgtgtttctctttctccacatcctctccagcatctgctgtcacttgaatttttgatcttagcaattctgactggtgtgaggtggaatctcagggttgttttgattttcatttccccgatgattaatgatgttgaacgttttttcaggtgcttctcagccattcggtattcctcagttcagaattctttgtttagctctgtaccccattttaaaaatagggttatttgattttctggagtccatcttcttgagttctttatatatattggacattagttgcctatctgatttaggattggtaaagattttttcccaatctggtggtggcctttttatcttattgacagtgtcttttgccttatagaagctttgcaattttatgaggtcccatttgtcaattctcaatcttacagcacaagccattggtgttctgttcaggtaatttccccctatgcccatatctttgaggcttttcctcactttctcctctataagtttcagtgtctctggttttatgtggagttccttgatgtacttagactttagctttgttcaaggagataagaatggatcaattctacaaaaaatgtggtacatttacacaatggagtactactcagctattaaaaagaatgaatttatgaaattcctaggcaaatggatggacctggagggcatcatcctgagtgaggtaacagaatcacaaaagaactcaaatgatatgtactcactgataagtggatattagcccagaaacttagtatacccgagatataagacacaatttgcaaaacacatgaaactgaagaatgaagaccaaagtgtggacactttgtcccttcttagaattggaaacaatcacccacggaaggagttacagagacaaagtttggagctgagacaaaaggatggaccatctagagagtgccatatctagagatccatcccataattagcctccaaacgatgacaccattgcatacactagcaagattttgctgacaggaccctgatatagctgtctcttgtgaaactaggccggggtctagcaaacacataagtagatgctcacagtcagctattggatggagcacaggacccccaatggaggagctagagaaagtatccaaggagctaaagagatctgcaaccctgtaggtgcaacaacattatgaactaaccagtaccccggagctcttgactctagctgcatatgtatcaaaagggcctagtcggccatcactggaaagagaggcccattgaacatgcaaactttatattccccagtacaggggaatgccagggccaaaaaatgggaatgggtgggtagggaagtggggggggagggtatgggggacttttgggatagcattctaactgtaattgaggaaaatacgtaataataaaaatattttaaaaaataatggatcaattcgcattcttctacatgaaaaacgccagttgtgccagcaccatttgttgaaaatgctgtcttttttccactggatggttttagctcccttgtcaaagatcaagtgaccataggtgtgtgggttcatttctgggtcttcaattctattccattggtctacttgtctgttgctataccagtaccatgcagcttttatcgcaattgctctgtagtacagctttaggtcaggcatggtgattccaccagaggttcttttatccttgagaagagtttttgctatcctaggtcttttgttattccagatgaatttgcagattgccctttctaattcgttgaagaattgagttggtattttgatggggattgcattgaatctatagattgcttttggcaagatagccatttttactatattgatcctgccaatccatgagcatgggagatctctccatcatctgagatcatctttgatttctttcttcagagacttgaagttcttgtcacacagatctttcacttccatagagtcacaccaaggtatattttatattatttgtgactattgtgaagggtgcttttccccctaatttctgttttttcagcttttaggaactttattttctttccatcttccctcccccccccccccactttgctcaggtgtctgcacagcagctcaggaccactcagtggtggcttcaactcactcagtggcctgtgctgtgggagctgctgaccaacctcactggctggctgtgcactccagtcttctgtggggaactgctggatgggcacagagggaacctgcacaccctcagaccagtcggccacctcaggctgagcagcagtgaactcaggagctggtacagtccattcaccctggaattcctccttggtcacagccttctcagcagcagcctgctcctccttctcaatctcctctgggtctctgtagaagtaaagatcgggcatgacctcccaggggtgctcacgggagatagtacctcgcatgcagaatacttccctggccagcatccaccacatcagacccactgagtgagctcccttgttgttgcatgggatggcaatgtccacatagcgcaggggagaatctgtgttacacagagcaatggtgggcaggttgacataagaggcctctgtgagtggctgctggtcagccctggaattggttaccactggaagctgtggcgccctgaaggctgcttggatctggttagtgaaggtcccaggtgtgaagtggccagcaattgaagtagctcctgtggcagcagcaaacttcagcacagctcgctggccagtgttcctggaggagaggacgctgatgtcagcagggttctcaatggcaacaatagctcaggctgcgagcaacagcttctcccaggtcctcttcagatttatgatgtagatactgtcacttttccttttgtagatgtactgctccatctgaatgtcagggttggtgccacctaagtgggttcctgcagcaaggaatttgaggacattcttctccttcatcttcaggacgtcaagggctctggacattgtgtaaatttccctttaagttacgatgggaatcaagaacaacgccgtatggacccgtgcccgggtagtgtggaaaggaaaaaggtttccctaatttctttttcagcctgcttatcctttgtgtacagaaaggccactgatttgtttgagttacttttatattcagctacttcactgaacctgtttatcaggtttaggagttctctggtggaatttttaggatcacttatatatactatcatatcatctgcaaagagtgatattttgacttcttcctttccaatttgtatccccttgacctccttttgttgtcgaattgctctagctaggacttcaaattctatattgactagatagggttgtctagtccctgattttagtgggattgtttccagcttctctccatttagtgtgatgttagctattggtttgctgtctattgcttttattatgtttagatatgggccttgaattcctgatctttccaagacttttatcatgaatgggtgttggattttgtcaaatgctttctcagcatctaacgagatgatcatgtggtttttgtctttgagtttgtttatatactggattatgttgatggatttccgtatattgaaccatccctgcatacctggaatgaaacctacttggtcaggatggatgatcgttttgttgtgttcttggattcggttagtgagaattttattgagtatttttgcattgatattcataagggaaattggtctgaagttctgtttctttgttgcgtctttatgtgatttatgtatcagagtaattgtgacttcatagaatgaattgggtagagtaccttctgtttctattttgtggaatactttgaggagaaatggaattaggtcttctctgaaggtctgataaaactctgaactgaacccatttgatcctgggctatttttgatttggagactattaatgactgcttctatttgtttaggggatatgtgactgtttagatcgttaacttgatcctgatttaactttggtacctggtatctgtctagaaatttttccatttcatccatgttttccagttttgttgagtatagccttttgtagtatgatctgatgatgttttggatttcctcaggttctgttgttatgtctcctttttcatttctgattttgttaattatgatactgtccctgtgccctctagtgagtctggctaaggtgtatctattttgttgattttcttaaagaaccagctcctggtttggttgattccttgcttgaatagttctttttgtttccacttggttgatttcagtcttgagtttggttatttcttgccgtctactcctcttggatgaatttgcttcttttttttctttttttttttatttaatacatattttcctcaattacatttccaatgctatcccaaaagtcccccattaccccccccccacttccctacccacctattcccatttttttggccctggcgttcccctgtactggggcatataaagtttgtgtgtccaatgtgcctctctttccagtgatggccgactaggccatcttttgatacatatgcagctagagtcaagagctccggggtactggttagttcataatgttgttccacctttttttgttctagagcttttaggtgtgctgtcaagctgctagtgtgtgctctctctagtttctttttggaggcactcagagctatgagttttcctcttaggactgctttcattgtgtcctatacttttgggtatgttgtggcttcactttcattaaactctaaaaagtctttaatttctttatttcttccttgaccaaagtatcattgagtagagtgttgttcagtttccatgtgaatgttggctttctattatttatgttgttattgaagatcagccttagtccttggtgatctgataggatgcatgggataatttcagtatttttgtatctgttgaggcctgttttgtgaccaattatatggtcaattttggagaaggtcccatgaggtgctgagaagaagatatatccttttgttttaggataaaatgttatgtcgatatctgttaaattcatgtttttataacttctgttagtttcactgtgtctttgtttagtttgtttccaggatctgtccattgatgagtgtatagtgttaaagtctcatactattattgtgtgaggtacaatgtgtgctttgagctttactatattttctttaatgaatgtggctgcccttgcatttggagcatagatatttagaattgagtgttcatcttggtagattttacatttgatgagtatgaagtgcccctccttgtcttttttgataactttgggttggaagtcaattttattcgatattagaatggctactccagcttgtttcttgggaccatttgcttggaaaattgttttccagcctttcactctgaggtagtgtctgtctttttctctgaggtggctgtaagcagcaaaatgttgggtcctgtttgtgttgccagtctattagtctatgtctttttattgaggaattgagcccattaatgttaagtgaaattaaagaaaagtaattgttgcttcctgttatttttgttcttaaagttgggattctgttcgtgtggctgtcttcttttatgtttgttgaaggattgctttcttgctttttctagggtgtagtttccgtccttgtgttgttattttccctttattatcctttgaagggctggattcgtggaaaaataatgtgtgaatttggttttatcatggaatactttggtttctccatctatggtaattgagaattttttggggggtatagtagcctgggctggcatttgtgttctcttagtgtctgtataacatctgtccaggctcttctggctttcatagtctctggtgaaaagtctggtgtaattctgataggcctgcctttatatgttactttgacctttttcccttactgcttcttaatattctatctttatttagtgcatttgttgttctgattgttatgtgtcgggaggaatttcttttctggtccagtctatttcgagttctgtaggcttcttgtatgttcatggacatctctttctttaggttagggaagttttcttctataattttgaagatatttactggccctttaagttgaaaaccttcattctcatctatacctgctatccttaggtttggtcttctcattgcatcctggatgttttgggttaggatctgtttgcattttctttgatttttgtgtccatgttctctatggaatcttctgcacctgagatttttttcttccatctcttgtattctgttgctgatgcttgcatttatggttcctgatttctttcctaggttttctatctccagagttgtctccctttgtgatttctttattgtttctacttccatttttagatcttggatggttttgttcaattccttcacctgtttggttgtgttttcttttaattctttaagggatttttgtgttacgtctttaaggacttttacctgttcagcagtgttctcctgtatttctttaagtgagttattaatgccccttttaaaaatcttctaccagcatcatgaaatatgattttaaatctgaatcttgcttttcgggtgagttggcatatccaggactcgctgtggtgggcatactgggttttgatgatgcggagtagtcttgttttctgttagtaagattctcatgtttgccttttgccatctggtaatctctggtgttagatcttctagctgtctctggctggagcttgatcctcctgtgattctttagcctctgtcagcactcctgggagtccaactctctcctgagtcccagtggtcagagcaatctctgtaggcaagctctcctcttgcagggaaggtgcacagaagtctggagctcagatccacctcttgagtcctggggtcataaccctccctggaggctgactctcttcaggcagggaaggtgctcaggggtttgggtctcatctctgccatctggctgaggatgaaggctggaagggaccctgtccaagaagctctgttgcttctgccacccacatgctctcctgtgtagactggtctcagtgatcctaagatcctgggtgtgttagggccaggtgagttcgcacccaagatggtgtggggctggctccaacaggaatgaaccccagcctccggttgggcgggtatcctttgtcccctgttcctgctggcacaagaccctttgggttttttggaacagatgttgcgtttctatgcaccagtgatcccaagatcctgggtgtgctagggcctgctgagttcacgcccaggatggctcagggctggtacagaaattgctttttaaaaatcatctagtgctagttcatatttataaacagctataaacaagaccgatactttctttaaaaaatagagtatttttacatgcatggtatgtactcactaataagtggatattagccaaaaataaaaataaatgtacagaattcccaagatacagtccacagaactccaaaagctcagcaagctgaagtgcccaagtgaagacgactcagtcccatttgggagggagaagaaagcaatcacaagtggggaggcagggagtgaccttggagggaaagtggacagggtggaggggggaagtgggctggagaggggaacctgatctggtattgggtgaggtaaaaggactgaagccctgagggccagcagattggaaacaggcaaccttaggaagtacgaggatggggggaccttccagaatgcaccagagacctgggaggtgagagactcctaggactcaaagcgagggacctgatatgaaatgcctgacagtagggagagggaacttatagagcccacctccagctggaggacagggcatcaagtgaacgatagggttcccattccacagtcacatctctgacccataattgttcctgtctgaaagaattacagggatggatatggagaggagcgtgaggaaaagaagttccagcgacaggcctaaagtgagattgagctcaaggggaggtcccaaggcctgacactattactgaggctatggagggaaaacaaacaaaaagggacctatgatgactgctctcccaaagacccaacaaacagctgaaagagtcagatgcagatatgtttgcccaaccaatggacagaaacagctgacccctgttgttgttttagggaaggctgaaagaagctgaggaggagggcgaccctgtaggaggaccagcagtgttaattaatctgaacccctgagatctctcagacactggaccatcaaacagacatcatacaccagctgatatgaggcccccaacacacatacagtagaggactgccaggtctgtgcttattcagagatgacacacctaaccctcaagagactagaggccccagggagtttagaggtcaggtgcggtgctgggtgggggaatccacatggagacggggtgaggtggggaagaggtgtcagagggtggatgggggtggggtgggaatggaatacggagtgtaaaaagcaaattaaaaataaaataaaaatttaaaaagagcattttttctttgaggattttattcatgtacatgtgtattttgatcatacttatcctcacacttccccttctaactcctcctaggacctcactgccacctcctacttactttatgtcttttcttttttcttttttcccttaaaaacctaactgactcagtctaattagagctgcccatatctgtgtgggtgtggagccatccattggagcatcattgaaagaaaactgactctttcctaatagctgtgaactgtcagtaacttctcagctagaggtgggttcctgtatgccacgaagacaggcacttattattagaaggactttcaaaagcattaaactatggaggtaaagatgggattctttgcaaagtttcaagctcataatcacagaatgcttatatatggaccacctttgcatttgtgggcctagttccagtaagactattgttgaacctagtatccagtacctcacttacaaaaccaaaaataagaaccaaaggcagtgttcatcaatattttcagcaaagtagactgtttttaaaatatataaacccttggaataaggcagggaacccatcattgttctagtgtgtgttcaaatggcaaaaaaattgttttgccagaaatgtcagttgctttcactaactgcttttgcaacagtgcatagccatcttttttgtttacttatttcttggttgtacttccattcctacattaaatgcaaggcccctgattacataattcacgattgtttcagtagtggttgtattgacagtctctgtagctgcattagaggtgtgtgtgtgtgtgtgtgtgtgtgtgtttgtgaatgtgtgtgtgtggcacgattgtgcatggcacacatgtgcagcatggatgccttcacattaagaagctgtgatcataataacttgaaatgtgcagcatctggagacagctctacaggatattgaattttgaaatgatattatttatttcttaaaagcttaatggatggataaaaaccagagccatttgctcctgtcttgggaagccagagaaaccaaagactgaggggtgtgcctgtacactcttggtctgtgtatccacagctttgatttctatctagagtaatagatctaaggaggtgattatttgcatctttgaagatttcagtcctgctggctgattagagtagaacattagaaaagcattgcatgtattctgtggtattttgaagaattattatcaacatctttttctagtagtttcattaagtgatttaattttagaagtggaaaaccttagatattggagtgcttaaatctaaatagactattgtcttaaactttattaaacataagaattatttcctagacctgggtgtaaagcggtgggatattagggatgtagaaggggatatgatcaaagtatattatatgcatgcatgcagatgttgtttcaaggaatgagtgagggttctgttttgcagaatcttagtctcatggataaaagagtctaaacatggacttggaaggataattttattagagtttgagagaaaacaacaagggaggcaaactgtaaatcttggcagctggtgagaagacaggtatggataagaggcagagagaaggccatatcttaggagttagcctacaggaaagcagttaggcccagtgatggatgtttgtaaacacctgaatggggagagggtggtatttagagaaagactgggaatgtctagagtgtcaagtcaaacatcctcagggttgactagtagcctaaacagagaaagagagaagagttgaaaggcatcctttatactttttttttttttacttaaaacttgggaaactgagcatgcttagcagtgagaatttgtaagcagctgtgtggatggggtggttttgaaaggggagggcaaaatggggggagaagaggaagggaagaaggaagggaaagagaaagattgtgaatgagaatggtttattttatgggggttcaacaaagtcctgatacttctgttctcctttctttcatctggttctttaaattgtgatgcttctttttcctaaaactgatgggttatcagggaaacagaaatgaggtccaaagctgttagcgcagaaccaggtccatcttcagtgccttctaagcctgctaatgcctgtctagatctttaacagtgtcagcatgaaatctatttctctgtacaattaatatgcactaatagaaaacaattattttctgtaatattatgttaggttctaacaaaaatcaaattagatgttcaaagcagaccacaaagatattcaacatagaaaaagtatatttgagctaatatatttttaaagatttatttatttattttatgtgtatgagtacactgtagctatacagatggttgtgagccttcatgtggttgttgggaattgaatttaggaccttggcttgctccagtcagctctgctcactccctgttcgctcccgcccaaagatttatttattattatacataaggacactagctgttttcagacacaccagaagagggcatcagatctatttgagctaatattaatgtccttatgagtattaggacaagagatggtccttctgtggtggttggcaatggttacttgaagtccttttttcagtcctaggaagctttaccttgaacactcattcatgtactgatttatcttcactggtgtatcttctcagagatgtccatgaaaaccatgtaagataggcctcattagctggtgctccctccttttccatggtagttcttggagggagattctagggagcaatattgttagatagagaaaggcagaatatgacaagcatttatgtgtggggcagatgatggtaggcagtgaaagtggagcctaagactttgtagatcatggataccatgttaaagaccttgaatttatttttccatggatactgacattatgcaaagtaggactagctccatttctggcttgaagcagggtaatgatagtagggagaaggaaaacactggaagagtgctggagaagtagtgttggaagtcctaggaaagggcaggatatggggatcatgcagtgtagtgctgtggtcctgtcagcagcaggaatggagtcacagccccagtcttcatgttgagcaggttgaggagctcccttagtcttccagagaactcaacgcagagaatactaaatccttaggctcaaggcagaaaagcgtttcagtatgaggcagactaaaacaaagctgggatttattagaaatagaaagtaagtcattctgggaatgaacaaggcacactgagaacaatattttaacataggttttaaacacaggagttaggagtaagagagactaagttacatccaagtgtggggtgtgggattctctaggaagggtcacccataagtgtctaagcataggcatatatatgtgtgcactagtcatatgtatagtaatggtatcaataaacagttatgttttgagaagccaaacttcaaaggtctaacacttcccacctagtttcgtattctatacccaacatctaatgttctacaaattgtagctttgttatcattgtcataacagcttatatccatatatatgggaatatataccatatttctcttcccaagtctgaaatatcttgcttaggatgatttttttcctagttctagtttctaggttttttattattattatttttattattttttaattaggtgttttcttcatttacatttccaatgctaccccaaaagtcccccaagcccttccccccaatcccccccgccacttccacttcttggccctggcattcccctgtactgaggcatataaagtttgcaagaccaatgggcctctctttccactgatggccgactaggccatcttctgatacatatgcagctagagacacgagttccggggggtactggttagttcatattgttgttccacctatagggttgcagatccctttagctccttgggtactttctctagctcctccattgggggccctttgatccatccaatagctgactgtgagcatccacttctgtgtttgctaggccccggcctagtctcacaagagacagctatatctgggtcctttcagcaaaatcttgctagtgtatgcaatggtgtcagcgtttggaagctgattatggggtggatccctggatatggcagtctctacatggtcaatcctttcgtcacagctccaaacttgtctctgtaactccttccatgggtgttttgttcccaattctaagaaggggcaaagtgtccacactttggtcttcattcttcttgagtttcatgtgtttagcaaattaatactcagctttcttaactggaacgttgtgttagtaattcctacatcatgaagttatagtgagacttgaggaatgctattataagtagagcccatgtgcaaagtgagtattcaatatattgttctagctgatttgaaacaataccaaaatgtactgattctgttcggaagtaaattgcttagagtaataggaagaagcatgaaacatcaagggtagtatattgattgaggtcagctattgtaggtaggatttaatttttttttgagacaaaatttctctgtgtagccctgtctgtcctgaaattaactctggtgcccaggctggcctccaactcagacatctactcaccactgcttcctgagtgctggaattaaaggtgtgtgccacaacttgcagctccaggatttaattttaaagtttttaatggctcaagaaatggaaatgttaatttctttgactagattattattactgtatacatgtattgaatgatcatatgataccccatagattttttgcaaatcaaataataattttgaaatacatgcaaagaaaaaaaacctaccaaaatgcttataaaaatgaaaatgatactatatttggttgttcacggttgtgaaaaaagccacataaataactagtttcttttcacttctctaaaatgggttgaaatcttgaattaattatatgagagtcaaaagcctctgacaccaaggtaactaatagtgtgatttttggaaaataccaagctccaggggaactaccaaactcgggaagagccttggattatctctcctctatgaccacttcttaccagatcttacatgtttgcttgcatgtgggccattaatctggccctgtgtagaaactctcttcattattttacactgtattgagtatgaaaccaagggcctgttgcacatactaggcaagtactgtatcattgagctacatccctaacctgaaaatctgggactacttagccccctacttattaagggtaaaacaagaatcattcaagataagtcctgttctgtttttatgcaactgattgttaatggcattacccttttctgctgagttttgtataataagacagctttgtttttgaatgcaaaattgagcaagcatttatctctgttagctgtctatttacctgtatcaaatgaatggcacaccatacttcctctttgtttcagttgccaagaaattcagcacaccatgcaaggtttagtcatatcagaaactctaggtggacctcagacttacttcttccttctatgtagttaagcactgccagtttctgtttaaattagcctggtacagaatgcttacaagctttacaaaataacaagagtatgcctgagactgatccatataatttagcatttagccaatgtaacaattttccagattcaaacagtcagtaaatatattgtgtttaaaacacccagctgtctagcagtaggggcatggtttagtaaattgtggtatattcattcaccacaattagaatttaagtccatgattctaaagcaaacctgttacctaagctcatatatacaactgtgcaactgcatagcaatatacatgcatgactttacatgactcaacctgagtaactcttaaaagattgcatccaggaaaaaaaagagagatgctatgaaatttgtctagtaagtatgatttctactaatgaaaatttcaaagaataaatggcctcccagaaaaaaggactattttcttgcttcttttatagccaggtgtgaccatgtgatcaagtatggccaacgactggccagtaaggtaaagtagagtatgcaaattggaagccatgcctttaaatagaaagagaatatcttcctttgtcccctcagttccctctgcttaaatggtaatatgctcggacagggagccatgggttcatcccaggaatgcgtattccatcttctacatgacagggtcgggggaggtggatttctgccttgtttaagctactattatcttgctctttgttccacaaccacaacctcctagttcgagaaaatattatttgtataaattaaaaccagaaaagggggatgggagatggctcaatcggtaaagtgcctaccatgtgagcatgagaaacacatgaaaaagaaatataaataagaaaagggctatttcacatctgtagatatgtgtaaatcttagattagggatacagacaaaaatgaattagtggttgtctcagaggcagaagagaggtactggggtcaggaatgaagagatgcagcctgtcttcttgctaagtcatgagccagtctttcttttctgtgttgagtaggttaaacagtgataaaggtaaagaaaatgcatacctgagatgtttgtgattgctttatggaaacctgtttttggatgactcttaatagaggcctttactctgcatgaaatgattagattaggaaaaaaggacatagccatagcctgcctgagatagaccccatgtctttggatggatgtcctcaccctctgattgttagctgctaaacagagtgctgggtttcctttcatacatcttaggtacattccaggtgagtcaccctgggatttggggattcccaggctcttgagaacatacaatcagccaagctcctgcattcaaccaatagtctgtcactcacattcaacacatgggaaatggttagatagtgttaaggtaaatatgttcatgtaattatctgtaaatctgggcagaggtgcgtgaccctaactgtcttgttctctattctaggtacataactcaatacatttactacttggaattctgaatgaggttcttccagtcacataagtgtgcttaatctactcgctgcccctgtttctctctgtttgcctaaatgtacatatgcccaaagggtagtctgctctgatgacttttgctttcatatctgtggctttagatataatttttgcataggtagtttccagttctttctattcagccatgagctttgactcctctctggccacttgcctcattcttaccttagtaatcaacataatctaacactttactcctggctctgcattttgcagcagacctatccttctgttatgctagactgccatccacacctagccagatggtgggatgcattcccttcacacacaacatttaactgcttgtagttcccttgagagccttgactatccccctgcttttatatgaactagaaagaccattgactcctccagtgcttttttttctcttttagcacaattggctttcagtgggttgtagacagtcataggaaccactgtatactatttctaacctgttccctcttttagtgctttgcactgtcgtttagagttagagagctggttcttatgcatttgtcaaattgatgcaggtagaaagagagaaagaaagaaagaaagaaaggaacactcttctcagtctgaatgaagtctctccaaccgagagtaaagaattcctagggcaatgaacacattttgctacgaatattgcctttatagagatgatattacttttctctagagcaatttcaaagaagaatgttaaagtagcaataaatcctgcttaaggcctaagcattctgaaccaggtatagactttttcatcttccaacactaaacctgcatttttaaaaagtaattctttttaaaaagacacttcttttaaataaaaggtaattcttgcgcaacccttgtgatctattgggttactttgtcagattgtaatcttacccagttcacttcagataccactcttcgatcttatttaccaagaaaagggggaaagggcagaaagaggtttcttagaaactgtttgaacaatgtgatttcatccattgggctattaagacaattaaggggaactttttctagagaagtccacacccatcaaagaaacagctctcatcccaaaggaacaaatgagcccagtatggcctaggaacatagatccaggtttactcaaataccatgttctagcatgaaaacagttccatcaaaaagtaatagatacttaaatcgtgagacaaaacacttttcaaatgtattggcagatatatccagtaggtgggttacagacaaacagggatatctcagctctagtctttccttagatgctgacagcttttttgattgataagaaactgggagtatagtggtacagttcaaaggatgtacctgatgaatataaagatgttaagtcatataaagaagggggtaataagtttcaattaaggggagataaagacaccacaagataatttagctcttgacctgcaacattccaatttctacatatcactgaagttctcatcaatcaaatagcccttggagtcagagcttctttgcagtagttcatgttctcactactaacctctgctttaaatccatattaaatgcccccaaaacgccaactctgcttcatattgtctcatcctgaagttcttctctgtggccagattaagaatctgagcttcttctgaatagaagtctctgaaaagaactcactaggctgctgcaggtggcatcatggagcgctctctctctctctctctctctctctctctctctctctctctctctctctctgacacttctgcccctgaggaagtgatgagatgaacgctcagttctgttcaattaattgatgtgggcatcttatttttaaacatgggaaaatgtaaccattggccgaaaaattgattgacaaggagctgagtagctaacttattatattcaatgatgtatcctctctttgtttacaatgaaactttctcttttctgactaatatatcactgccctacctttgcacctcctacagtgctccctgtgtaattcttcctcctttattttcatgtttcctgcttataatgtacctcttagctatcttatctgaaaagttcttttcgtgtcaggctgtgagggctgtgaagagacagaagaatttatgtgcccgttattgcctgctatagtcatagtttctgtgtatatcatctgggtgagataccgattgctgtgttgtcactaaatggagtattgtgattgtcttgaccaatgttccattcctgtgaagagacaccatgaccatggcaactcttataaataaaggcatttaattggggctggtttacagtttcagagggctaatctgttatctatcatggtaggaaacatggcagtgtgtagacagccatggtgctggagaaggagctgagagttctatatcttgatcctcaggcagttgggaaagagacactgggtctggcttgagcatctgagacattaaagcccaaccctagtgacacagtttctccaacaaggccacacctcctaatttgtcttaagtagtgctgttccctaaagaccaagcattagaatatttgagcccatggaggccattcctatttaaactactatagtcactaattgtaggtttctctttattcagtttgagattgctgagtcacgtcactttgaagccagtgagacatttttcatctctgcaaatacaagttttagtttggggctaagcaactgagaggcccgtggaaagaagaaacagatacaataatggatgagactctactcttggtgctaacatgtggtactccctctcaacacttcccatttgtattttgttaaccttattttgagtatctttaataaatgtgattgataactctaattttcattgtagtatatgtccttagctggtgttttatttctttaccttttatggttaatatgttttttgttcctttctcttagatgctgtcagtgttatactgaggaagatgctagtagatagggtttgactatgaggtttcttgatggcatttaggctctgatgtgtggccatagtttacttccctggcaactgcaatgaatgtgtgattctctcctgaaagagatgccaggtgggccttagcctggacacagtactgagagtactacctggtgatgctggttctctgtaatggctgtctagccactttgccttaacaggtcctgtaatgtgactgtgggtgtcatatttaagatggatatatcactaattaatctaatccttaattagttgtgaaacagctttcacttcttttgtgagaactgagttcactcagatggtatcaaggaaatcccagtgccttatatgcgcaaagtgatcagcagagcctgctttgctgaaaagctaagcttttgtcctctagttggcaaggagccaccagagcctttaagctaggcagtgatgtttctttcagaattacaatcattatggtggttttaaggtagattgttaagtagtgtgtgatggattcaggaaggtgcggaggctgtgaagaacagctgccagtatgcagaaccttgatgcctgtgggtgtaatgagttaaaggtgactcagggagctgactgtggcacagacagggaatggggagaggaaataatgctgaaatgaaggagtgcgaggtacctctggcacctattgagtttggggtatcagagaacttatgagcaggaaattggacagagattccagaacatggcatggggcaggggaatctgtgctcaccttatgtctgctagaatataatattattaaagacttattctggttagatgacttttattgtggcaggtttcaaattcatgaaagtaaaggaaataatataataaaccaaagtcatgagttcattaccctgcttcatttaattgcaggtttgtagttcatcttatttcatttatgccttcaaactggtttaccctatttcagtatgattttgatccagtcctacacattctatcattttatttataaatatgtccataagataaggtgtcttttaataatgtggacataatacattaggaactatcaaattccacaataattctgtaatatttgtcaaatatacagtgagttcatatttctccaattcacttttattgcttagtttgatttaagatccaagtaaggcccttcaaatagtatttggatggtatatgttgttttctcataaattcttatgaggtttgaatgggtaacttttcagaatattctaggacctgttgtgtgaaccctgaaccatagccatcaaacaaatgaaagaaaaccatggaacaatgtagggcaatgggggaattttcagaagatgaatcattttgacatccccaccacacatcatagttagttttagttgtcaacttgattcagtgagaatctcaatgagggctgtctatatccagttggtttgaattgatatgaaattttcagtgaaaaatctgatagcactgtttaatgggggtagaccgtgaagtatatgagtgcaaagtgtaattcgaacattagcaggcctgcatacattcattactctctactcttgactttgtgattagctactttaggttcctgtcttgacttctcggtgatggacctggaagtgtaagctgaataaatcctttctcccctaagttgctcttggtcaggtttttttttcttttttaaaaattccagcaacagaagtgaaactaggacaccggacccctgatattttggggaaagctgctagaactcttgtacccataacctgtttctcctgcaatttcagtattttcattttcagtatttttcttatggaactttctagaagtcatacttggttgtatgtgaccctttcttggcccagaagtctttgaggtaaacattaatcttgtgagcctggttccaagggatggaagccagtttccacatgacacttgggggcccctttctccccaacagtagccaactcaggctcatctgatgttcatttgccaaccacatactgaatgagggttttctctgaagtctactttctagcttctttccttctccttatagtttcacttctcttgtaaggcccagtttagaagtcaccgtttctctgaagttttctacgatgaatctgttcacatgaaagaaatatttattctatactctgctgtgtcaatttttttgtgctttttttttgtcatgtctgactcactttgattggctttatttataatgtgtacacaagtgggacagatgaatgtatgtctctgtgcatctgtagtaggacgttggagaacaggctgtatgtcagccagcttcagaacttcctgtgagtatccagcccagaacccttcccatctggcctgcaggggccagcacttgggaactactattttttttattagatattttctttatttacatttcaaatgctatcacgatagttccctatactccccacccctgccctgctcccctacccacccactcccacttcttggccctggcgttcccctgtactggggtatatgatgtttgaaataccaaggggcctctcttcccagtaatggcctactaggccatcttctgctacataggcagctagagacacgagctctaggggatactgattagttcatattgttgttccacctatagggttgcagaccccttcagctccttgggtgctttctctaccttctccattgggggccgtgtgttccatcctatagatgactgtgagcatccacttctgtatttgccaggcactggcatagcctcatacgagacagctatatcagggtcccttcagcaaaatcttgctgacatatgtaatagtgtctgggtttggtggctgattatgggatgaatccccaggtggggtagtctctgtatagtcaatcctttcgtctatggtccaaactttgtaacaccttccatgggtattttgttccctattctaaggaggaatgaagtgtccacacgttggtcttccttcttgattttcttgtattttgcaaattgtattttgggtattctaaatttctgggctaatatccacttatcagtgagtgcatagctaatgacttcttttgtgattgggttaacccactaaggatgatatcctccagatacatccatttgcccaagaatttcataaattcattgttttaaatagctgactagtactccattgtgtaaatgtaccacattttctgtctccattcctctgttgagggacatctgggttctttccagcttctggctattataaatacggctgctatgaacatagtggagcatgtgttctatttaccagttggaacatattctgggtatatgcccaggagaggtattgctggatcttcgtgtagtactatgtccaattttctaaggaaccaccagactgactttcagagtggttgtacaagcttgcaatcccaccagcaatggaggagtgttcctctttctccacatcctcgccagcatctgctgtcacctgaatttttgatcttagccattctgactggtgtgaggtggaatcacaaggttgttttgatttgcatttccctgatgattaaggatgttgaacattttttcaggtgcttctcagccattcggtattcctcagttaagaattctttgtttagttctgtactccattttttaatggggttatttgaatttctggagtccagcttcttgagctctttgtatatattggatattagtcccctatcagatttaggattggtaaaaatcctttcccaatctgttggtggcatttttgtcttattgacagtgtcttttaccttacagaagctttgaaattttatgaggtcccatttgtcaattcttgatcttacagcacaagccattactgttctcttcaggaattttttcctgtgcccatatcattgaggcttttccccactttctcctctataaatttcagtgtctctggttttatatggagttctttgatccacttagacttgagttttgtacaaggagataagaatggataaattcacattcgtctacatgataatggccagttgtgctagcaccatttgttgaaaatgctgtctttttttccacaggatggttttagctcccttgtcaaagatcaagtgaccatagttgtgtggattcatttctgggtcttcaattctattccattgatctacctgtctgttgctgtacaagtaccatacagtttttatcacagttgctctgtagtacagtttgaggtcaggcatggtgattccaccagaggttattttattgttgagaatagtttttgctaacttaggttttttattattccagatgaatttgcaaattgccctttgtaactcagtgaagaattgagttggaattttgatggggattgcattgaatctgtagattgctttcggcaggatagccatttttacaatgttgatcctgccaatccatgagcatgggagatctttccatcttctgagatcttcttcaatttctttctccagagagttgaagttcttatcatacagatctttcacttccttagttagagtcacaccaaggtattttatattatttgtgactattgtgaagggtgttgtttccctaatttctttctcagcctgtttatcctttgtgtagagaaaggccaattatttgtttgagttaattttatatccagctactgcactgaagctgtttatcaggtttaggaattctctggtggaatttttagggtcacatatatactatcatatcatctgcaaaaagtgatattttaacttcttcctttccaatttgtatccccttgacctccttttgttttctaattgctctggctaggacttcaagtactatattgaataggtagggagaaagtgggcagcgttgtctagtccctgattttagtgggattgcttcaagtttctctctgttaagtttgatgttgggtactggtttgctgtatattgcttttattatgtttacgaatgagccttgagttcctgatctttccatgacttttattatgaaggggtgttggattttgcaaatgctttctctgcatctaacgagatgattatgtggtttttgtctttgagtttgtttagatagtggattatgttgatcgatttctgtatattgaaccatccctgcatccctgggatgaagcctagttggtcatgatggatgatggttttgatgtgttcttggattcggtttgccaagattttattgagtatttttgatagatattcataatggaaattggtctgaagttctcttactttgttggatccttgtgtggtttaggtatcagagtaattgtggcttcatagaatgaattgggaggagtactttctgtttccattttgtggaatagtttgaggagagctggaattaggtcttcattgaaggtctgatagaactctgcactaaacccttctggtcctgggctttttttttttctttttctttttgagactattgatgactgcttcttatctacttgtacaaagctcaagtctaagtggatcaaagaactccacataaaaccagagacactgaaacttatagaggagaaggtggggaaaagcctcgaagatatgggcacaggggaaaaaattcctaaacagaacaccagtggcttgtgctgtgagattgagaattgacaaatggatctcataaaattgcaaagcttctgtaaggcaaaagacactgttaataagacaaaaaggccaccaacagattgggaaagaatttttaccaatcctaaatcagataggggactaatatccaatatatataaagaactcaagaagctggactccagaaaatcaaataaccctattaaaaaatgaggtacagagctaaacaaagaattctcaactgaggaataccaaatgtttgagaagcacctgaaaaaatgttcaacatccttatcaattaattgctaggtgggctgtatggccagtgagctccaaggatacacctgtctctgcttctcttcttccatgcctcagcgatgatattacagataagtgttactgcatctggcttttatatgagtgctggggggggcatctaaaatcagcttctcatgcttgcatagcaagcactttgcagactgagccatcttcctattccttcttattataggaaaactggtaaagtattttattttccatttgtttatgaagctagagtgctgcatgctgatgtgttgttatatggctgtatcattttattattgacttttatgtattttgctaaattcctgggacagtcttctagaataaagatcagtttttataaagaattatacctattctccaaattgtcatatggccaaatctctttagaatggtaaattcttatagaaatgtttattatactgacacccatgaaggtgctgagggcaggcaaataaattgtagcacctggcccctccattgaacagggtgatgtcaataagagagaactccataggtgcttttctatgagtagctttcctactctgttccagcccatatatcaactccccttccaaattccatgattctctaatatgcagtattttgatggcagtttagctaatgtaaggatagttattcatccaaaagacttggagaaaagcagcacctgggcagcagttggtagtttgtaaaggattttggcacagtgtacttgttcttccagcagccagatcttacaaaagaacagtggaggcaccttgctttgcatggcagctgaggggaacatgacagaacatagccaagcttactatggagcccaccaaaatcatctttcagctccctggtagagcaagttattagggtgggtgattgagccacaacaacatgggacgaaactgttacaaataataatttaaaatctatgaaaatagacaaatagtcaaataacaaattggaggacatttattgaggaaatctgctgagccttaccaagtataatggtggtctgtgacttttagggtagggatgacatctctccccacatatatgtaaccaaatgatgtacactgggtaggtggaggagactgtagtgactctcagttaccactcttccctgtgtcagtgacaagcacagtgtataagtagcagaactgtaattgtggtctttccacccacacataagctcgctgaaataacgactctgacacttaattatattaatgaataaatacttaggccataagcttgggcctgttccccaactgactcataacttaattatcctgtttattctattctaaagtctgccatgtagttgaccacctggtcctcagtattatgggactgaccatcttcctctgtgtccaggtgaatctctccatgcctgactcaaccccagaattcccctctctctgctagaactcccatttccatttcttgcttcagcacattggccaaaggcttttttattagcaggtgattgcttttacacagtgcacaagaaattatttctacacagaacaagtagaagaaagcattggaaagagtcccaacaatcctgcatcaaaatcaaaatctgtcaaaacccccctagccccgaaaagtgatggttacagttggaatccattgggttctattttgttgaatttaacatgtaggttaaacactcctaatctgaaaatctgaaatccaggatctttttagtgccccaaaatgagaagccaaaaaacaagaaaaacaaaaacaaacaaacaaaaaacaacaaaaacaacaacaacaacaaaaaaaccccaaaaccccccaaaccaaaaaactgtatttaggaacatagtacattttggattccagattagggaatgcttaatttgtaaagtctatgcaaaaatccccaatttaataactctgaaatcagaaacaactctagtttcaagtatttcaggtaagacacacaacttagagttacttctacatctctaacccgtgtgtgtgtgtgtgtgtgtgtgtgtgtgtgtgtgtgtgtgtgtgtgagagagagagagagagagagagagagagagagagagagaacacacatgtatgctactgtagatgggtgtgcttgctgcatatatggatgccagaggacaaccttaggtgtgggtctttgctttccatcttgtctgtggcagtatcccttgtttgctcctggacatgccagattagctggtccaatagcttcttggaatttttccatctcactgtaagaacactggatatcactattttcaaatcttttgtgacttgatgcttcctttcctttcctttcctttcctttcctttcctttcctttcctttcctttcctttcctttcttttttccccttgtggtaatgtttattttattttattattttattttattttattagatattttctttatttacatttcaaatgctatcccgaaagttccctatatcctcccccacccaccctgcttccctacccacccactcccacttcttggccctggtgttcccctatactggggcatataaagtttgcaagaccaaggggcctctcttcccaatgatggccaaccaggctatcttctgctacaaatgcagctagagacacaagctctggaggtactggttagttcatattgttgttccacctatagggttgcagacccctttagctccttgggtactttctctagctccttcattgggggccgtgtgttccatcctatagatgactgtgagcatccacttctgtatttgccaggcattggcatagcctcactggagacagctatatcagggtcccttcagcaaaatcttgctggcttatgcaatagtgttgggtttggtggctgaatgaaggaaaacactgccatcaggaatgtctgtagcccaagtcaaagtgcacactcaaggatcaagccagatttcctccctaagcaagctcatttcctatgaagaagcaagggaggaaaaagcctgaaggaacattgccaaggatattgagaggaagggaaagtatccctttggatacaagaagtacacaagagtaccttctgtttccattttgtggaatagtttgaggagagttggaattaggtcttctttgaaggtctgatagaactttgcactaaacgcagctggtcctgggctttttttttcttttcttttttttttggttgggagactattgatgactgcttctatttctttagggcaaatggaactgtttagatagttaatctgatcctgatttaactttggtacctggtatctctctaggaagttgttcatttcatccaggttttctagttttgttgagtatagccttttgaagtagaatctgatgatgttttggatttcctcaggttctgttgttatgtctctattttcatttctgattttgttaattaggatactgtccctgtgccctctagttagtctggctaaggatttatctatcttgctgattttctcaaaagaaccagctcctggtttggttgattctttgaatagttcttttcgtttccacttggttgatttcatccctgagtttgattatttcctgctgtctactcctcttgggtgaatttgcttcctttagttctagagcttctaggtgtgctgtcaggcggctagtgtatgctctctctagtttctttttggaggcattcagggctatgagttttcctcttaggactgccttcattgtgtcccataatttggggtatgttgtggcttcattttcattaaactctaaaaagtctttaatttctttctttatttcatccttgaccaaggaatcattgagtagagtgttgttcagtttccacgtgaatgctggctttctattatttatgttgttattgaagatcagccttagtctgtggtgatcagataggatgcatgggataatttcaatatttttgtatctgttgaggcctgttttgtgaccaatgatatggtcaattttggtgaagttatcatgtgggtctgtgaagaaggtatatcctttttagtttaaaatattctgtagatacatattaaatccatttgtttcataacttctgttagtgtccatgtgtcttgattaagtttctgttttcaggatctgtccattggtgagagtggggtgttgaagtctcccactattattttgtgaggtgcaatgtgtgctttgagtgttgctaaagtttctttaatgaatgtggctgcccttgtatttggagcatagatattcagaattgagagttcatcttggtagattttacctttgatgagaatgaagtgcccttccttgtcttttttgataactttgggttggaagtcaattttattctatattagaatggctactccagcttgttttttgggaccatttgcttggaaaattgttttccagcctttcattctgaggtagtgtctgtctttttctctgaggtgggtttcctgtaagcagcaaaatgttgggtcctgtttgtgtagccagtctattagtctatgtctttttattggggaattgagtccattaacgttaagagaaattaaagacaaataattgttgctttctattatttttgttgttagagttggcattctgttcttgtggctgtcttctttttggtttgttgaaggattactttcttgctttttctagggcatggtttctgtccttgtatttttttttctgttatcctttgaagggctggatttgtggaaagataatgtgtaaaattgtttttgtcatggaatactttggtttctccatctatggtaattgagagtttggctgggtatagtatcctgggctggcgtttttgttctcttagtgtctgtataacatctgtccaggatcttctggctttcatagtctctaatgaaaaatctggtgtaattctgataggcctgcctttatatgttacttgacctttttcccttactgcttttaaaattatatctttatttaatgcatttgttgttctgattattatgtgtcgggaggaattcttttctggtccagtctatttagagttctgtaggcttcttgtatgttcatgtgcatgtctttctttacgtttggaaagttttcttctataattttgttaaagatatttgctggccctttaagttgaaaattttcattctcatctactcctattatctgtaggtttggtcttctcattgtgtcctggatttcccggatgtcttgagttagcatctgtttgcattttctttgattgttgtgcccatgttctctatggaaccttctgcacctgagattctctcttccatctcttgtattctgttgctgatgctcgcatctatggttcctaatttctttcctagggtttccatttccagagttgtctcactctgaattttctttattgtttctacttccctttttagatcttggatggttttgttcaatttcatcacctgtttggttgtgttttgctgtaattctttaaggacttctacttctttagcagtgttctcctgtatttccttaagtgagttattaatgcccttcttaaagtcctttaccaacatcatgagatgtgattttaaatctgagtcttgcttttcggatgtgttggggtatctaggactggctgaggtggtagggctgggttctgatgatggtgagtggtcttggtttctgttagtaagcttcttacctttgccttttgccatctggtaatctctggagttagttgttatagttgtgtctggttggagcttgttcctcctgtgatcctgttagcctctgtcagcattcctaggagaccagctctctcccgagtctcagtggtcagaatactctctgcagtcaagctctcctcttgcagggaaggtgcacagaggtctggcgttcagacctgcctcctggctgaagatgaaggcccaaaacagggcctgtttcagaagatatgttgcctctgcagtctgcatgctcacctacacagactggtctctgagggacccgggacacaagatggctccctcacctgctccggcagtcagagccctcccgggaagacatctcacttctggtggggaatgtgcccggaagtctggagctcaaaacggggtctgtcccagaagctgcgttgcttctgcagtacgcactctcacctgtgaagactgatctctgagcgatccgggacccaagatagctccctcacctgctcaggaagtcagagtcctcctgggtagacacctctcctctggtgtggaaggtgcccagatgtctggagtctgaaacggggtatgtcccagaagctgtgtcgcttctgcagtccgcgagctgacctgcacagattggcctccaagggacccaggacactgatgctttcttttcttttatttcaaatgaagctttagaactcagaagaatccttatgatacaactgtatggtagtggctaaaccaaactgataacccttcaccctcagtagcatgcataaggaaatggaaggtcagactagagaacagtacattccagcaactgttcctctcctgattttaatggtcttattaattttgtcatttttataatgtggctggtggatggctgtctagaattatacctctctccgtgtccattgttcatctattctctcaacagctttagccacaaagagaaactagtttcatattcatgggggtcggtatcctcatgaccctctggaattgcaatcacatttggctcatattcctttcttattctactaatgaacacagatataagatattcatacacacatgtctgtctatacatgttcatagtcctttggttctattttagagttggaagagctggcagttgtacacctttagtacagtatgctgagacagttgggaagtaagttttcttcatacccacaagatagaggcttagatttttgtccttttgctttcagccacacaaaatgtcaaagtaattccatccatatttgctttctgtaaaagttataattagattatttcctgatgttagtcatatgcctgtgaaatcagtgaccctctgttcctcagctgctgtctgttatgctgtttttctacagacataggcttgtttttctctgtcatctgcagcactgttctgtagagcaggtcagatcagtgcctatgtgtctccctgcaatttttttatgagtactgaacttcttgagctttaaacaaaatgtcctacatatttttaagtctttgcagttatgatcttttcacagtttcctatcagaggatatattcagatccagaaaataaactatgttgttaataatgttgtctccagttttttagaattcattttctcaaacacaaaacagtagcaacaacaacattacccctctgcagtcctgatatcctgctctttcttcaatcagaaaatgtgcattgtaaacttagtattgaaagactccaagagaagacccttgctcaggccttgggacagtagaggacacccaagtactcatgagagaccaagcttgatgtaaaccacatgaggctttatttggggaaagccagagctctggggacgactcatattccacgcaggggtagaggagtcgaaggggaaagaggtcccagtttttataggccctcagggggcaaaggagaaggcgggagtaggggatttccagatctaaacaatgtctattctcaagaaatgggtatgggaggggtacaaggaaagagtctggtgcaggtgtagcaactcaggattggcctggctgtggttgctggggagattttctgactctttctcagcaaccaatatcacaaacacctggcagtggacttcagcagtgggcacacatatgggttcaaggaatggtcaaaatattggcagacacacgggttcaaggagtgaccagagcattgtgcacctcaatttttctaaatcagtgaagctagttctgctaacagtgacatctatcttgccaatttctgggcttctgtgaccttttacattctgtcaggatctttcagtatcacagcatggggagtgatgatggtaaatagaaatctacattgtttggagagttatgcagagaagagcagtatactatggacttggctaggtcagattctcaggatggggttaaccatttacttttgctgtgatagcttgtattgctatgtttaaccacagcatcattcctctcactgtttccctttgttaacatgagtgcaattggacccagagcaaaaaaggaaaagtttgctaaatttaaacacaattcaatattctgcatctgctaatgaatctagacatttcctggaattgaagaatttgtatacaaatgtatgcctccctgttttaaaggtttatttttacttttgtatgtgtgcacttgtgcgtgcaacatgtgtataagtacttgtggaggccagaagagaccattggagctgaagttacaggcagttgtgggctgtgtgacaacaatgtaggttttgggaatagattttggttcctctggaacaggctcttaccactcagccatccctccagcctctaaacctcatcttttgccagtattcattgtgaggacctatgagtatgctttactttcttatctgacgaggatgtaaataaagttaagaaacagtgaggaccacaccaacgtgtggatatttcattcctccttagaataagaaacaaaatacccatggaaggagttacagagacaaagtttggagctaagacgaaaggatggaccatccagagactaccccatccagggatccatcccataatcagccaccaaacccacacactattgcatatgccagaaagattttgctgaaaggaccctgatatagctgtctcttgtgaggctatgccagtgcctggcaaatacagaagaggatgctcatagtcatctataaggtggaacacagggcccccaatggaggagctagagaaagtacccaaggagctgaaggggtctgcaaccctataggtggaacaacaatatgaactaaccagtacccccagagctcgtgtctctagctgcatatgtattagaagatggcctagtcggccatcattgggaagagaggccccttggtcttgcaaacttaatatgccccagtacagggccaagggccaagaagtgggggtgggtaggtaggggagcagggtgagtgggggggggagggtatagggaactttcaggatagcatttgaaatgtaaataaataaaatgtcaaattaaaaaaagtaaaagaaaaaaacagtgaggaatgtaaagcaacttgtaaacagtttctgtaaatactgtttaatataaaatctttgataggtcaccttcaggtagtacaggccattgtgtatcatgacaaatgctgaagatctgtggaaccgcttcgtcaagtaactcttcatcagtacataattgcctaaccaaggactgaaataaggccaaataaaggacattataaaaatctggggagaaaagccttgagaggatcaagcagtctctacccccctgcccccagtgcttccagcagctttggaaggaagtcctgttaccacagctgatcctagttattgtcaacctcctctcaaatgcgagcaacaaagctgagacactcagcatagcaccataggcacaaaaatattgctgtgatgaaagtttagaagcaatatgatggttcaatataagaagtatagtggtctgaggaggtggctcagtgggcaaagcaagtgtgaggatctatctgagttcaaatccccattggtgcatctataactccagtgcttctggagatgagaggtggagagaaaaaaattacccagatgtatacaggccagctagcctgacaaatgcagcaataaaaagacaggtgccatctcaatgtagaaggcaaagactcaaactttttttctgatttgcatatatgcccttgcatattctctcattctctctgtctctctccattcctcttccccctctctcaaatacacacacacacacacacacacacacactgtctctctgtctcggtgtctctcttagacacatacatacatacatacatacataactatgtatatggtttcacccataagatacctatagatgtaacttgtttactagattgccacagagaataataacccccaagtaacatccttgcaacaaagaggatagaacatttatagttttgtgttgttaaaggagagaagggtgcacaggaagcaaagatgcaggctcttggtggagttctactgctggatgtaaatgctcagcacactgtaaatcatgagaggtcataggactttccacacagtcaccaggagaatgagcagaataatgtaaatggggagaaagaaatgtgacttttctttactttagatagggctttgatagcagagcaaagatacaattctactggcatacacacacacacacacacacacacacacacacacacatatatatatatatatatatatatatatatatatatatatatatatatacacacacacacacacacatccatcctatggggcagcttccacaaaggtatgtttataggcctaatcttgtgtgagtaatcacaactgttttgattccataccacacctggagagcagagttccatagcagagggtttgttcactgccctgaaactttagggccaattgtatacatgatatacttccttcatgctccatgcagaggacatttatcagagttctcataacctcctatgaatgaaaactgatagagaccaataatatattaggccttgctagagcagccatgaagatgatcaggaaaataaaaagaaatatgaccagcagccaccctgctgtgggtagctcacaaaattactaaccagcacagacatccagagagcaagactaagatagccatgccattgccagtggagaagcatgttctcgagctgggcagagcagggctgagcaaattctgcctggccatctccaccatcatctgatttgttaccacatgggaataaaataaatggaaatttagcgataagacctggtagacactgaagaagtgtttgtgttttgcctgttcactaggtaattggaaacatctgcattatgggcttctttgttttgttttgtttgttttttaggcatatcattttggtaatggtaaacatgctttgtaaaatgaagtctgacttttcttatacctttaaggttgtttcataattggtcaggatgagattattaagaacatcattttaaatttgtagctcaagaaacagcccctgaatcatgactgcttaagcttacactacaacctctagccacccagcaggtataattactttctccatgatcctcagtgcttggaatgacttactcaaagacgttttccctccttccactctggtgtgtgtgtgtgtgtgtgtgtgtgtgtgtgtgtgtgtgtggcaaagcatgtttgttacatttgtatcaattaaacattcttctggcctggtcctccagagcagaggacagtaggaaatggtttgaaagatactatggggaaaaacaaaggttggctcagcggcccttcctcaatctgttctgggcagaaaacattacactcttctccctccctcatctgtctctactaaaagcctcagaaatgagagatgaaagagaagtgtggctgagtctgtttatttggccatattaaccactgttctatttaatccttctagtggctaagggactcagatcagcagtgtgttgcttccatactttctgttctgccacatgactgacttttaaaaaagtttagtgattaatttgttaatgtttaaaactctaggataggcaatctagaaatctgctcagaggatggagaagaggaagagagaaacccgtgcccttttgagttaggcatggaagttgggcacaaagccatatagcaaaagggaggtagtttcagacaaagtgaaaaagcataccagagaaagcatacttaggctctggccagtttctgaaagagacaaaaaggaaaatcggaaatggattttctgagtatttcagaaaagtaggcaggcttaatccagctgcaaggctgcacctccataaatgagtacacagtaaaccaggactaattttatttttatgtgtgtcaccctacttcagggctcattgttggagtgatcctgagatatggcacccctgctaccagcggtcatgacaagtcactcagctgtactcaggaagacagagcctttagcactttattagtgaatgtcagtgggaagttctttgaatacactctgaaaggagaaatcagccctggcaagatcaacaacgtggagcagaatgacatgctgcggaaggtgagctgataccatggctttctgggacaaggttgttgatcccctggcttcatcttgaccttaaggagagaaattctcccaaactactggaatatctgtcacatttctgacttacaaatttgtagggtgctttggggtcagaattagaaggaagagccagattttaactttgttgcttcagctaccagctttactggctagggcctatcgcctgcatgggctactgatgctgtgacatgttggtgttatccctacttgccttgttttatttatttatttatttatttatttatttatttattttattatatgtaagtacactgtagctgtcttcagacattccagaagagggagtcagatctcattacagatggttgtgagccaccatgtggttgctgggatttgaactctggaccttcggaagagtagtcgggtgttcttacccactgagccatctcaccagcccgccttgttttttcaatggcatcacttctttactctcattgctgtgaaatgagcttagaaatgaacttacttgcttgcttccttccttcctttatatctttatttcggtttttcaagacagggtttctctgtgtagccctggctatcctggaaccagctctgtagaccaggctggcctcaaactcacagagatccatccacctgcctctgcctcccaagcgttgggatgaaaggcgtgcaccatcaccacaagacacttatctctcaaataatattagtttcctttttagcttagtcaatattctgaaatgcaattcctagttctccatagctttcttgacatagtctacaaacatgagtgcttacaaatactaatgattgatgctaaagtcttacctgatattcaaacgcaggagggcttgttttagaatttaagtctagggattatttctcaattttaaaaatttcatttccttttcttttaagatagtgtcttaaaacatagttcaggctaatttcaaattcattgtcattccatctcagcctcagagtgctagagtccaccactatgcatggttcaagcatggtttttcctttgactatggagtagcaaaaatgtttcaggaaaaaaaaaaaggttgcacaacacccagagaaagatccactcccaggcactctaacactcccaggatcataagatcagaagtgaggaggacttttgaatatattccttaatgactcatttttaatattttattcttttttactatgcttaattcccaaagatgctcacagtcagctattggatggatcacagggctcccaatggaggagctagagaaagtacccaaggagctaaagggatctgcaaccctataggtggaaaaacattatgaactaaccagtacccgggagctcttgtctctagctgcatatgtatcaaaagatggcctagtcggccatcactggaaagagaggcccattggacatgcaaactgtatatgccccagtacaggggaacgccagggccaaaaaaaaaaaaatgggaatgagtgggtagggaagtgggggggagggtatgggggacttttgggatagcattggaaatgtaattgaggaaaatatgtaataataaaaaaaagactgtaaaaaaaaagaatattttgtatattttgaaataatttagtattcaatattagatataggatcctcagttatggatagtattaaatattcattaatgatatttttaggatatgaaaggatatgaatataaaagttgaacaaattacttatgtattatttgatcctcaaaatactcaatattattaatatatctgatatatgaaatgtatttaaataaaaaaattaaggaaaaaaagattatgtgtctctcatgtggatgatttctgagatagacaagaaatcaatgttaaagatgtattcacatgggtaaattaattgattttatttcacttaatcgttttaaatatttagcctactcctacctctacccccaagttttgcctttttataaatgcttagttcctttgggctgtactgttattggctgtgtagaagtgtcactgtgagcttctttttatcaaaaacaaccaacttcagttgatgagcaagaagtggctgacctcactgataactttgtcttggccatgtgaagtatttccaaagggtgttccctcaaaggagacttaaatgttatagaattaggtctacaaaagggaagttaataaaaacccataacatttttattgcaattaagccttcatgaatgtgtaatgaaaatcaagatgtttttattttctgttgaaaaacattggcagcagctgcttgtgagttcctcaaatttccccaaacggttgtgacttaatatgtattaaaatagaatactggaatcttaagtgctgggggcagccatgggcaagaacatgccagtcaataggtaaattgtgacttatctgctgtaatgatttcacacattggcagctttggtctaaataaggcactttagtcaatggcttcccatattaaataaatattatccaatcagttgagctttatctcaaatttgacttttaactttttaaacttacaggtaacatttgatccagaggtatttttcaacattctgctgcctccaattattttccatgctggatacagcttaaagaaggtatgagggtttttgttagtgatttcttaagaattttctcctttgttccccaacgtaatatttttattatttggaaatttcacataatgtacccgatcacttgaactgtgacactatgagtcctcccaccaaccctcctttcccatgcgacctactcccagaaaaagaagggaagaaaaaggaaaaactacaaagtccaatttgtgttgcccatatactcaccggagcatggtcaaactcacagtggttcgccccttaaagaaaactgcaccaggggtctctccaaacctgcacccttgccagaagccatcaactgtgaagagctatacttcagcatcattatcataattttaaagagttcttttcaatggtttcctgtctaggctgtttttttggggggtgtttttggggaaacagaagtctcagtgtcgacctggataatttctatttttccccttaaactctcagatttatgtgttgtgtacccaatcagagtctataggtctcatcttcagtaaattgtttgctttaaaatataagagctctcccaaactgccagcaagaatgtaacatgctgcagccactttggaaaacaacataatagctttttgtaacagtgaagtcgaaggtgtcttttttaggcattttttattatatatttccttcatttacatttcaaatgctatcccaaaactccctataccctcccccaccctcttaaggcataacagcttcactgctgaggatttctagacaaggacatgaactttgttcacacaaaaacctatgctgcctcattactatctgatttgtaagacaaaacactaaagtaaacagaaggccttcctgccagtagtggttaaacaaaccatactatacccataccatagaaaaagaggcctgctaacacacccagatcataggatcagaggtgaggaggacacaacatctgccctgccactggaagtaactggggccagctggacccaggcacccaggaattctgcctgaccagtggcacgggttccttctggtctgggctagtgccctgagcagtccatgggcatgaactctgcagccagtcccacaacatccagaagaagctccaatcccaggtgctctaaaatacccagaataacaggaacataggatcccagggtctcagggtcccagaggcaactggactcccaggagctctgacacacccaggatctcaggatcccaggatcccagaatcacaggatcacagagacagctgaactctgaggagttctgatacaaccaggatcacagaaaggacaggctccagtcagatatagcaagggcaggtagcactagagataatcagatggtgggaggcaaatggaagaacataagcaacagaaaccaaggttacttggcatcatcagaacccagttctcccaccatagcaagtcttggctacaccatcacaccggaaaagcaagatttggatctaaaaattacttctcatgatggttatagaggactttaagaaggacataaataattccctgaaagaaaatacaggagaacacaggtaaacagctagaagctcttaaggaggaaacacaaaaactccttaaagaactacaggaaaacacaatcaaacaggtgaaggaaatgaacaaaactatccaagatctgaaaatgaaaataaacattaaagaaatcacaaagggagacaaccctggagttagaaaacctaggaaagagaacaggagtcacagatgcaagcatcaccaacagaatacaagagatagaagagagaatctcaggggcagaagataccatagaaaacactgacacagcagtcaaagaaaatgcaaaaagcaaaaggctcctagcccaaaacttccaggaaatccagtacacaatgagaagatgaaattcataggtatagaagagagcaaagactctcaacttaaagggctagtaaatatcttcaataaatttatacaagaaaacttctctaacctaaagaaagagatgccaatgaacatacaagaagcctgcagaactccaaatagactggaccagaaaagaaattccccctgacacataataatcagaacaacaaatgcacaaatcaaagagagaatattaatatcagtaagggaagaaggtcaagtaacatataaaggcaggcctatcagaattataccagacttctcactagagactatgaaagctagaagatcctgtgaagatgtaatacagaacttaagagaacacaaatgccagcctaggctactatactcagcaaatgtctcagttaccatagatggagaaaccaaagtattccatgacaaaacaaaatttacacaatatctttccatgaatccagcccttcaaaggataatagatggaaaacaccaatacaaggagggaaactacaccctagaaaaagcaagaaagtaatctttcaacaaacctaaaagaagagagccatgtgaacataattccacctctaacaacaaaaataacaggaagtaacaatcacttttctttaatatctcttactatcaatggactcaattctccaataaaaagacatagactaacagactgactacacaaacaggactcaacattttgttgcattcaggaaacccatctaagagtcaaagacagacactacctcagagtaaaaggttggaaaacaattttcccagcaaatggtcccaagaaacaagctggagtagccattctaatattaataaaatcaactttctaccaaaattatccaaaaaaatatacggaaggacactttatactcatcaaagaaaacaatctaccaagatgaactctcaattttgaatatctatgctccaagtgtaagggcacccacattcataaaagaaactttactaaagctcaaagctttagtaaaatcacaccccacataataataatgggagacttcaacaccccactctcagcaatggacagatcatggaaacataaactaaacagagacacagtgaaactaacagaagttataaaccaaatggatctaacagatatttgtagaacatttcatcctaaagcaaaagaatatacataccttctactcagcacctcatggtaccttctccaaaactgaccatataattggtcacaaaacaggcctcaacagatacgaaaatattgaaatcatcccatacatcctatcagatcaccatggactaaggctgatcttcaatagcaacaaaaacaatggaaagcacacatacacatggaaactgaacaacattctactcaatgatgacttggccaaggaagaaaaaaagaaagaagttaaaggctttttagaatttaatgaaaacgaagatacatcataccaaaacttatgggataatgaaagcagttgtaagagaaaaactcacagctctgagtgcctccgaaaagaaactagagagagcttacactagcagcttgacagcacacctgaaagctctagaataaaaagaagcaaatacacccaagaggagtagacagtagtgttgctttaaatatccaacctaaataagcctggataatgaaaacagaactcaattaatatgaatacatgctatgtgcctagactgggcagatctaccactacactaccatcttccccatagaagagaccccttataaattgcagtttctccaggccaggtgcttctgctccattttcctccttcctcctcctcttctgtggacctctctctgtctccccaaaccttcagctccaccttcctctttgtctcctctcaattactggctctattgttttactataaactaaggtgggaagaaagcttacagaaaaatcacctgagtgctgactcattccttgttctcagcccctcacagaagaacagaattatcatcaaatacaattagccgcagggctatccgcaacactttcccttttctctccaattaaaagagtagtttatctcagatataattgaacacaactattactattttgtaatttatgtagtacaagagacctaacaccctttctatcatctttcttaattaaataaaacctctgtcatctatccttacttaaaagactatagttctgcccctggctatggcttggctttagaatgactatcatctgaaaaccatcctctcaaatctgttcctctcaaagtaaaaagccagggttggctaggatactgtgtagtttttcaactccatcagaaatccaagaacgactgatattaactgaaaatatataggaagcctaacacagcttccaaaactagccaatttatacagactgctgatcacttggatagtcccttacttacacgttggatcattggtcttcagcctactggccagagtgatctcacagacttagagaaacaggaatattaaggactagcctactctgtcttggcagaatcaagctgtcctaacctgtaattgtgtcctttctttggacattattatgtctgtagatgaaatgaggcaattcttgcctagtggctgttttcccacaactggagcaactcagagatgctcagtttcttctttgaatccaagacagggaaagctgtcaggagcagactggtctcaacaacaagtgaataaataacattaaagtcacgttctgtggacttccgatgcttttgaaaaccaactatctatgtgaagtaatctggactgttctctgttacctactctcagacacttctgattaaaataactgaaaataccctaaggataaactcagagccatgaatttcctatttggcccttaactcacaggcttaaacatctcagatctgtttataataatagcaatagaaggactgggtctaagccctgtacttcaaaatttttagtatcaaaggcaacctataataaccacccccagccccaaagcctagggaactgggacaatgactcttcataacttcttcaagctgaatatgggttttgagatattttgaagggagggcgaaggttagggaaaatgggggagtttgttggccttaagatggtattagtctctgatgtctgtgtcctgactggatcaagatgaaaaaccaagacatcaggagttcaggcaggtcagttcagcatgtctggtgatggaattcaccaaggctgtatattctgtaatatataaatctcaaaaaatttttagtattatcaagataacctttttgtttgattctctggaatctagttcttagggggtctgcctgtatcaaatctgatccatataactctggaaggtgtaaataccttaatcaccttttccaaaaccacaaagacaaaaccttttccccaaatcagcacatccctcagccagtaaccaggaaaacctgtagcttgccctctgtcccagaggaacaataaaaccaccacaacactcaaaatcacatacattttagcctgtttaggcgtttctaatttgttatgtcaggatattaacccaaaattccagtggagcccatgttagacagaatgtgagtatcctgtaagacttattagactaatacatctttataccatctttaaagcaattagtttaaacctccactaatatctgcctataggaagcagatagtttttaattgttaagctctctgcctagagcagccatcctgttataccgtctatttgttttgctctctaccaggagccacagattttatttaattaatacctattgtaatatctatctattatgctctctacctggagccacagtcttctattaataaatacctgctcatagcaggagattatcactgctctttctacttggagtcagtgactaatattccctatctagttccaaaccgcaggtgaaatttcccatctttaagtatcaaaaggttataattctctctttatatcaatgaattcctggtctggagccctttgtacctttgtctcctgagttgagtctttattcacagggaagagctgagtgtagacagacatgcattgtctgtgtccctgtttgggggtgggggaggcagagtggagagcgaaggatactggaaatcgaacatagaaaggctctctctggcatatatgcctctctgccattctctgtaggcccctcaaacccagtcagcttcgaatccacactgctgtagcctattttgctgcccaagccccattcaggggttggggggcagtaaaattttacctcaggttagttgagttcaaatcaatacattgggcaccaatttgttgtggtaaatctccaaccgaaataagcccgggcaatgaaaacacaactcaattaatatgaatacatgctgtgagcctagattgggcagatctaccgctacactaccatcttccccatagaagagaccccttagaacttgtggtttctccaggccatgtgcttctgttccactttcttcttcctcttcctcttcctcttcctcctcctcctcctcttcctcctcttcctcctcctcctcctcttccttctcctctaccattctctctctctctctctctctctctctctctctctctccctctccctaccaccccccatccccacagtagaagagaattaacatcaaatacaattagccccaggtctatccacagcatggcaggaaataatcaaactgaaagccaccaaatagaaacaaaaagaactatacaaagaatcaacaaaatcaggagctggttctttgagaaaatcaacaagatagataaacccttagccagactaaccagagggcacagagacagtatctaaattaataaaatcagaaatgaaaagggagacataatgacaaaatatatcttaaaataattattctgtttgttgaatattaacagttcaaaatattataatcatgttttacaaacaccatgaacatattattaataatttttctcactgtgcttgaaattagcattttattaatgttttacttcaaagagtttttgctattttgaaatatttaaaatatacttactgataaaataatttctctcctagaaacactgataatcttttttaagtaaactgattgttagacaatgtacacatatataatgcgttttaaatactccctcactatgtcaggtagtatcatataaggacttttgaatatattccttaatgattcatttttaatattctattctcttttagtatgcttaattcccaaagaatattttgtatgttttgaaataatttagtattcaacattagatataggaccctcagttatggaaagtagtaaatattcattaatgatatttttagggtatgaaaggaatgaatataaaagctgaacaaatttttatgtattatttgattctcaaaatgctcaatattatttatatgtctgatatataaaatgcatttaactaataaaaactaaagaaaagagaaaatattaaaatcttgttctaccaaaaaaaaaaaaaaaaaggtgtttgctgacaggagcctgatacagctgtctcctgagaggctctgccagattctgaccaatacagatgtgaatactcacagctaacctttggactgagcacagggaccccaatggaggagttagaggaaggactgaaggggccttatctggcaccaatgggaggggaggcccttggtcctgtgaaggcttgatgccccaatgtagaggaatgctagggcggtgaggcaggat

SEQ ID NO: 699 - DNA, 33399 bp, mus musculus; identical to SEQ ID NO: 27

SEQ ID NO: 700 - DNA, 33399 bp, mus musculus; identical to SEQ ID NO: 27

SEQ ID NO: 701 - DNA, 3255 bp, mus musculus
tgattggctccgctggccagctcgtcacactcttttgtgtcagtaggctgctgataaaagctttgcagctgccttggaaactgcgctattcgaatccggttacctgtgggtaagtagctgggtgaagcagctctttctggtagcttcgagtcgcctagcggctccggaggtgccagcacttttctccccgggactcacaggcagaatccatagctgaagacaccacagcagcctctggctaccagtggatcacaggttttaaaacgggggggggggggatgggatgggtgattccttggtgtggaaaaggaatggggcgcgcggggtggggggcagagaagccctcgggcataggccgctcctgccttggagaatctgcaattgcgacgctgggggaggtaaggtgcgttagcatgacctcactgggagtcacctggaagatgccacttggtaggatttgcctggccagggagggggtaggggaagaggccaactggaggatgacggagaagcaattttgtttgccttaaaccccctatgtatctcctctaatttctctgggtactgtgggggtgggtgtgtccaactcttattctgttttacagtagcagcccatcaaagcggaatctgaacttgaatttggtgcagctggttgtagagctgggtaggataatggtatctagggatgcaaatatgtggggttttggggggtaggggatcgttttgtattgtattcagaaggtgggagagggaattttctacctaatgacagcagaaatgggcgggagaaagagggagggggagggaggaacaggagaaggatgacgacggagtatttttctgacctttcttttgcctcctccaatgtggcgcagtcttgagcatcaggatctgagacccccagtcgatcgaggtccatcaactggaccctggaggcaggctttctcacgggagggaggacacaggttgcagaagctggaaatactccagtttcccagctgatgtaagaatctgataaatcacagaggggggggggtggtatgggggtggggtggggggaagtgggtggtccagggagttttgagaggggcttgcagttaagaccagagatcatgaagttaatgacgtctctttttaacccctgcgaatttgtgaccattgtgcatttccacaagtaaaatccagaatggaagcaacagttgccctccctctcacaggactggcgggagggtatggatgacgtggctataaaaaacactgttagtattgagacatcagctagctccaggaggctgcaactgctctcctagcccgtattttaggacagtggacaaatatatggggtattgaggcacagtaattacagctggagcctgctcccttattaaattctcctctcccttttgcttttttgcagccccctactgagattggagactgctgcactgctgaagataaagcgtttttgttttgtttctaaaacgccttgaacttcgtgtattaagatatcctatcactgctgtcagacatggctagcatcctttcacgtttgggtagcagccgggggcagaactcacccctgccaccttgggctcattccatgctgagatccctggggaggagtcttggccctttaatggccagcatggcagagagaaacatgaggttgttctctgggagggcagagccagcccagggggaagaaacctttgaaaactggctgagccaagtaactggggtgctgcctgattggcatatgcctgaggaggaaaaggtcagacgtctaatgagaacccttagaggccctgcccgcgaggtcatgcgtttgctccaagctgccaatcctggcctagatgtagaggattttttgcgggcgatgaaactggtctttggggagtctgagagcagtgtgacagcccatagtaaatttgttaacactgttcaggaacatggagagaaaccatccctgtatgtgatccgtttagaggtgcagctgcagaatgctatccaggcaggggtgtttgctgagagagaggcaaaccaggctcgcctgcatcagctcctggtaggagctgagatgagtacagaccttcgattcaggcttaagaatcttctccgggtatatgcaaatgagccagagcgccttcccaatttcctagagttaatcaggatgataagggaggaagaggaatgggaggagacttttattaatccaaagcggcccagaagagccgagtcagtgatggagagggcactcagccctatggcatttcagagctccccaccaataatgatcagcagtatcgactgcaatgtgatcgagatagatgactctcctgatgattcggatgaggatgtgatcttggtggagcctgaggacccaccactgccatcctcaagtgcctcttccttcctaggcagggctgtatctgaggaccaagtgctggtcattgagtccccaaacatttttgagatccaggctccttccactagcagtggtgctgggagaaagaacaatcggggttttggggagctgcgtagagccaggaagcgcaaacatacgatccattgttcccactgtggtgaggagggccactcaaaagaaacctgtgacaatgagagtgacaagggccaggtttttgagaatctgatcatcaccctgcaggagctgacacatgcagaggagagggcaaggggggcccctggtgaacccattggcctatctgaaccacagtaagatgcgactccccagccttaaattaacccttacccgtattaaatgtttaacggtggaaaagttgtggggacagatttctaattgcatgaacaaatccacaaagtggctttctttgggggtggagaaagggtcccgaataccagtacagtaaagagaggtggcctgacctatgatcgtgttcccattccccactgcttaacagtctattttctgtgtgaacctctctccttggtggctttgttctctttgtgaaagtggtattgttcattgttcaatcttcaagtaagaaaattattaaaaagtacaaattacccagacctctctaccttgtgaaacaattgtcagccctttggtgcctatccttctaaatatttctctatatctgtgttcctagattagaaatatgtatagacgaaagtgatcaaatagaagtgttgttctatatgctgtattttttcaccaaaacgtatgttgtggccttctttgtcaataaatatatacatatatgtcagcatcta

SEQ ID NO: 702 - DNA, 37107 bp, mus musculus
gggggcggagctctcgaggggagtcaattggtccgctggagcccaccaagggattggagcaggcaggcgtgcaaacctgcaccctgtagcccccagccaggaatcaggaggcagccacctggaagctcacggggcctgcagcggggcgaggggcgctcggggcgttggcacgagcgcgcgcgcctgcgtcgccttctcggatgcggcgaggacgactctgtgtcgcgacctgagccattcaacagctggcctcgcccgcggcggtggaagagagcgaccaggagggttgatccttgacactgcggcggctggagggaggcggcggcaggagcggtagcggttccgctaccccagcggagctaagcgtgaaggtacagcggctgctgaggctcccgataacacccccccccccctttctgagaatcgaccaggcggctgcgtccttctgcgtcccggttggccggccgccctggcctaccggagtcttgggtgcctgggaggcagggccgcgttggaccctgagtgaggacttgggaggggttttggagagaacccaggtagccaggcctgctctaggtggaaaccaggttttctagagatgcccctaggctttcccccttggatccattcggctgctctcttgggtcttggtgccgcactagggggcgctgtggccgctgctgcagctgaggtcactggaagcttttccttagggtgtactagattgcttaggaaagctgaaggatgccctcctccctgctgtatgcaaaagccaagggctctggttctcaatctgcttcagtgacattcattccagttaaccactacccagggtccgttgcctctgcccactgatgaccaccaagggccttgtgaggttcctaccgtggatggaattaaactgcttctaatttgacccaagaaagcagggtaaacctctaagcctttggaatgcatagtcttgagctttgagtagatgggcagaagtatcagggaagaaagcaagttggggagcctcatgtcttggatactgctgtctctgagcatgttggtcactgggactagtaccatttttacatttatcacctgcttatgaaaccagtcactacctgagcacttttgaatgtcactaactctaaacatgtgttgattggaaccctggaactctgaattgcagtatggggactacctgggtctttttatttcccacagggtttcaaagatggtacccattttacctgatgttcttcctgtctcagatctacctttgaaacctcatactgttgaaatactgtaagattgtgaagtataattgatagggatgccttttcaattctgaaaatgtagtggggatctctcaaattcagttttttaaaagaaaattttttttaaagcatgtgagattctggtagccacacatttctttcttttttttttctttttcttttttttttttttctttttggtttttggagacagggtttctctgtatagccctggctgtcctggaactcactttgtagaccaggctggcctcgaactcagaaatccagctgcctctgccttttgagtgctgggatcaaaggcatgccccaccacgccgggctggtagccgcatatttctgtgttctattttttattcctgtgtggggagtgtatcctctcaaaaggatggagtaacttgaagcatggggtaacttccatgaaagtgttttttacttcagttcttgtaaagcacatggaaaagtggaatgagcctccaggcactggtgcccagggaataccagctgctatacccatcagaggacggctggggctgacttgaagaggaagtataaggtagagggtagggcatgcagaaaccatcttctgcagtaggtggactcgaggtctcccatttattcttaaccaaatatcacacaagaaaagtgtggctcattggtctatttttttatatcatattcaggcaacagacccaagtttactggatccatgtgtcatcagaagaaatggtgaggcttgttgatggtgtgtgtgtattgtgtgtgtgtacacacatgagagagagagagagagagagagaagaagctctctgctgttaaggctagctatgccttttattttcccagcatgcacccctgcctttgtcagagaaaggaacttatgttttttttttttttttcagaatggaaaagaaatcttactttaattataattatagaatccttttaaagaaataatattttatttttctgttatttgctttgtttgttttttgttttttccagacagggtttctctgtgtagccctggctgtcctgaactcactttgtagaccaggctggccttgaactcagaaatctgcctgcctctgactccaaagtgctgggattaaaggtgtgtgccaccactgcccggtgaaatagtattttattaatcctttgagaatttcatacatgcatatgaagtcttttaatcatatttaccccattattccctcctaattcttctcagactcccaacaccatgttctcttaaaaaataacccatagagttaatttgtgctgcctagatagtcatggcttggggaccatccactgcagcatgcaggacccttaacaaaagctgactcttccttcctcagaagacattaactatgagtagtggagagaagagttttattggtagtggtattttaagaattcagattcaatctccattcaggtttacagatttttttgttgttgttgtttccaacatattcctggctttttaagaagcttaaaagcttagttgcagttggaggcaggtcacagttgaagtcaacatggtctacatggaatatagggagcatttctcagaagagacagtataaggactgggacatattaaggaagtccagtgaaaattgagtagtagtagcggcaataataacaatataataataataattcaatgcttttggggctaagtatttgctcatctcatgtgattcttcaaaaaatcacacacacatactcagaaagagagagagagagagaaagagagagagagagagagagagagagagagagagagagagagagagagagactgggcatgctagctaatgattactattattccagcactcaggtagactcagaaggattaaagtccttcttggctagattggaggctagttgagctgtatgagaccctgtcttaagtacacataaaagataagaaacaggaaaccccctgtaagataagtactggtcactattaggggttgagtatctcaaatccaaaaatctgaaatctaaaacactgcaaaatctggagccttttgaatactgtcacagtagcacaggtggaaaagtccacgtatgtcctcatgtgctgggctgctgtaaagaagctgcattaacaatattgtataaaattaccttgaggctatgcatacaccatgcatgggaaacatgaatgagctctgtgtttctatctgggtttcaccctcaagatatcagctgggtggtggtagcgcatgcctttgatcccagcacttgggaggcataggcaggtggatttctgagttcaaggccagcctggtctacaaagtgagttccaggacagccagggctatacagagaaaccctgtctccaaaaaccaaaaaaaaaaaaaaaaaaaaaaaagatatcttcttctatagagatagttgtgagctcaaacattttggacaagggatattccatgtggatcttctacagtttaaacaggtgacagacccaagaaaatcccctagctacttgatggcatttcaaaccagaactacttgaacgcattttggttgttgattttttttttctgccactataaaggttccatgaagtagactttgaagggtgggtaaagtttgtatgagagggcatatttggtgaggggaatcttcatctttggaagacctcaaagaagtctggatcaactagaatggggatatgagcatagagatatgatacccactaggtggggctgaggtggggagggtcttgtttttaatgccttaaggagaatttgtggtttggtgtaataaattgagcctgctgagaaattacttatcttgagtgtgtacatatgcacatgtcacagtaaatgtgtggagcccagaggacaacctcagttatctgtcctcacctctaccttgtttgagatctggtctttttgttgttccatcctgggcatgccaggctagctagcctgagagcttgcaggtttatctcactgcaggtgcactggaattactgacgtgctgccacacccagcatcgcgtgggctctggagctccgtcactcgggtcctcacacttgcctggcaaacgctttctctactcaccgagccatatcttcagtctggcatattcataatctctaagcaagaaacaatatgacagaagtaaaaattgtgtgacttccctgggtccctgggcctatgtctctttcctctttcctcttttttttcctgaggatcttgttcaggtgtgagtgtacttaattattgtttttgatctctctaaacccctagggagtaccaaatgcatgcaactgagtagattcttgggtctactgtataggaaaaggaagctaggagctttgtgagaaaacctgcccctaatgagtaggctttagcctatacgatttgatttctgttttgttttatgtttgagacagggtgttgacatgtagaccaggctaggtttgaattcacagagatccatctgcctctgactttcagtgttgggatttagggtgtaagttaccatgcccagcagcctgtactacttgaaaaagcaactgaattgggggaaggaaggtcagcactgaaaaactgatgatctcagtaaaaaccaagacctttagcttatcttgcaagtctcaaaggcctgggtgatctcacacacacaagactgagcttcacagagtgaaccccttcagctgggtctctgcattgcctttctcgtggccctggagtctctggacactcgtccgagggaaccaagccctacctagcagattccaattcaagattaccctcttgcctcactgtgcaatcaggaacttgccagccgacttcccatagcactatccatgtggaatgaacatagtcccagcttgctggcaggcggcatatttcatcatggaagagctgtctgccaggaactgagcatcatccccaggcagcttcttttctcgggcctgggactgaaagcctgttctattatgacacattctgttgaatctttattcttttcttagacaccagttttctctctgctgtatactgaatgaatataggatctgggtcaaaatgtaaaaaaaaaaaaaaaaaccaaaaaaacagttcagggtaaaatacagaaaaaaaaaacaattaaaaatgtaatgctagtttggaggggggaatgatgtaattatattataatccccccaaaaagaaccaaaatattttaaagaatagcatgctcaaattattaacctagaaatctctgaaagcatttaagtctttttgtgtgtgtatgtgtatgatatttgcatatgttcatgtctgtgagaggagagtacgtgcatgccacaccacagcacacatgtggccgtccgaagtcagcctcgggtatcagtcgtcagcttctaccttgttttaggacagtctcatgttattgagtattgcatttgtcagagtagctgctccgtgagcttttgaggagtctcttgcctctatctcccatctcaccacaggaatattggagttgtagacacacagtactgtgtccaggtatacatgggttatggggatctgaactcatatccttgcacttgtgtggttgccacttgtgtgctttacccatggaaccatcttcctagacccataccacactctgtgttctagctaggtataagccatttctgtgttagcactgaacaacattatacaagtctgtccaggaactgcagggcatttaacattagtggcccctgcttaccaaagtgatgatgtgccctcctagtacaactgttagggcaagtaaaattgctctcctgcacataccattgctcttgaagggaacaatagtgtcacatttaaaagctacaaagaacattctcaaaccatctagcatttcatgtggagaaatgttaatagcatcattgctaatctgtggtgcaaagtgttctagtcctcttatggtgttttctgcatcaggttccagttactcgccctaatttctgtctctttttgactcaattcttcgagggtaagctcattataacacaccactccagctcccaatgtctagcggggtaggtgattggtaggtacacctgaattactcccattgttcattagtgttaatagctctagtctaaaaaagcgtgttagcctgcattgctgttgcaccattggtcttgagatgctggtgtgggattctaaatacagaactaacacctttggaaagaagctgtcaggcaaagtcgctgtttaacttagctttggccctattgagtttctcctgcctcccagctgttctaggctctggggtaatactgatgaagcaggcatacattccatgctcttaggacactcgaggggatgaaggaaaggggctccgaacacaagttgctaacgatgcattgtgactaggtggctttgatggtatgagaacagtgctcttttaactgttcagggatagcatctctgaggaggagactaggcatttgagtcaaatcggaaaagcaaaggagccaggcaaatcataagcaatgtgcctaatgtcttgtgtccagtaaagaagccaagggactggggtggagaggaaactcagggggacaaggaggtggaaggcatcgacagaagcaggcagaaggcacattttgaaggtaagaagtttagatttcctttaaggcatggttggaagccactggagggttttgagcagatatctaacatgatccggtttagggtattttaagtcagacatggtggcacacacacctggttccagttactcgtcctaatttctgtctctttttgactcagttctttgagggtgagctcattacaacatttaccactccagctctcaatgtggctaagggagtaggggattggtaggcacacctgaatcagtcccattgttcattcaacactcaagcggcattcctgtgagcagaagggttgctctgagtttgagcctgggttatactatgaattttaggccagccttggctatggtatacatgcctgtctcaaaaaaagtgaaaatttttgttttaaatcatgttggcacttatctagggtaaggatagaagaagaaaggctagttaggaagcttccagaatgattcaggtcagggtggtagaagatcaggcctaggagagagcaacaaatgggcaatgggtttagaatatatactcaaggtgaagggattgaaatggagaaggtgagagggctagctaactcctaggttttcagctgatgccatgggtggaggtgcctagacttagggaaatgaaaattattgggtgggaaggagccggtgtgaagtggagggcaggattgggggatgggaattaggcgttcgggtgctcttgttttgctaagatgccaaggaaaagtttcactggagacaatgaataggcagttgaatatgcatcttaggttggcagagcttgagcccacatgaaattaaatgcaaattaaaggtgctttggggtgtcaaaatatactagcatagacatcacacctaaaatgataataatccagagtgagcagggctgtaaaggagtcaggcatggggattctgccgatggcctgattctttgccttaatgttccaggagaccaatttgacaataggtaaggagctggacacgattattcctgacctttgacatagcatattttgaaaaaacaatctttaaaagctctgcacagagcttttcatgctaagtgtacattctaataataatagtctagagtaacactcttaaaaggggtagtgtgtccttttaggaaaagaaatggagccaggcataacagctctggcctgaaattccaagagtttctgagggcgaggcagaaggatggtgagcttaagatcagctgggttgcatagtgaagtccaggctaaccagggctacatagggagactctatggggaaaagaaatgcacacacacaagccctaaagggaaggaatagctaaccattctagtttcattctcttgctgtgataaaacactatgacagacagcaacttagaggcggaaagggtttatttggcttctacttccaggtcacaatgtattattgagagaagctaaggcagggtcccatggcaggaatgtgaaacggaaaccataagtgaatattacttgttaactcacaagcccatgccttctaacacagcacaagccctatcgcctagggatggtgctgcctgcagtgggctggggctccttgcatcaattagtaatcaagacaaaccctcacgtgagtgtgagtacaatgcaggcaactcctcaattaaggctttcctctcaaatgactctaggttatatagcaaattgactgtcaaagataattaggatactaaccaaagttatagtaacccccatagagaatctccttgtatataattttcacacatcaatatctgcaattgttaatcaagcaggtgtaaatcttggagagtggcaatgtgtaggtacaactgtgtaaaccttacaagctgtccatggtaaacataataaatgtgttatttatgtgtaaatcacttctttcacttttgactttgtccctgtttctctctgacagtgtcccttgcttaggatgccacagcacagtgctcgccatgaagagttcccatgaatcgtggcctttgtgatattttcttctttgacacattttctgcataaggtattgggtaatatatcctattccatgagacttggatttgaataagttcttcttggggttttataaaggttgggagacaagcgctcagaaacccattgagtccactctgtcataaaggtggtctttccccggtaggtggcgactggtagacaggaactttgctggtaattttcagaccgaagctacaagctgcaaaacactggcaatgttgtgataagcatttcccacgaataatactcagattattcaaggagtgaagcaagagcctggcagatactcagccacattcctttaaatccttgttgacctttttttttctttcctatgtgaattaatgaaagtagtaggcctacagcatcatggtaaattaatccaagatagacagcagctttcttggctggaggtgttgagcaaaggagtttcccaataaagtgctatagatggtgaaaaaatcgactaaaggacttctcagacaggtctgccagctgctttgtgcatatcgtttttaactagctgcctttcttgctatcatgggttcacagattacaacaaggtagcatgcagagtcatgtaaacactttgtttgtttgcttatttatttgtttattggttgtttgttgagacatactgtcatgtatcccaggctggcctcaaatggccttagattccctatatattcaagggtgaacttgaacttctggccttcctgtctctatctcctgaatgctgggattccacatccatgcccgccatgcctggtttatgtggttctggggatgggactttgtgcataaggaaaatgaatttgcactgagataaattaatgagtctgtttttctcctttcctgggttccctccctttccatgccctcctattctcttttgtttgggtttgggttttggttttgagtcagaatcttgttatatatcctatgctggccttgaactagtgatccttctgtgtccatctcctgatcactgggataacaagccatgtgccaccagtcctggtcagttttcttcgtttaacaattatgactctccacactgaactctgccttacagttgagtcggagtagtggtagagaagattttctcttagtattccattgctgctagtctgtcatgtctgaatgcctatggggtctctaaaatccctttttttctgtccagagggcctcagggtcttatatgagttctttcagaccatcagaatctgggaatttcacaaaaggtcataaattggctattattgcaaagctgagtgctgcttagtttaatgatgtgattttgatgttattcaaagatctgagcacatggtcagtgttggtttttgaaatgatgtttaggttagtgatgtgcccagatgtgtgagcatcttcactgaagagctctggaatatttgtatttgagcaagacttactggagagtctgtatttgccagattggccatttggctaggttggtttgacccacataaatgttggctgccctgctgacttccaaaatgtgttggtagaattttatatgtcttagatgctttcaaaacgacaacattaaggttccaaagcctggagaagaaagaaaggcaacaaagggttgctttcagaggggacttgagtttcgtctacggtcccatttcttttcctgttgttacttttttgcatgttcttcattcaaaagtccttgctaatattctgactgcaaatgcccaagagtgagaaaaaaaaacaaaaacaaaaaacaaacaaacaaaaaaaccaactggtggttgctgatgggtacttttcctatgacaaattgtttttaatctttcaaagctaatttcactaaatcaatcaatcaattaatacacgaagtagctgatgaatttctctactctgtcctgaaatgagagagtgactttggatgtcaactctgcaggaatttgttgagttggccctgctatttacaaacctgttttgggctgtgaacatctcgagtctgtttccttctccctaagttctgattctgctattatgtagccagctttgctgctaggtagagaagcaggcaagagcagatgggggaagggtagacaggctggatgagtgaaggaagcagccatggttcctgggaatctcccagagactttttaacattggaagcatgatactggtaaaaccagctggggtgatgcacacctttaatgccagcacttgggaggcagaggcaggcctatgaccttgtgtttgaggctagcctcgtatatattaacaaattctaggacaaccaggactatgtgggaaaaccctgattcaaaaaaaccaaaccaaaccaatcaaccaaccaaccaaccaagcaaccaagcaaacagcaacaataacaggatactgctagagtgcatgctgggtaagcactgtacagcaaccatactttttaaactatatgggccattgagaaaaatcatttcattctaattagcccacaaataacgacattgcatagctggtttacgttcatgctctgactttgttcagtgatggactggacatgtcagccaaacacacccgttcctccccaagttgtttatggacagtgatttatcagagcagcaagaaagcaaactagaacagatattagcaccaggagtggtgttggtttcattatgaactttaccagaaccttaccaaaatagtctctggactattttgttagaggattaaagacgatttgggcactttaaactgaaaaaaaaaagtatactcagagattaatgggctgttttacggggagcttagaagatagggacatgcaaacatgggacatagaggcttggattgtgaagttccagatagaagcaaagactctattgggggcatttgtgttatattttggattaagaatctgtgattgttggtcagctgaggctgaagagtcaggatgattaacaagcgaacagcatcactaaggtgaaaccttgtgtttcacagagacaatgagtgtgaatcagctggggctgaagaatcagttgtgggtaataagaaatgagtatactcaaggtgaaatcttctgggaagtgttttctcacagtcagaacacaaaagctgtgaatcagaggagccacattggcatctcaagccgacagatgaacttgtcagcatgtaatggtcacctatgtggttctggtttgaagggatgaatggggtcatggagagcagctgaggcttggtgtcttgtggcaggtttggagttgccccagaaagattctgagaggccattggtgaaggtgaggcctcagtggagaccccaggatattagagaattcaggattgtgggatatcctccaaggacagtggaatgtattgtaagaccccgaagctgggcctcagctcaagtcccgggatgagctggccagcaccccaatgactcgagagaaaaccacacctgatgcaaactgcaagaggttttattatcagctagctgaggacaaactccttccactgtgcagggcaggggagttcgaccctgagtggtgacagtagggggcttttaacagccagctgaggaattgggaggcgttgggaagagttaggaggagttgggaggagagttcttctctcccgggtgtccttggtgaaatttacaaggcaggagtggggagtgagttctttctgaatttttatctccgtgtcatcggcacaggaaggcaggcatctctggttgtacagtatagaaacaaaaaggctttttgctggctatagagaacaaagagcttctttctggctgtatttttagagatcagggaaaacaagcttggggaacatccaggcgctttaccttctagggagaaacgctctaagtcggggtctcacagtatgaagcggagcatgtctaagcctatcagtcaaggtgtgtgttaacagagctgaagtgaggttatctaagccctttgaagcccagaagatggagttccagatgtcagccatcgagctactctgtggctttgagtcttgcttaagtatgattactcttatgcactggttcttcctttatggactaagttcttaacttgtcttcaattttacgagagcccacagaaaagagccttgaacttttaaagcatctgggttttgtttttttttttaactctagaggacttttaacgttgtactgttttatcttaaggtattaacatgagatcttggagacaaacatgaggatgtggtttttgagtaaattggtctatgagcatgacagtgattgatgaaaaggatgagaccagtggcaattcattctactgccactgccaaatgaagcaaggtttcttgtgtctgttcagcacatgatttctttttaaatttaatttgtgtattttaaaaggtaaatcatcaaatccaccttcattctccatgcatttcccctctcatttcttcccccaaatcgcccaccaatatttctttccaacttcatgtgttttttttttttttttataaactaacctcgtctcctcagtgctgccggtatgtgcatgggtatgggaccaccttttgaataggctctcaggggtcacatctcttcaggaaagtgactcgacatctcctagaagctatcaacttctcttggctcctcagctaaaggaggtaatgatggctttactgaccaccttcccattccacgctgggcatttgtctggcttgtgcagctttcctgtgtggtatcacaacagctgtgagttcatgtgtgcaatagagctgtcgtgtacagaaaatacggtttcactgcagacattcgctacagctagctcttacaatttccattcatcttccacgacgatttctgagccttgggaggagggggtatgatatagttgtaccatctagagcagaacacactagtttcttccttgcatattaactcttcgtaggtcgctgcattaatcactatctattgcaaaaagaagcttttttggtgcaggttgagaggcacactaatctattggatataaagataagaatttaggaggcagtttattactatgttgatttaggaagcattagtaagttctcccaagtactgtgatctacccagctacagtttcttggctcagttaacagtaacaagcatggatttcagcttactgagccaaccttaaatgcaattggcaagtggtcagttaatcctagaatgttcagaagcacgtcctgcttaaacacaaaattggaaggcaaatttggcttttacagtcaattttatgtcatagcctaataacttgatttcagaaattccacttgtacctgtattttggttaatatataacaagctctatctcttcagtacagcctggtctacagagcaagtttcagggaagctagaactacattaaaaaaattgtctcaaaaaagggggtgctggggctggagagatggctcagaggttaagagcactggctgctcttccagaggtcctgagttcaatttccattaaccacatggtggctcacaagtatctgtaatgagatctggtgccctcttctggcatataagtgtacatgcaggcagaacactttatatataataaatctttttttttaaagcctcatataaaatagagattatttttaaaaagcaaggaccatgtgaagagaaagctaaaaacgtttatagacctatttttaagaatgaagtaggattctctaacagatttaattaaataaggattatcgcatcgaccttggaaccgggaaagtattctgattttgaagaaagtacttgctagtgtattaatatataattgtttaaaagaaatacatattcttaaacaggttgtgaatttgcagagagctgagtgattgccaaaggcaggaggattacaaaaaggcacaagaaaatttgtgaaaataatggttatttccactatcatgatcatggtgatggtttttcttcaagtgtgtatacgtgtgtcaagacttattaaaaacatttgttcaagccaggtggtggtggcacacaactttaatcccagcactttgggaggcagaggcaggcggatttctgagtttgaggccagcctggtctacagagtgagttccaggacagccagggctatacagagaaaccctgtctcaaaaaaacaaaaaacaaaaaaccaaaaaaccaaccaaccaaccaaacaaaaaaaccaaaacatttgttcagtttatgttataaaatggataatattatacatcaatcatgtctctatcaagcagtctttatgtcttcctggtactggggatagaacccagggccactggcatgctagacaaagctttctaccactgtgccacactcccaactcaaatcaataaagcagtgttctaaaaatcacctgcacaacctgtgatatagctagtcgcacagttgccatgtgaccctttgtttctaagaatttcattccaatctcccaggcttcagtcatgactcatataaccttcaattctggaatccgatgctagtgatggcacatagagggctgcattgggggttatgtaggggactgttgtattaattttcctagaaaagtttgtatctgcagttggcgattgcttctaggtatctgctctgtgagaggctgcttgtctaacatgtaagaggttctggattccatttctagcgcaactgaatgaatgaacaaataataagtggataaaatatgcaaggcaaaaaaggggaaattattctctacttccaacccactttctagaggaagtattgctaacaatgcgatgtatatatttccaaactttatgtatgtgtgtttgtagacatacatacgtgtttacattattctacaagtttattatatctcattttgaaaatattaatttttctgcagcgtctttcctccaaaaactatcatggttattccatcttatcagtaaatacacctccctctctccccttcctccttccttccatcttcccctgttctctttcttccccctccttgtttatttttccttatttttatttaaaaatcctttcatgcaatatattttgattatgtttcctcaccccaaccctctctctccttctctctgtctgtctctttctgtctcttgtctctgtgtgtgtgtgtgtgtttgtgtgtgtgtgtgcttgtctgtctgtctgtctgtccgtctctctgcctccctgcttctctttgtgtgtgtgtgtctgtctctttctctgctccccttaatcatgtctgaggcccccttcaacaacaggtgccacaatggagttgattgtttgcagctatgcgccagctgttacattaatttcccatggcatgactgtagcactgaaagtatgatatatgcaaaaatccaattagttggtgtgtactaggcccttgacagatttttaaataagaattgaaaattagctttctattcccagaaagtaattgaaaatgaaatatccacatgcatttaattttaagatctagaatctatgactagagaaggggcaagaacaactgtttttgttattgcagtcttaggaaaattggaatttgagaattgcagttgtgatgatttgaaagggggcatttaaaaagttaaaaattttaattggcacataattttaaaactaaaagtacaactatatgtattcaaaggacataatttgacattgcaatatatgcatgcaatgtgtaatgatcaaattagagtatgatatggccatctcctcagacatgcaccatttctttgggtggagaatatttaaaacctgacctactgggtgttttgaaatatacaattaattttttcttctctatagttgccctactgttctatagaacagtaatgattatcttgtctagtcaacagtactgtatgtacactaaccaccttctctccagtccctcttcctctattcttctcagcctgtgctaactaccattctactttccatttctatgaaagtaagtatttagcttcgttgtattccaagcttatttcatttaacataatatttcctagcttttcctaattgtggaaatgacaggatttcattctttttagagcgtgataatattccattgtgcttatatactgaatattctgcaaccatcctccattctatgagcacccaagttaattctgcaggaagcatgagagtgcttcttgacatactgacttcatttctttggacgtatgcccagttgggagacatctgtgtcatgttctagctctggttctatttcgagtgttttgagaagactgatatacatcctactatatatagtaatatccaagcaccatttattgaagagactttttccaaagtattttttggtgccttgaaaaaaaatcatctatttctgggtcctctattctattgtattgatcaatgtgtctgcttttatgctagtggcatgctgctttggctacagtagttttatataacatgttttgaaatcacatattattatgtctccagctttgtcatgttagattttgctcagaattactttggcaggatttttttgcagctccatacaagttttaagggtgtttcctcttgtttctgtgaaggatgcccttgttattttgatggatgctgtattgaatctatagattatgttgaacagtatagctatgtcaagaatatgaatttttccagtccaggagcattccaggctgtcattgtctgtctgtctgtctctgtctatatgtctctctgtgtacttatgtgtgtgcttcaatttctttcatcagtcttttatagatttgattgtagagttctttaacctctatgtttaagttaatttctaggtatctttataggtgttgcaaatgaattcatcttcttgatttttcagtttgttcattgttgtataggaatataagccagatttgtttttgttggtatatgtctttcatcccagcactcaggaggcaggggcaggtggatctcagttcaagtagctcaaggctagtatggtctacataatgaattccagatcagcctggcctgtgtagtgtgcacttatctcaaaaataaagaaaggagattcatatttatttttaattctgtgtgtatgagtgttttgcatacatgtatgtcagtgcaccacatgcatgcctggtgttagtggaggcatcaggtcccctgttactggagttgcagatggttgtgaattgctatgtggatgctgagaacctaacctcctggtcctctacaagagcagcaagtgttctgagttgccgagccatctctttagccctcagtactaacttttatatattgattttgcattctgtaacttgtctatcaattctaacatattttggtagtctttaggcttttctgtatatcagataatgttatgtgcaaatgggtgatttgacttcctccctgccacctggatatttatctcctttctcttttttaactgccttacctgagattttcagagtcattttaaaaatgactgacaatgctggagaattggctccagttaaagggctgcctgcttttccagaatacccacgtttgattctcaggacctacatgatggctcacaactgtttgtaactccagttgcaggggatctaactgtatcttctgggatccatgggtactgcccacacacggtacaacagacatacatatggcaaaatactcatacacagaaagtaataaaataaaaattttaaatattatcaatccggtcttcttgggaaaatcaggttatcttttatagtaattcattttttctccaaagcattcttgatttctgaatcttgatttgatgatttctgaatattaaatctaagagctgggatgtagttcagtggtaaagtactagtcttgtgtgtgcaagggctttggtttatttcctgacatcacaaaaaaatctgtactaaaataatttaggaattaatctctgttaagctatttaaaaaatataacctagacttttaaattaatctatgagaggcactatttaaaattatttttccatcagtataatttgggggagacgtctgttaagatattttgtctctttttctattgttgttggaatcaaatttagggccatacacatggtaggaaaacgttctatctctcagctacatccccaaccctgtttggccggctcctgtaaaagtaacttttattcacctgtgataattgctatctcagaagcttactgcctcagtctgctaacctaggcctagtcctggaagcttctaacctccatacaatctaatctaggcctacaatgttttcagcctcatagacttgctgttaaatcagcgctgagctttctgagctctggatgtctggttcaactctgcttttctggctcaaaactactctccaaactaactgattcaagctggcttctcttggcctcatactcactttggcaatctgttctactcttcaggctccttcgaattctctggctcattctgtcttcacctgtgtctagcttcgtttctcgtcaacctgtctctgtaaaactctcccaggaaaactgcctacctctttctctctgcactgcccctgaagtagcttccctttcctctctcttcttgtgagagttgggtgtatcctattctgtcaaatttttctctgatttgtcacttggtctgccattcaattagacacccctttcaaacatggatgcttccttctacaaactttaccttcattggttgggattaaaggtgtgtactaagggcatgccagtattccaactggagggattaaatgtgtgtgctaatggataagccacaccacaactagaaacaggtttttccaataaataatacaatctcagggttcacagaatgatcagatatcctacaacaggctcatttaaaaaattgttattagttatgtgtggccatgtgtggtgatatgtatgaaggagtctagttgcttgcgtagtgcagaggtgggtgtaataccacctggaggtggagttacagtccattttgagccaactgaactttggtcctctgcaagagcagagaggttcttaatatctgaaccatcttttcagcccattttggcccatatttaggttagatgtctattgttccagcattagtcattgaaaagattaccttggctaacttctttatacattcatagactttatgtgaatttatttctgagttttctatcctgttccatacatctacttgtcttttcgttgatatgtaccatcttatcttaacgactatggtgttagattacttttgaagtcagagagtgtcattctacccccgccccaatccttcaatgctaagttggttattttaggtctttgtctaaattttagaatcttttttctttttattttgagtcagggtctcattatatagccctaattggcctggaaccctttgtgtaaaccaggtttgccttgaactcacagagttctgcctgcttttgcctccagaatgcttggattaaaggtgtgggccaccatgtgctggccttagaatttatatttgatccagaaaataacttgttgaaatttctattggggttatgtttaacatacagatctagttggaaagaattggcatgttgatccttcttattgatttactgcacattctttgatatttttcatcagagttttgtagtttcttttgtatagatcttttgcagatttttgttagacttctgcctaatcatttcatggatttggtgctaatataaatgcatcatggggtttgctgttgttgctgggggaagggggagtttagaaagggtctcattttagtagttcaggataatctggaactatttaggtcaagatgtactcaaaatcatagcaatccgagtgtctctgtttcttgagtgctgggattgcaggcagaagccaccatacttggattggcatcatgctttaaatatctaattaaactttgttgttggcatataggcatgccattggctgttttggttaaccttgtatcctataaccctactataattgcttattagtttcaagagctataaggtactatgttaattctactcttagtatgttttccctctatctgttggatctaagactagcaatggtaacgccatttcacagtcccaatctgtgttttgcttcatctgtattaaatttttctcttttgtcctctaaggtggtgtgaggacaccatgacagtcacagtggtttatgataactctgaggcaacagagctctgtgctgctcagcacctctacctcaagcctatagcaaaattaatgatcaacgtgttgctcccagaatgtatagaacctgtgaggcccttctctaactgggaagttcttgaccaactgaaaagtctgatttgccctgaccagtttaccacagtgcgcctctccaagagtacgaaagacttcatccgatttgagggtgaggctgaaacacgaagtttggttcagatcctgaaagccaagttacatgggaagatcatcaagcttaatggtttgaaaactgacttaaaagtagtagcgacagatgcccagggagagtgggaacacttcccaaaagagaaagaggcctcagtgattgagggagctgaagaacaagaccatgataagggccctgattctatctactttgaaggcttgccctgtaagtggtttgcacctaaaggctccagtggagagaagccctgtgaggagatcctccgagtagtctttgagagttttgggaagatcaagaatgtggatatccccatgcttgacccctaccgagaagtgatgacaggtgggagctttgggggtttgaactttggcttgcaaacattcgaagcctttatacaataccaggagtcaactgactttataaaagccatggaatcccttcgaggaatgaagctgatgcttaaaggagacgatggcaaagctctggcatgtaatattaaggtaagaaggatccggacttcagttttcactgttccactggaaagaagcatctaatttaaatgtatttagattccactaggctctgatcaatcagtgatgcagagatgcatgctatcatttatacatgtatgtttaggaagaaacacaagcttaatgtgaatatccaagcttctgaaagcaggtagcccaccctctgtgattttaaagtgctggttcgtaccatctgggtctctgcccaagccttgtgaggtcattaaaggattattcatgcctcccatggaacaatttcctatgcttgttgtacttgacagttgctgtgagagggagtcatgaagtctgaaatcacaaggagagcacttctctccctcattcccttgaaccaaaatcctaaaggcccgtgtcttttgctttcaaaaccagcctgtctatgtaggcatgccatgctacttcattgatgtctgggattgctttggtcatcttcctgctttatttaccctcatcaagatttatttcaaggcctggacacatttagacttaccaaaatggaactattgttaattttctataatatataagcacaatataaaaaattggaaaatgtacacaattagctaatacctaaacaatatacttcttttttcaaaaaaagcaatggctatttagcaaaatataaggtgccaataaaatatcaaaacattggaactggagacacatcttctgagcatcttggagaggatcgaggatcaaggatcaaggatcaaggtttggttcccagtacccacatggtggctcacgaacgtttgtaatacagttccagggtatctgcagctctcttctggcctccgtggttaccaggcatgcaggtggtacacaggcatacatgcaagcaaaatacccatacacataaaataaaaataaaataaaataaaataaaacagtgtcaaatgctaaatgagaacgcagttactaacagacataaagctactttatccattctgggtttgactactaactttgtcacataaagccacaaataaattgagccttctattagatatgggatttacaacattaaatactatattttcagttaggtatggcagtgtgtgtcttttgatgtcagctcttacgatatggaaacaggaggatcaggaattcaagaacagcttggactctctgagactcaagtctccaagatcataggagttggttcagtgggtgtaactgagctttgggcttgcctagtatccacaaagccctaggttctgtggagaaatttgtggggattgttatactttttagtgtccgaacttatgataatgcagtttgttgcttttttacttcttttatatttaaaatacatagatacaaaacaaacatgcacatatacaaacatagtctgtctaattaatatatatatatatatatatatatatatatatatatatatatatccacccaaatttctttattacttcattcctgttctgacagttttaatgttcttctataggctttataagtgtgtatttccacagtaattataattaattcctgcatctcagaaatgatttacaataagatatctttaaaaattaccttctatattcgtcactctccaccagaaaatctgttgctgaaatgagcaagaatatagggaactctctgacaggcccagagaaatctgtaattgaagttacttaatatcccaagattttaactttctgtttatacaaaccaaaggacccaattggctaaaagttatagttaataggaggaaaaagacagggcgtttaactaaaattctatatctcaaataaaaaaaaagcccctctagtctagcattaaattatattgggtatatactgccaggatagcttctaatcatatattttaataaatcttgtaattgtttcatagtttaattgattattagtatgtttaggggaaaataagcactttgtgttaagaaacaggtatatacaaatggatgggtagttcatttatgcatgtaattaactttagttttattttgttttgagatggtgtggttgcagcttactccgttgtagcttaagtctagcctcaagcttgtgaccctcctgcctcactctcctaaatgctggattttcaggcaggtgttaccacacctggcatgtgttctcatttaaatcctgcaaaaccctaagagcgcaatgcaggcacacacttagtcacgattcctattgtgatgaacagatcagtatagatgcaggcagtctcttaaatgtgcaatttcaggccatttctaatgggaaaaacggacagccttttcaagctagaaagaaccaaagacaagaacagtattgaaggaaaagaatagctactgttttgaaaaggagcaagatgtattataaaacacacacacacaaaagcgagatctgcaggacagaaaaacaccatctttaacaaacaaacaaaaaaccctgataggcagagggaatctaggccacttggaattgaggatgcaccacacagacacagagacagcacaataaactgtcctcacatgggaaatcagcaagacagaattcataaaagtcctcatgcctacaacaatatattaatgcacaagatagcaaaaatgagtctggttttcctccttgggcaaggcatgaatttatcaaacttctgttaatacattttcaagttttctttgctcagtagcatatgctatacaaatatgctggtattttactgtaagacttttggttcttgtctcaaatcgctgacttggtttttgtatacaccatgttatttccattataatgcacttactatatttctagtgattcactttaactaacttactgcattaatagcttcttaattgaaatgaatattttactactacagtaggatgcattgaacttagcaactgaagcacagtagagtaactacatcatattgtttaatttcacagctatagaaaaacgtttgcctttaaaaatacaatcaagatgagactacatagtttatgaacagtgaaatactaggaaacagtggatgaagaaataaggtcatttttcatccatgaccataattttgtctttagaaacctggaagaaaatattgtggtaaatctagtcatttagttgtttcttcaatctcatgagttactgaaataagtggtactaacgaatcaaagttcttttctgggccaaggtaggcaacaacggccacatagaggatttcctcataaaagtcctctttgaaggtatacatgatatgtgattctctggactttttcacattcctacgctatgggttccagccttgtgttcaccaccatcttatgggcattctcacttccaacaccagagaaactataataagtgccagtggaccacataaactggaaatttgttctggaaaaaattagctgtggcgacacccagctgctcggagctacagccgaagccttgcatcacttggcctaggcagaagtacagcagcctttaggcactccgcaggcttctggcaggtttattgtgaaccatcggctgggagcaagggctgtggcctgattcacacatcccatggaaccaataagctcagtcccctggaccggctggggtactgaagcaagaactctgcattttctgcttggttgtacggtagcttggcggcccaggtatcaacacatgctgatccgagtagctatctctaaggaggcacatcgattatcaccctgaaggcctaacccaacaatggaaaagacacagctagattcttctctaagccagtctttggcgttggcatgaatttgcattttcagtttcatgtgtgtgtgtgtgtgtgtgtgtgtgtgtgtgtaactacttgtgttaaaaggaaccatggctgtgaatgtattgtttttaatgcatatttatttgtttatttactttctgcagcactgggcatgcagcctaggattttgctaatgccaagcaagcactctaccactgagctatatccctagtccacttgggtatatttcaataactagttttcctgtttattatttttgtattcatggtgctaaggatgaaactagagacctcctgtatactgatgagctaacagagcatctgcctcttttagcctatgagaatatctccttatcccacttgcttattatatttcaagatatgaactgtagttcatctgatatcttattaggttagttttcttgtctcttttctgcctaccctattccgtgccatgcttattatttttatcttttctgacgtaaacaacatcatcaactcatcaatctggttgacctgtatggcttactagaggtaatatatttctcacctgtgcctagactgccctgggatgctacccatggccatatgtaaagtaggctcctgcacaaaacattgaaggcgtaaaagtgggaggggcatacattgggaaggaggtggggggttgttagagtgggagggtaatcagagagggtaaggagatgactatattcacaatacagtgcaaacatgtatgaacttatcaaaaattaaataaaaataaccaaaacattgtgatacacttaagtttagttgcatgaaagaactatggtaatttgatgttgtatttcaaaggttttgccagagaacatcctagtgcctgcaagtaccattcagcccttggcccataagcaacagagcatcatggctctcaaagggcatttcctattcgtttggttttcaattgctgtgcactgttttcgcttcctctctttcacctgggatccatccagtccattgactgacaagcctttctaagaaagctttgatttgttttgggacaggttatgtttgataccaccaaacatttcagtgaaggagctatacagaggaggaatcaggaaaggctaaaattacaggagctggaagaagagaggaaaaaagaaaagaagagagaagaggaagtagctgaaaggtaagtgggctgaattttagcaatgaagaaggttttcctttggagatttggactaattcatttgggtgaatggctagattcggtagataatatggggcaggctttggcacagatcaaaaactctatcaaagacagtcttacacattgcagataatgaaataaagacaatcaagaaaccagaaaagcatgcctggaagtgagaacgagtaagaaggataatgggactggccagattaagaagtctgggggaaaggatttttaactgagaatgaggaatgaatgaattaatttctttctctctctctctctctctctctctctctctctctctctctttctttctttctctttttgcagtactggggtttgaacccagggccttgtatttactaggcaagcatcccatctgtgggctatagtcatgagctgaaagtttatagtgataatccaaattagaaattgtattagtttgctaatattacctagactgccaatttaaaattaaaaactaacttgggaaagttttctgtcctctaaaatgtttgagaatcaaagtaatccagacttgtggatttgttgggaccatccttcttcttgttggccagaattcttactgtgaatttggggtattctattttcttccttcagtctcaccacattatttaccagtgctggggcttcagcctagctagctagattatttgcctacctaggccattgccgaacatttgccaaaaaaggacagacaccagctttatagggctctgataacccagttttcacctcctggccccttctcttttatataaaccacagcattaaaaaatattaagaacactgttccatctctctcttttttgcctggtcacatctaggaaatttggccagagcttctgccatttcaaggtactattctttatcaaattccaagccaaacattccatttagataatcctttgtcctctggctaactccagatccaggtaatagccctttatttcttctcacattttcatgaggtgataactgaatttatctacttcccttagccactgtatcctttctagcattagttgttatttgttttctttttaatagccattctgacagaggcggaatgggttgttagtggagttttaagatgcatttaaagtgtttttatgtgtgtgtgttgactacatgtactatgagcgtgcttcatatctctggaggccaaaaaggatgccaggtcctcttgagctggtgttatgggtagttgtgatctgccatgtgggtattgggaactgaacctgggtcctctgcaagagcagccagtactcgtcactgctgagccatctctttatccggctcttagtgtagttttggtttgatgatgatggttattagacattgtttcatatgcttattttccatctgtactccttttgagaattgtatattagtgtgtatgtcctcttattaattggataatttgattttgatgggtagtttttaaagttcttcatatatcttatatattattaactcccttgactacatagctggaaaagggtttcttctataggctccctgtttattgagaatatgtctatatatacacacatgaacatagaaccttagagtaaagggggaaaacagaaaggccaataagttacatttttaaaatgaggaggctggagagatggctcagtggttaagagtattagcccctcttccagatgttctggacccacgtagtaactcataactgccagtaactccagtcccagggaatatgagcccctcttctggcatttgagggcaccaagcacacatatgatacacaggcatgcagacaaaacaccatacacatggaataagtgagtaaatagtgaaaacctatcagaacagattctttctggctaggtggaggggtgtggtcagttaaagttgaagtctgtcaaggctcagttgttcattggatctacattcactttaggggtgtcccttttttgcttatggggagctatttctgtccactttgcagtctgtgtactgggtagattcgcacttgctctagaaactttttttttaaagatttatttattattattatatctaagtacactgtagctgtcttcagatacaccagaagagggcgtcattacggatggttgtgagccaccatgtggttgctgggatttgaattcaggaccttcggaagagcagtcagtgctcttaaccactgagccatctctccagcctcagtctagaaacttctacttgtataccccatgggggctaatatccaagccaaggaatgtcttctgtgttgcccagtggggaagcaaacaaagagctgagatccttactgatgtatgggtctcagcactttcaaatcatgtacagcgttaaatgtcctgtaaaaggagggatgctgtagaaaattgagagaggcccataggacctgagcttcacggttctcagtcctgctagccggccgaaacccatggctgagagaggtagcccactaacccaggcctgagttgccacagttttctgcaggtgatggagtctaccccttttcacaaagggtgggacccaggacccacccatcacaacgtttttttccagtcagagcctatgtgctgcctgaacttctcagcatggcatatccagtctcaaatgaagccttccaaattatgaggattattagtatggattttgtctttactaagtatctggtatgcaggagcaatcactgtcacactaaatccgccccctggatttaaggcttgtgagaactatggcatccttctgtgactgttttaccagggcacactatgtctgggactcccggttccccccccccccccccccccgccagggaactgggcggactggttttgtggcctgtttgtttttctgatcttttcagctatcctagaattagttttgtgagttcagactatagcccttattttttttttctttttaccttcagaatagaatctgctactcattttcttgcctattcttcagggcatcacataaaagtaccagagctctctccccttcccttctttctgtccttcctcctgtgtctataaggtatccgttatatatttgcattttacacacaaaattatgtcttttcctttgactgatgttctttttttttattttagggggcatgtgttttatttcttttatatgtatgtatatatgtatatatgtatgtatgtatgtgtttgcgtgtgtgcgtgtgtgtgtgtgtgtgtgtaggccagaggacctcagttgtcattcctctgatgctgtccacctgctttgtttttgtttttgagaaaggatttttcactggcctgtaaattgctaaatactctagaccatctggtcagagtgtgccagggatccacctgtctctatctccccatcactgggatcaaagtgtacacaccttgcttagtcaggtccttgtatgcacaagacagtcacattactgatggagcaatccccccagcccctggttgttgtgtttgtttgtttgttctgttgttgttctttgtttttaccatgagttgtcaattccaggtcctgaggttatcagacctaggtttctggaagcctaaatgattattagttcttctgggtggctaattattattgcttgaatgaatgatgaatcttaattgttgttcagaaaaagaaaagatgaagtaaggaaagcccaagaaaagagaaagaaggccagggacaggaggcgagccctgaaggaaagagacagacaccgtcaaagaaaggaaaaagtgaaaaccaagcctgaggcccgtcaggagctggactcttcgggagagtgggaggagcggaagtacttgctggctcggaggcgggttgaagctcttcggttactccgggtactcctgaagaaaattgcagtaaggctgtttcctaactattctctttagttttggtaggtactagtctttctgaggcctagcctttggttttaagtattgtcccaccaacaatgaactgcgcggcatgcatagacatttcctttaaatcgattgctctcccttaaccccaaccatgggtttctaaaaacagtctagtgccatctcaactcggtcctcacttcccgtgtttaaacttcagacactttagctacttcatcttcttgtttgtgttcctataggatatgacagaaaaatgctagggggacacaaagggtcggtgtggtgcaggtgttccctctgtagccttctggtaacttcattcatccatctgtccgtaacaggtttggatgagaaaagagaagaacctcaagccttgtcaaacacacattagccttctcttgaactgtctggtaaggattttttaaagatttatttattatatgtaaatacactgtagttgtcttcagacacaccaaaagagggagtcagatctccttatggatggttgtgagccaccatgtggttgctgggatttgaactcaggacctccagaagagcagtcagtgctcttaactgctgaaccatctctctagccctggtaaggaatttcttacctcacagatcagttatcttcttcacagatttttttcatttatccaaggatttttatctgtttgtgggctcctagagatagccagaatcagataccttgaataatagccagagatatttctgaagtattcatttaaaagtccatatgcagtgatttaaataggaagaatgactgttgctgctattctagtaagccaattttgtttgttactgtggatagtgaactaactataggtcctatggataactaaacttggtaaaagcaggatcagaaaaaaacccaacaatttcatacttggattattgatggcaagcccagctagactggtttttggtttaccttaatgatgctcaagtgtgatattcttctgtaaaatctacctctttaaatgggtagggagcacgattctgaaacccattaatgcttacactgattacaagttaccagggaggtgctgtgctctgccgtgtggcagacctccgtgggaatacacagcaaaccttcctggggatgggtatgtgggcatcatctttcccttactctgcagctgtgtagaacaggttgcatcagatttgagcacaggcaaattcatgggcacagtgatatttttctacttgttgtttggcttttcttttctgacttaacatgcaaatgctataccactaaactgcatctttgttccctgtgtgtttcatcttaatgaggcaggccaggtggctcaactcggagacatcctcaacttgcagtccatagagaaagattggagtatgaaatagagggacagtttatttagtaagtcagttgaccttgtgggacttgtttcacccacatgtcttttcttgtactagggtttcctgtgaaggctacagagcattccttattcccctgtttccctagtacctattggaagacttaaaactgtaggcttgtcaagttttgagcaactaaaaagagtaaggtgttttaaatgccatggaatggtcacaaatctaataaaaattgctcttattagatcaaaacattttaatttagtagtttcctcagtatagtattgcttctaatctggacctatcttgttttattgtttgtttgtttgttttttccagagcagttttctttgtgttttgttttgaatttttatctacatttatttatttgtttgttttgtgtgtgaatggggatgggacacatgccactgtgtgagtatgtgtggctatcagaggacagtttgctgaggtcaggtctctcctttctcacatataggtccctgagttggaactcaggtcattacgcttagaggcaggcacctttatacctcctgagccatcttgctggccccatttgagttttcatgagagatcattaaatcttatttttttccttaaagggatccacacagtgtaatccacaggaagttggtgttatgaagtccgaagctcatcataccccagggactgcattgaaatcacccgaggaagaagaattaaacactcggcatcttctagattgggaagaaatgccaagctaccaggcttccacacttgatcttagtcaaaaggcagagaagcgatgctatcaggcttccaagtctgacaataaacaaaaacaaaaagggaagaaaaaaactaaggctcagttacagaaatcttcacacactcctggggtgaaacaaatgagacactcagctagaaaagaagaaactggaaaagtgttaagtgatgggtgtgattacagtttggtctctgaccagaattctttacagagtacaatgattgcagatcagtcccttgcaaaggaagaccacgccagttctaatgaatcccattcttctagacaagctgtgatcaaccgtggcaggaaacagaagatctatgaaacagatgaatttattgactacctattaaactattatcagactccagagtatgcccgattctgtcttgaagcaagtcacctaacaagcacatgtcagtggcagagagatgtctacgctaagggggatggctttcagatctatttaagaaaacaggggtaccactcaaacagcctgagtgaagaggagagcctgcaagggatagagcaggacgaagagcaggactggccacaagtgtatattaaagatcctgagagtaagtcgcaaaagacaggcaagatcaattatgccaaagaatttacaaagaaattaaaaaaccattgcaaggacatagcaagtgaaactgatgagcacctgtctccaactgatggagagagctatcctgtggaaaagattcacagtcacggagtcaaagattctcaacacataagaaaaagcccagtttcctcatcattaaggtcagtagatgtaggtttgccattggcagacttcttggaggaaattagtagcgattctgagtgcttcagtgaaactcttagcatgaaccaagaggaggaggaaaggtctatggctgtctataatagctccccggaaaaaagacctcttggtactgacaaaatcagtacttgcaaacagaaaacgaagtcgagtcagcagaccttgtgttcagagtggaaacatgacaatgagggaaaatactctaaacacagagttagggcaccaggtaaaaggtccaagtctgaactgagatactcgtggcttgaggaggaaggtgattccattagagttgacaagaacataagcaaaactagggggaaactagccccgaaacacatgcttgatgaaggccagtaccatgagtccagttccagtgatgaattagaaagcaccacgaggaagaagaggagacttactagcggtatgtttgaccagaatgtgaaatacaggccccttcatatgccatcaatgccgccaaaacgggctagagcattctatttgggatatttctccaggaaaaggcagactccgtggaagtcagaatataaccaggatgtaagaaggttcaaaagatatgaaaattctgaagattacacgcttgattctgataattactatgtcagtcacgatgacaaccaggagcacattgagtatggaagctacttaggagacagctactctagttctttgtattttaaaatgttctgacggccactttgagcaggaacacccttatttacaagaaacagtggacgggaagaaaaacttcaaaccaaatatagctatgttgttagcaaccacagtgcaagacctagaagagggttcaagtgcaaaagcttgctcctcttgccaaagttccaagtgtggatcagagtaactgcaggtatgtcagcaagctttggaaatagaaaacctgtaaattctaaagcttggtgaaacaccgtaattacaaaacttcttgatccaaggacagattttacattaagctttaatttggtgccagtaaaggagcagattagcattaagatggctgacttagccttcgatggctcttttgctgtcataacatcattcatcatctatcttcaaagaggacaatagtggacaaataggcatcttttgatgtgttcgtagattgggtcagaagcaccatgtatggtaacaaactttgctaaattttactccataataattttagataaagaagaaatccagaggttagaacatataatagattttatgactagaatttcatgaatattcactggaaggaaatgaatatattcataatactcaaagggtcatttatgtactgacagttctagaagaagaatctaaaagggctgattgccctttgacagctaagtagctgggactgtttggagttttcttgtttgttttatggaccccatatgtttccatcaaagcaccaggatcgaatttataaaatcagggggatttgcaaaggaaatatcaaaacatcctggcacatcaataatggcacttgggaagaaaagttgtgacagtattctatttcaggctctgtaatcctttcactcagggttgggtgacatcagtttgtaaaaagtcactgactatcccccacactgacttttatagaatagtaacaagtgcctccttcgtccttaacaaagtcatggtgttagaaagacttaagaaaagtccacagttttctagctgtggaaaaattgtttgtgtgtggaatttgtaagcgatgttaaataagtgatttatcttttttgctgactcgttttggacttcttaaatgtgtttttaaattgagatatttgtagattcctgaagacttaccccttagcacagtgcatgctctgtagaaagcttggccaactctttctgccttacattggattcaggacctcagggcagttagttgaccttcattttcccaacaaagctatacccgacctggcaactggctatcagtgaatttagagaccatctgcaacaagaatagttgtttcgaatccgcagaattggtgaagggtagcattttcatgacaatttcagttcagtctcaatttgacattctacaggaaagcatctgctagcagatgcaggtaggatgtcagtctgtggggttacttactatccttactatcgtgtcacacactgagtgcccctaaactgcctcttgagcagcctggtgtctgcagtggttgtgactatggtgtacctaaaggagaagccacaggttgtttctctgatctgcgtattcctctttgaagagagattgttcagtcacttcaaagttcagaaaggagtgaaacagatccacatggattactaagaaagaaacaacctcactttgaagccagtggttggtttcactattaaaactgggtttgacttactgaatctgaaagactgcacatgtggtgagagtgccttttttgttttgtttttgaggacgagcaatgactattcatgttcaaagtaatgttgcccaaagtagcctttgaaagcactaacagctcatatcttgtcagagagttttctggcaacacattactctcctccaattaaaaagctgcctcctttccctcccccacatgttattctattgaaacaaaaaacattatgggtttgtaatagaaagcagctgactgttttgaaacaaacaaacgaaaaaaaaaacccactcagtttcttccctcatttgatgttgtttctcgagagattttaggtatttttgctcggtaagaaaagacaataaaattgcagatctcagcagcatgtgcaaaggttgggatttctccctgtgatagacgtggtgctaagtcatcttgattcagcactttcgcgctgtttctttgctaaatgctttcctggggcctccaagtaacaatactgcttttgctgaaccctggagttttgtacccgtctgtggtaatgcattgtagatccgtgtcaaccccttttttgctgtaggccttacccgagaaaggtagccgagtaagatagcttactctgtgcttgtcactcggcggcttagtaaagaatgtaacgggacaaactgctatgactacttttgttcttgatactgttgttatttaagttgtgaagtgtgtttcctcatatcttctttttgtcccatcaaacaagggcctgacgttgttttatttaaagaggggtttccgtgcgcttcccttgtatgtgctgctaatcctgtaaagggaaagtctgctaagtgctttgttcatttgtttgaatttctcaggtagaaggccatgtaacctaggcattttgaaaccacaaccaaatcaatgtgtttttgttgcaaaactgttcaatgtgtgaattttaaaataaatgctcattgattcca

SEQ ID NO: 703 - DNA, 37109 bp, mus musculus
aagggggcggagctctcgaggggagtcaattggtccgctggagcccaccaagggattggagcaggcaggcgtgcaaacctgcaccctgtagcccccagccaggaatcaggaggcagccacctggaagctcacggggcctgcagcggggcgaggggcgctcggggcgttggcacgagcgcgcgcgcctgcgtcgccttctcggatgcggcgaggacgactctgtgtcgcgacctgagccattcaacagctggcctcgcccgcggcggtggaagagagcgaccaggagggttgatccttgacactgcggcggctggagggaggcggcggcaggagcggtagcggttccgctaccccagcggagctaagcgtgaaggtacagcggctgctgaggctcccgataacacccccccccccctttctgagaatcgaccaggcggctgcgtccttctgcgtcccggttggccggccgccctggcctaccggagtcttgggtgcctgggaggcagggccgcgttggaccctgagtgaggacttgggaggggttttggagagaacccaggtagccaggcctgctctaggtggaaaccaggttttctagagatgcccctaggctttcccccttggatccattcggctgctctcttgggtcttggtgccgcactagggggcgctgtggccgctgctgcagctgaggtcactggaagcttttccttagggtgtactagattgcttaggaaagctgaaggatgccctcctccctgctgtatgcaaaagccaagggctctggttctcaatctgcttcagtgacattcattccagttaaccactacccagggtccgttgcctctgcccactgatgaccaccaagggccttgtgaggttcctaccgtggatggaattaaactgcttctaatttgacccaagaaagcagggtaaacctctaagcctttggaatgcatagtcttgagctttgagtagatgggcagaagtatcagggaagaaagcaagttggggagcctcatgtcttggatactgctgtctctgagcatgttggtcactgggactagtaccatttttacatttatcacctgcttatgaaaccagtcactacctgagcacttttgaatgtcactaactctaaacatgtgttgattggaaccctggaactctgaattgcagtatggggactacctgggtctttttatttcccacagggtttcaaagatggtacccattttacctgatgttcttcctgtctcagatctacctttgaaacctcatactgttgaaatactgtaagattgtgaagtataattgatagggatgccttttcaattctgaaaatgtagtggggatctctcaaattcagttttttaaaagaaaattttttttaaagcatgtgagattctggtagccacacatttctttcttttttttttctttttcttttttttttttttctttttggtttttggagacagggtttctctgtatagccctggctgtcctggaactcactttgtagaccaggctggcctcgaactcagaaatccagctgcctctgccttttgagtgctgggatcaaaggcatgccccaccacgccgggctggtagccgcatatttctgtgttctattttttattcctgtgtggggagtgtatcctctcaaaaggatggagtaacttgaagcatggggtaacttccatgaaagtgttttttacttcagttcttgtaaagcacatggaaaagtggaatgagcctccaggcactggtgcccagggaataccagctgctatacccatcagaggacggctggggctgacttgaagaggaagtataaggtagagggtagggcatgcagaaaccatcttctgcagtaggtggactcgaggtctcccatttattcttaaccaaatatcacacaagaaaagtgtggctcattggtctatttttttatatcatattcaggcaacagacccaagtttactggatccatgtgtcatcagaagaaatggtgaggcttgttgatggtgtgtgtgtattgtgtgtgtgtacacacatgagagagagagagagagagagagaagaagctctctgctgttaaggctagctatgccttttattttcccagcatgcacccctgcctttgtcagagaaaggaacttatgttttttttttttttttcagaatggaaaagaaatcttactttaattataattatagaatccttttaaagaaataatattttatttttctgttatttgctttgtttgttttttgttttttccagacagggtttctctgtgtagccctggctgtcctgaactcactttgtagaccaggctggccttgaactcagaaatctgcctgcctctgactccaaagtgctgggattaaaggtgtgtgccaccactgcccggtgaaatagtattttattaatcctttgagaatttcatacatgcatatgaagtcttttaatcatatttaccccattattccctcctaattcttctcagactcccaacaccatgttctcttaaaaaataacccatagagttaatttgtgctgcctagatagtcatggcttggggaccatccactgcagcatgcaggacccttaacaaaagctgactcttccttcctcagaagacattaactatgagtagtggagagaagagttttattggtagtggtattttaagaattcagattcaatctccattcaggtttacagatttttttgttgttgttgtttccaacatattcctggctttttaagaagcttaaaagcttagttgcagttggaggcaggtcacagttgaagtcaacatggtctacatggaatatagggagcatttctcagaagagacagtataaggactgggacatattaaggaagtccagtgaaaattgagtagtagtagcggcaataataacaatataataataataattcaatgcttttggggctaagtatttgctcatctcatgtgattcttcaaaaaatcacacacacatactcagaaagagagagagagagagaaagagagagagagagagagagagagagagagagagagagagagagagagagactgggcatgctagctaatgattactattattccagcactcaggtagactcagaaggattaaagtccttcttggctagattggaggctagttgagctgtatgagaccctgtcttaagtacacataaaagataagaaacaggaaaccccctgtaagataagtactggtcactattaggggttgagtatctcaaatccaaaaatctgaaatctaaaacactgcaaaatctggagccttttgaatactgtcacagtagcacaggtggaaaagtccacgtatgtcctcatgtgctgggctgctgtaaagaagctgcattaacaatattgtataaaattaccttgaggctatgcatacaccatgcatgggaaacatgaatgagctctgtgtttctatctgggtttcaccctcaagatatcagctgggtggtggtagcgcatgcctttgatcccagcacttgggaggcataggcaggtggatttctgagttcaaggccagcctggtctacaaagtgagttccaggacagccagggctatacagagaaaccctgtctccaaaaaccaaaaaaaaaaaaaaaaaaaaaaaagatatcttcttctatagagatagttgtgagctcaaacattttggacaagggatattccatgtggatcttctacagtttaaacaggtgacagacccaagaaaatcccctagctacttgatggcatttcaaaccagaactacttgaacgcattttggttgttgattttttttttctgccactataaaggttccatgaagtagactttgaagggtgggtaaagtttgtatgagagggcatatttggtgaggggaatcttcatctttggaagacctcaaagaagtctggatcaactagaatggggatatgagcatagagatatgatacccactaggtggggctgaggtggggagggtcttgtttttaatgccttaaggagaatttgtggtttggtgtaataaattgagcctgctgagaaattacttatcttgagtgtgtacatatgcacatgtcacagtaaatgtgtggagcccagaggacaacctcagttatctgtcctcacctctaccttgtttgagatctggtctttttgttgttccatcctgggcatgccaggctagctagcctgagagcttgcaggtttatctcactgcaggtgcactggaattactgacgtgctgccacacccagcatcgcgtgggctctggagctccgtcactcgggtcctcacacttgcctggcaaacgctttctctactcaccgagccatatcttcagtctggcatattcataatctctaagcaagaaacaatatgacagaagtaaaaattgtgtgacttccctgggtccctgggcctatgtctctttcctctttcctcttttttttcctgaggatcttgttcaggtgtgagtgtacttaattattgtttttgatctctctaaacccctagggagtaccaaatgcatgcaactgagtagattcttgggtctactgtataggaaaaggaagctaggagctttgtgagaaaacctgcccctaatgagtaggctttagcctatacgatttgatttctgttttgttttatgtttgagacagggtgttgacatgtagaccaggctaggtttgaattcacagagatccatctgcctctgactttcagtgttgggatttagggtgtaagttaccatgcccagcagcctgtactacttgaaaaagcaactgaattgggggaaggaaggtcagcactgaaaaactgatgatctcagtaaaaaccaagacctttagcttatcttgcaagtctcaaaggcctgggtgatctcacacacacaagactgagcttcacagagtgaaccccttcagctgggtctctgcattgcctttctcgtggccctggagtctctggacactcgtccgagggaaccaagccctacctagcagattccaattcaagattaccctcttgcctcactgtgcaatcaggaacttgccagccgacttcccatagcactatccatgtggaatgaacatagtcccagcttgctggcaggcggcatatttcatcatggaagagctgtctgccaggaactgagcatcatccccaggcagcttcttttctcgggcctgggactgaaagcctgttctattatgacacattctgttgaatctttattcttttcttagacaccagttttctctctgctgtatactgaatgaatataggatctgggtcaaaatgtaaaaaaaaaaaaaaaaaccaaaaaaacagttcagggtaaaatacagaaaaaaaaaacaattaaaaatgtaatgctagtttggaggggggaatgatgtaattatattataatccccccaaaaagaaccaaaatattttaaagaatagcatgctcaaattattaacctagaaatctctgaaagcatttaagtctttttgtgtgtgtatgtgtatgatatttgcatatgttcatgtctgtgagaggagagtacgtgcatgccacaccacagcacacatgtggccgtccgaagtcagcctcgggtatcagtcgtcagcttctaccttgttttaggacagtctcatgttattgagtattgcatttgtcagagtagctgctccgtgagcttttgaggagtctcttgcctctatctcccatctcaccacaggaatattggagttgtagacacacagtactgtgtccaggtatacatgggttatggggatctgaactcatatccttgcacttgtgtggttgccacttgtgtgctttacccatggaaccatcttcctagacccataccacactctgtgttctagctaggtataagccatttctgtgttagcactgaacaacattatacaagtctgtccaggaactgcagggcatttaacattagtggcccctgcttaccaaagtgatgatgtgccctcctagtacaactgttagggcaagtaaaattgctctcctgcacataccattgctcttgaagggaacaatagtgtcacatttaaaagctacaaagaacattctcaaaccatctagcatttcatgtggagaaatgttaatagcatcattgctaatctgtggtgcaaagtgttctagtcctcttatggtgttttctgcatcaggttccagttactcgccctaatttctgtctctttttgactcaattcttcgagggtaagctcattataacacaccactccagctcccaatgtctagcggggtaggtgattggtaggtacacctgaattactcccattgttcattagtgttaatagctctagtctaaaaaagcgtgttagcctgcattgctgttgcaccattggtcttgagatgctggtgtgggattctaaatacagaactaacacctttggaaagaagctgtcaggcaaagtcgctgtttaacttagctttggccctattgagtttctcctgcctcccagctgttctaggctctggggtaatactgatgaagcaggcatacattccatgctcttaggacactcgaggggatgaaggaaaggggctccgaacacaagttgctaacgatgcattgtgactaggtggctttgatggtatgagaacagtgctcttttaactgttcagggatagcatctctgaggaggagactaggcatttgagtcaaatcggaaaagcaaaggagccaggcaaatcataagcaatgtgcctaatgtcttgtgtccagtaaagaagccaagggactggggtggagaggaaactcagggggacaaggaggtggaaggcatcgacagaagcaggcagaaggcacattttgaaggtaagaagtttagatttcctttaaggcatggttggaagccactggagggttttgagcagatatctaacatgatccggtttagggtattttaagtcagacatggtggcacacacacctggttccagttactcgtcctaatttctgtctctttttgactcagttctttgagggtgagctcattacaacatttaccactccagctctcaatgtggctaagggagtaggggattggtaggcacacctgaatcagtcccattgttcattcaacactcaagcggcattcctgtgagcagaagggttgctctgagtttgagcctgggttatactatgaattttaggccagccttggctatggtatacatgcctgtctcaaaaaaagtgaaaatttttgttttaaatcatgttggcacttatctagggtaaggatagaagaagaaaggctagttaggaagcttccagaatgattcaggtcagggtggtagaagatcaggcctaggagagagcaacaaatgggcaatgggtttagaatatatactcaaggtgaagggattgaaatggagaaggtgagagggctagctaactcctaggttttcagctgatgccatgggtggaggtgcctagacttagggaaatgaaaattattgggtgggaaggagccggtgtgaagtggagggcaggattgggggatgggaattaggcgttcgggtgctcttgttttgctaagatgccaaggaaaagtttcactggagacaatgaataggcagttgaatatgcatcttaggttggcagagcttgagcccacatgaaattaaatgcaaattaaaggtgctttggggtgtcaaaatatactagcatagacatcacacctaaaatgataataatccagagtgagcagggctgtaaaggagtcaggcatggggattctgccgatggcctgattctttgccttaatgttccaggagaccaatttgacaataggtaaggagctggacacgattattcctgacctttgacatagcatattttgaaaaaacaatctttaaaagctctgcacagagcttttcatgctaagtgtacattctaataataatagtctagagtaacactcttaaaaggggtagtgtgtccttttaggaaaagaaatggagccaggcataacagctctggcctgaaattccaagagtttctgagggcgaggcagaaggatggtgagcttaagatcagctgggttgcatagtgaagtccaggctaaccagggctacatagggagactctatggggaaaagaaatgcacacacacaagccctaaagggaaggaatagctaaccattctagtttcattctcttgctgtgataaaacactatgacagacagcaacttagaggcggaaagggtttatttggcttctacttccaggtcacaatgtattattgagagaagctaaggcagggtcccatggcaggaatgtgaaacggaaaccataagtgaatattacttgttaactcacaagcccatgccttctaacacagcacaagccctatcgcctagggatggtgctgcctgcagtgggctggggctccttgcatcaattagtaatcaagacaaaccctcacgtgagtgtgagtacaatgcaggcaactcctcaattaaggctttcctctcaaatgactctaggttatatagcaaattgactgtcaaagataattaggatactaaccaaagttatagtaacccccatagagaatctccttgtatataattttcacacatcaatatctgcaattgttaatcaagcaggtgtaaatcttggagagtggcaatgtgtaggtacaactgtgtaaaccttacaagctgtccatggtaaacataataaatgtgttatttatgtgtaaatcacttctttcacttttgactttgtccctgtttctctctgacagtgtcccttgcttaggatgccacagcacagtgctcgccatgaagagttcccatgaatcgtggcctttgtgatattttcttctttgacacattttctgcataaggtattgggtaatatatcctattccatgagacttggatttgaataagttcttcttggggttttataaaggttgggagacaagcgctcagaaacccattgagtccactctgtcataaaggtggtctttccccggtaggtggcgactggtagacaggaactttgctggtaattttcagaccgaagctacaagctgcaaaacactggcaatgttgtgataagcatttcccacgaataatactcagattattcaaggagtgaagcaagagcctggcagatactcagccacattcctttaaatccttgttgacctttttttttctttcctatgtgaattaatgaaagtagtaggcctacagcatcatggtaaattaatccaagatagacagcagctttcttggctggaggtgttgagcaaaggagtttcccaataaagtgctatagatggtgaaaaaatcgactaaaggacttctcagacaggtctgccagctgctttgtgcatatcgtttttaactagctgcctttcttgctatcatgggttcacagattacaacaaggtagcatgcagagtcatgtaaacactttgtttgtttgcttatttatttgtttattggttgtttgttgagacatactgtcatgtatcccaggctggcctcaaatggccttagattccctatatattcaagggtgaacttgaacttctggccttcctgtctctatctcctgaatgctgggattccacatccatgcccgccatgcctggtttatgtggttctggggatgggactttgtgcataaggaaaatgaatttgcactgagataaattaatgagtctgtttttctcctttcctgggttccctccctttccatgccctcctattctcttttgtttgggtttgggttttggttttgagtcagaatcttgttatatatcctatgctggccttgaactagtgatccttctgtgtccatctcctgatcactgggataacaagccatgtgccaccagtcctggtcagttttcttcgtttaacaattatgactctccacactgaactctgccttacagttgagtcggagtagtggtagagaagattttctcttagtattccattgctgctagtctgtcatgtctgaatgcctatggggtctctaaaatccctttttttctgtccagagggcctcagggtcttatatgagttctttcagaccatcagaatctgggaatttcacaaaaggtcataaattggctattattgcaaagctgagtgctgcttagtttaatgatgtgattttgatgttattcaaagatctgagcacatggtcagtgttggtttttgaaatgatgtttaggttagtgatgtgcccagatgtgtgagcatcttcactgaagagctctggaatatttgtatttgagcaagacttactggagagtctgtatttgccagattggccatttggctaggttggtttgacccacataaatgttggctgccctgctgacttccaaaatgtgttggtagaattttatatgtcttagatgctttcaaaacgacaacattaaggttccaaagcctggagaagaaagaaaggcaacaaagggttgctttcagaggggacttgagtttcgtctacggtcccatttcttttcctgttgttacttttttgcatgttcttcattcaaaagtccttgctaatattctgactgcaaatgcccaagagtgagaaaaaaaaacaaaaacaaaaaacaaacaaacaaaaaaaccaactggtggttgctgatgggtacttttcctatgacaaattgtttttaatctttcaaagctaatttcactaaatcaatcaatcaattaatacacgaagtagctgatgaatttctctactctgtcctgaaatgagagagtgactttggatgtcaactctgcaggaatttgttgagttggccctgctatttacaaacctgttttgggctgtgaacatctcgagtctgtttccttctccctaagttctgattctgctattatgtagccagctttgctgctaggtagagaagcaggcaagagcagatgggggaagggtagacaggctggatgagtgaaggaagcagccatggttcctgggaatctcccagagactttttaacattggaagcatgatactggtaaaaccagctggggtgatgcacacctttaatgccagcacttgggaggcagaggcaggcctatgaccttgtgtttgaggctagcctcgtatatattaacaaattctaggacaaccaggactatgtgggaaaaccctgattcaaaaaaaccaaaccaaaccaatcaaccaaccaaccaaccaagcaaccaagcaaacagcaacaataacaggatactgctagagtgcatgctgggtaagcactgtacagcaaccatactttttaaactatatgggccattgagaaaaatcatttcattctaattagcccacaaataacgacattgcatagctggtttacgttcatgctctgactttgttcagtgatggactggacatgtcagccaaacacacccgttcctccccaagttgtttatggacagtgatttatcagagcagcaagaaagcaaactagaacagatattagcaccaggagtggtgttggtttcattatgaactttaccagaaccttaccaaaatagtctctggactattttgttagaggattaaagacgatttgggcactttaaactgaaaaaaaaaagtatactcagagattaatgggctgttttacggggagcttagaagatagggacatgcaaacatgggacatagaggcttggattgtgaagttccagatagaagcaaagactctattgggggcatttgtgttatattttggattaagaatctgtgattgttggtcagctgaggctgaagagtcaggatgattaacaagcgaacagcatcactaaggtgaaaccttgtgtttcacagagacaatgagtgtgaatcagctggggctgaagaatcagttgtgggtaataagaaatgagtatactcaaggtgaaatcttctgggaagtgttttctcacagtcagaacacaaaagctgtgaatcagaggagccacattggcatctcaagccgacagatgaacttgtcagcatgtaatggtcacctatgtggttctggtttgaagggatgaatggggtcatggagagcagctgaggcttggtgtcttgtggcaggtttggagttgccccagaaagattctgagaggccattggtgaaggtgaggcctcagtggagaccccaggatattagagaattcaggattgtgggatatcctccaaggacagtggaatgtattgtaagaccccgaagctgggcctcagctcaagtcccgggatgagctggccagcaccccaatgactcgagagaaaaccacacctgatgcaaactgcaagaggttttattatcagctagctgaggacaaactccttccactgtgcagggcaggggagttcgaccctgagtggtgacagtagggggcttttaacagccagctgaggaattgggaggcgttgggaagagttaggaggagttgggaggagagttcttctctcccgggtgtccttggtgaaatttacaaggcaggagtggggagtgagttctttctgaatttttatctccgtgtcatcggcacaggaaggcaggcatctctggttgtacagtatagaaacaaaaaggctttttgctggctatagagaacaaagagcttctttctggctgtatttttagagatcagggaaaacaagcttggggaacatccaggcgctttaccttctagggagaaacgctctaagtcggggtctcacagtatgaagcggagcatgtctaagcctatcagtcaaggtgtgtgttaacagagctgaagtgaggttatctaagccctttgaagcccagaagatggagttccagatgtcagccatcgagctactctgtggctttgagtcttgcttaagtatgattactcttatgcactggttcttcctttatggactaagttcttaacttgtcttcaattttacgagagcccacagaaaagagccttgaacttttaaagcatctgggttttgtttttttttttaactctagaggacttttaacgttgtactgttttatcttaaggtattaacatgagatcttggagacaaacatgaggatgtggtttttgagtaaattggtctatgagcatgacagtgattgatgaaaaggatgagaccagtggcaattcattctactgccactgccaaatgaagcaaggtttcttgtgtctgttcagcacatgatttctttttaaatttaatttgtgtattttaaaaggtaaatcatcaaatccaccttcattctccatgcatttcccctctcatttcttcccccaaatcgcccaccaatatttctttccaacttcatgtgttttttttttttttttataaactaacctcgtctcctcagtgctgccggtatgtgcatgggtatgggaccaccttttgaataggctctcaggggtcacatctcttcaggaaagtgactcgacatctcctagaagctatcaacttctcttggctcctcagctaaaggaggtaatgatggctttactgaccaccttcccattccacgctgggcatttgtctggcttgtgcagctttcctgtgtggtatcacaacagctgtgagttcatgtgtgcaatagagctgtcgtgtacagaaaatacggtttcactgcagacattcgctacagctagctcttacaatttccattcatcttccacgacgatttctgagccttgggaggagggggtatgatatagttgtaccatctagagcagaacacactagtttcttccttgcatattaactcttcgtaggtcgctgcattaatcactatctattgcaaaaagaagcttttttggtgcaggttgagaggcacactaatctattggatataaagataagaatttaggaggcagtttattactatgttgatttaggaagcattagtaagttctcccaagtactgtgatctacccagctacagtttcttggctcagttaacagtaacaagcatggatttcagcttactgagccaaccttaaatgcaattggcaagtggtcagttaatcctagaatgttcagaagcacgtcctgcttaaacacaaaattggaaggcaaatttggcttttacagtcaattttatgtcatagcctaataacttgatttcagaaattccacttgtacctgtattttggttaatatataacaagctctatctcttcagtacagcctggtctacagagcaagtttcagggaagctagaactacattaaaaaaattgtctcaaaaaagggggtgctggggctggagagatggctcagaggttaagagcactggctgctcttccagaggtcctgagttcaatttccattaaccacatggtggctcacaagtatctgtaatgagatctggtgccctcttctggcatataagtgtacatgcaggcagaacactttatatataataaatctttttttttaaagcctcatataaaatagagattatttttaaaaagcaaggaccatgtgaagagaaagctaaaaacgtttatagacctatttttaagaatgaagtaggattctctaacagatttaattaaataaggattatcgcatcgaccttggaaccgggaaagtattctgattttgaagaaagtacttgctagtgtattaatatataattgtttaaaagaaatacatattcttaaacaggttgtgaatttgcagagagctgagtgattgccaaaggcaggaggattacaaaaaggcacaagaaaatttgtgaaaataatggttatttccactatcatgatcatggtgatggtttttcttcaagtgtgtatacgtgtgtcaagacttattaaaaacatttgttcaagccaggtggtggtggcacacaactttaatcccagcactttgggaggcagaggcaggcggatttctgagtttgaggccagcctggtctacagagtgagttccaggacagccagggctatacagagaaaccctgtctcaaaaaaacaaaaaacaaaaaaccaaaaaaccaaccaaccaaccaaacaaaaaaaccaaaacatttgttcagtttatgttataaaatggataatattatacatcaatcatgtctctatcaagcagtctttatgtcttcctggtactggggatagaacccagggccactggcatgctagacaaagctttctaccactgtgccacactcccaactcaaatcaataaagcagtgttctaaaaatcacctgcacaacctgtgatatagctagtcgcacagttgccatgtgaccctttgtttctaagaatttcattccaatctcccaggcttcagtcatgactcatataaccttcaattctggaatccgatgctagtgatggcacatagagggctgcattgggggttatgtaggggactgttgtattaattttcctagaaaagtttgtatctgcagttggcgattgcttctaggtatctgctctgtgagaggctgcttgtctaacatgtaagaggttctggattccatttctagcgcaactgaatgaatgaacaaataataagtggataaaatatgcaaggcaaaaaaggggaaattattctctacttccaacccactttctagaggaagtattgctaacaatgcgatgtatatatttccaaactttatgtatgtgtgtttgtagacatacatacgtgtttacattattctacaagtttattatatctcattttgaaaatattaatttttctgcagcgtctttcctccaaaaactatcatggttattccatcttatcagtaaatacacctccctctctccccttcctccttccttccatcttcccctgttctctttcttccccctccttgtttatttttccttatttttatttaaaaatcctttcatgcaatatattttgattatgtttcctcaccccaaccctctctctccttctctctgtctgtctctttctgtctcttgtctctgtgtgtgtgtgtgtgtttgtgtgtgtgtgtgcttgtctgtctgtctgtctgtccgtctctctgcctccctgcttctctttgtgtgtgtgtgtctgtctctttctctgctccccttaatcatgtctgaggcccccttcaacaacaggtgccacaatggagttgattgtttgcagctatgcgccagctgttacattaatttcccatggcatgactgtagcactgaaagtatgatatatgcaaaaatccaattagttggtgtgtactaggcccttgacagatttttaaataagaattgaaaattagctttctattcccagaaagtaattgaaaatgaaatatccacatgcatttaattttaagatctagaatctatgactagagaaggggcaagaacaactgtttttgttattgcagtcttaggaaaattggaatttgagaattgcagttgtgatgatttgaaagggggcatttaaaaagttaaaaattttaattggcacataattttaaaactaaaagtacaactatatgtattcaaaggacataatttgacattgcaatatatgcatgcaatgtgtaatgatcaaattagagtatgatatggccatctcctcagacatgcaccatttctttgggtggagaatatttaaaacctgacctactgggtgttttgaaatatacaattaattttttcttctctatagttgccctactgttctatagaacagtaatgattatcttgtctagtcaacagtactgtatgtacactaaccaccttctctccagtccctcttcctctattcttctcagcctgtgctaactaccattctactttccatttctatgaaagtaagtatttagcttcgttgtattccaagcttatttcatttaacataatatttcctagcttttcctaattgtggaaatgacaggatttcattctttttagagcgtgataatattccattgtgcttatatactgaatattctgcaaccatcctccattctatgagcacccaagttaattctgcaggaagcatgagagtgcttcttgacatactgacttcatttctttggacgtatgcccagttgggagacatctgtgtcatgttctagctctggttctatttcgagtgttttgagaagactgatatacatcctactatatatagtaatatccaagcaccatttattgaagagactttttccaaagtattttttggtgccttgaaaaaaaatcatctatttctgggtcctctattctattgtattgatcaatgtgtctgcttttatgctagtggcatgctgctttggctacagtagttttatataacatgttttgaaatcacatattattatgtctccagctttgtcatgttagattttgctcagaattactttggcaggatttttttgcagctccatacaagttttaagggtgtttcctcttgtttctgtgaaggatgcccttgttattttgatggatgctgtattgaatctatagattatgttgaacagtatagctatgtcaagaatatgaatttttccagtccaggagcattccaggctgtcattgtctgtctgtctgtctctgtctatatgtctctctgtgtacttatgtgtgtgcttcaatttctttcatcagtcttttatagatttgattgtagagttctttaacctctatgtttaagttaatttctaggtatctttataggtgttgcaaatgaattcatcttcttgatttttcagtttgttcattgttgtataggaatataagccagatttgtttttgttggtatatgtctttcatcccagcactcaggaggcaggggcaggtggatctcagttcaagtagctcaaggctagtatggtctacataatgaattccagatcagcctggcctgtgtagtgtgcacttatctcaaaaataaagaaaggagattcatatttatttttaattctgtgtgtatgagtgttttgcatacatgtatgtcagtgcaccacatgcatgcctggtgttagtggaggcatcaggtcccctgttactggagttgcagatggttgtgaattgctatgtggatgctgagaacctaacctcctggtcctctacaagagcagcaagtgttctgagttgccgagccatctctttagccctcagtactaacttttatatattgattttgcattctgtaacttgtctatcaattctaacatattttggtagtctttaggcttttctgtatatcagataatgttatgtgcaaatgggtgatttgacttcctccctgccacctggatatttatctcctttctcttttttaactgccttacctgagattttcagagtcattttaaaaatgactgacaatgctggagaattggctccagttaaagggctgcctgcttttccagaatacccacgtttgattctcaggacctacatgatggctcacaactgtttgtaactccagttgcaggggatctaactgtatcttctgggatccatgggtactgcccacacacggtacaacagacatacatatggcaaaatactcatacacagaaagtaataaaataaaaattttaaatattatcaatccggtcttcttgggaaaatcaggttatcttttatagtaattcattttttctccaaagcattcttgatttctgaatcttgatttgatgatttctgaatattaaatctaagagctgggatgtagttcagtggtaaagtactagtcttgtgtgtgcaagggctttggtttatttcctgacatcacaaaaaaatctgtactaaaataatttaggaattaatctctgttaagctatttaaaaaatataacctagacttttaaattaatctatgagaggcactatttaaaattatttttccatcagtataatttgggggagacgtctgttaagatattttgtctctttttctattgttgttggaatcaaatttagggccatacacatggtaggaaaacgttctatctctcagctacatccccaaccctgtttggccggctcctgtaaaagtaacttttattcacctgtgataattgctatctcagaagcttactgcctcagtctgctaacctaggcctagtcctggaagcttctaacctccatacaatctaatctaggcctacaatgttttcagcctcatagacttgctgttaaatcagcgctgagctttctgagctctggatgtctggttcaactctgcttttctggctcaaaactactctccaaactaactgattcaagctggcttctcttggcctcatactcactttggcaatctgttctactcttcaggctccttcgaattctctggctcattctgtcttcacctgtgtctagcttcgtttctcgtcaacctgtctctgtaaaactctcccaggaaaactgcctacctctttctctctgcactgcccctgaagtagcttccctttcctctctcttcttgtgagagttgggtgtatcctattctgtcaaatttttctctgatttgtcacttggtctgccattcaattagacacccctttcaaacatggatgcttccttctacaaactttaccttcattggttgggattaaaggtgtgtactaagggcatgccagtattccaactggagggattaaatgtgtgtgctaatggataagccacaccacaactagaaacaggtttttccaataaataatacaatctcagggttcacagaatgatcagatatcctacaacaggctcatttaaaaaattgttattagttatgtgtggccatgtgtggtgatatgtatgaaggagtctagttgcttgcgtagtgcagaggtgggtgtaataccacctggaggtggagttacagtccattttgagccaactgaactttggtcctctgcaagagcagagaggttcttaatatctgaaccatcttttcagcccattttggcccatatttaggttagatgtctattgttccagcattagtcattgaaaagattaccttggctaacttctttatacattcatagactttatgtgaatttatttctgagttttctatcctgttccatacatctacttgtcttttcgttgatatgtaccatcttatcttaacgactatggtgttagattacttttgaagtcagagagtgtcattctacccccgccccaatccttcaatgctaagttggttattttaggtctttgtctaaattttagaatcttttttctttttattttgagtcagggtctcattatatagccctaattggcctggaaccctttgtgtaaaccaggtttgccttgaactcacagagttctgcctgcttttgcctccagaatgcttggattaaaggtgtgggccaccatgtgctggccttagaatttatatttgatccagaaaataacttgttgaaatttctattggggttatgtttaacatacagatctagttggaaagaattggcatgttgatccttcttattgatttactgcacattctttgatatttttcatcagagttttgtagtttcttttgtatagatcttttgcagatttttgttagacttctgcctaatcatttcatggatttggtgctaatataaatgcatcatggggtttgctgttgttgctgggggaagggggagtttagaaagggtctcattttagtagttcaggataatctggaactatttaggtcaagatgtactcaaaatcatagcaatccgagtgtctctgtttcttgagtgctgggattgcaggcagaagccaccatacttggattggcatcatgctttaaatatctaattaaactttgttgttggcatataggcatgccattggctgttttggttaaccttgtatcctataaccctactataattgcttattagtttcaagagctataaggtactatgttaattctactcttagtatgttttccctctatctgttggatctaagactagcaatggtaacgccatttcacagtcccaatctgtgttttgcttcatctgtattaaatttttctcttttgtcctctaaggtggtgtgaggacaccatgacagtcacagtggtttatgataactctgaggcaacagagctctgtgctgctcagcacctctacctcaagcctatagcaaaattaatgatcaacgtgttgctcccagaatgtatagaacctgtgaggcccttctctaactgggaagttcttgaccaactgaaaagtctgatttgccctgaccagtttaccacagtgcgcctctccaagagtacgaaagacttcatccgatttgagggtgaggctgaaacacgaagtttggttcagatcctgaaagccaagttacatgggaagatcatcaagcttaatggtttgaaaactgacttaaaagtagtagcgacagatgcccagggagagtgggaacacttcccaaaagagaaagaggcctcagtgattgagggagctgaagaacaagaccatgataagggccctgattctatctactttgaaggcttgccctgtaagtggtttgcacctaaaggctccagtggagagaagccctgtgaggagatcctccgagtagtctttgagagttttgggaagatcaagaatgtggatatccccatgcttgacccctaccgagaagtgatgacaggtgggagctttgggggtttgaactttggcttgcaaacattcgaagcctttatacaataccaggagtcaactgactttataaaagccatggaatcccttcgaggaatgaagctgatgcttaaaggagacgatggcaaagctctggcatgtaatattaaggtaagaaggatccggacttcagttttcactgttccactggaaagaagcatctaatttaaatgtatttagattccactaggctctgatcaatcagtgatgcagagatgcatgctatcatttatacatgtatgtttaggaagaaacacaagcttaatgtgaatatccaagcttctgaaagcaggtagcccaccctctgtgattttaaagtgctggttcgtaccatctgggtctctgcccaagccttgtgaggtcattaaaggattattcatgcctcccatggaacaatttcctatgcttgttgtacttgacagttgctgtgagagggagtcatgaagtctgaaatcacaaggagagcacttctctccctcattcccttgaaccaaaatcctaaaggcccgtgtcttttgctttcaaaaccagcctgtctatgtaggcatgccatgctacttcattgatgtctgggattgctttggtcatcttcctgctttatttaccctcatcaagatttatttcaaggcctggacacatttagacttaccaaaatggaactattgttaattttctataatatataagcacaatataaaaaattggaaaatgtacacaattagctaatacctaaacaatatacttcttttttcaaaaaaagcaatggctatttagcaaaatataaggtgccaataaaatatcaaaacattggaactggagacacatcttctgagcatcttggagaggatcgaggatcaaggatcaaggatcaaggtttggttcccagtacccacatggtggctcacgaacgtttgtaatacagttccagggtatctgcagctctcttctggcctccgtggttaccaggcatgcaggtggtacacaggcatacatgcaagcaaaatacccatacacataaaataaaaataaaataaaataaaataaaacagtgtcaaatgctaaatgagaacgcagttactaacagacataaagctactttatccattctgggtttgactactaactttgtcacataaagccacaaataaattgagccttctattagatatgggatttacaacattaaatactatattttcagttaggtatggcagtgtgtgtcttttgatgtcagctcttacgatatggaaacaggaggatcaggaattcaagaacagcttggactctctgagactcaagtctccaagatcataggagttggttcagtgggtgtaactgagctttgggcttgcctagtatccacaaagccctaggttctgtggagaaatttgtggggattgttatactttttagtgtccgaacttatgataatgcagtttgttgcttttttacttcttttatatttaaaatacatagatacaaaacaaacatgcacatatacaaacatagtctgtctaattaatatatatatatatatatatatatatatatatatatatatatatccacccaaatttctttattacttcattcctgttctgacagttttaatgttcttctataggctttataagtgtgtatttccacagtaattataattaattcctgcatctcagaaatgatttacaataagatatctttaaaaattaccttctatattcgtcactctccaccagaaaatctgttgctgaaatgagcaagaatatagggaactctctgacaggcccagagaaatctgtaattgaagttacttaatatcccaagattttaactttctgtttatacaaaccaaaggacccaattggctaaaagttatagttaataggaggaaaaagacagggcgtttaactaaaattctatatctcaaataaaaaaaaagcccctctagtctagcattaaattatattgggtatatactgccaggatagcttctaatcatatattttaataaatcttgtaattgtttcatagtttaattgattattagtatgtttaggggaaaataagcactttgtgttaagaaacaggtatatacaaatggatgggtagttcatttatgcatgtaattaactttagttttattttgttttgagatggtgtggttgcagcttactccgttgtagcttaagtctagcctcaagcttgtgaccctcctgcctcactctcctaaatgctggattttcaggcaggtgttaccacacctggcatgtgttctcatttaaatcctgcaaaaccctaagagcgcaatgcaggcacacacttagtcacgattcctattgtgatgaacagatcagtatagatgcaggcagtctcttaaatgtgcaatttcaggccatttctaatgggaaaaacggacagccttttcaagctagaaagaaccaaagacaagaacagtattgaaggaaaagaatagctactgttttgaaaaggagcaagatgtattataaaacacacacacacaaaagcgagatctgcaggacagaaaaacaccatctttaacaaacaaacaaaaaaccctgataggcagagggaatctaggccacttggaattgaggatgcaccacacagacacagagacagcacaataaactgtcctcacatgggaaatcagcaagacagaattcataaaagtcctcatgcctacaacaatatattaatgcacaagatagcaaaaatgagtctggttttcctccttgggcaaggcatgaatttatcaaacttctgttaatacattttcaagttttctttgctcagtagcatatgctatacaaatatgctggtattttactgtaagacttttggttcttgtctcaaatcgctgacttggtttttgtatacaccatgttatttccattataatgcacttactatatttctagtgattcactttaactaacttactgcattaatagcttcttaattgaaatgaatattttactactacagtaggatgcattgaacttagcaactgaagcacagtagagtaactacatcatattgtttaatttcacagctatagaaaaacgtttgcctttaaaaatacaatcaagatgagactacatagtttatgaacagtgaaatactaggaaacagtggatgaagaaataaggtcatttttcatccatgaccataattttgtctttagaaacctggaagaaaatattgtggtaaatctagtcatttagttgtttcttcaatctcatgagttactgaaataagtggtactaacgaatcaaagttcttttctgggccaaggtaggcaacaacggccacatagaggatttcctcataaaagtcctctttgaaggtatacatgatatgtgattctctggactttttcacattcctacgctatgggttccagccttgtgttcaccaccatcttatgggcattctcacttccaacaccagagaaactataataagtgccagtggaccacataaactggaaatttgttctggaaaaaattagctgtggcgacacccagctgctcggagctacagccgaagccttgcatcacttggcctaggcagaagtacagcagcctttaggcactccgcaggcttctggcaggtttattgtgaaccatcggctgggagcaagggctgtggcctgattcacacatcccatggaaccaataagctcagtcccctggaccggctggggtactgaagcaagaactctgcattttctgcttggttgtacggtagcttggcggcccaggtatcaacacatgctgatccgagtagctatctctaaggaggcacatcgattatcaccctgaaggcctaacccaacaatggaaaagacacagctagattcttctctaagccagtctttggcgttggcatgaatttgcattttcagtttcatgtgtgtgtgtgtgtgtgtgtgtgtgtgtgtgtaactacttgtgttaaaaggaaccatggctgtgaatgtattgtttttaatgcatatttatttgtttatttactttctgcagcactgggcatgcagcctaggattttgctaatgccaagcaagcactctaccactgagctatatccctagtccacttgggtatatttcaataactagttttcctgtttattatttttgtattcatggtgctaaggatgaaactagagacctcctgtatactgatgagctaacagagcatctgcctcttttagcctatgagaatatctccttatcccacttgcttattatatttcaagatatgaactgtagttcatctgatatcttattaggttagttttcttgtctcttttctgcctaccctattccgtgccatgcttattatttttatcttttctgacgtaaacaacatcatcaactcatcaatctggttgacctgtatggcttactagaggtaatatatttctcacctgtgcctagactgccctgggatgctacccatggccatatgtaaagtaggctcctgcacaaaacattgaaggcgtaaaagtgggaggggcatacattgggaaggaggtggggggttgttagagtgggagggtaatcagagagggtaaggagatgactatattcacaatacagtgcaaacatgtatgaacttatcaaaaattaaataaaaataaccaaaacattgtgatacacttaagtttagttgcatgaaagaactatggtaatttgatgttgtatttcaaaggttttgccagagaacatcctagtgcctgcaagtaccattcagcccttggcccataagcaacagagcatcatggctctcaaagggcatttcctattcgtttggttttcaattgctgtgcactgttttcgcttcctctctttcacctgggatccatccagtccattgactgacaagcctttctaagaaagctttgatttgttttgggacaggttatgtttgataccaccaaacatttcagtgaaggagctatacagaggaggaatcaggaaaggctaaaattacaggagctggaagaagagaggaaaaaagaaaagaagagagaagaggaagtagctgaaaggtaagtgggctgaattttagcaatgaagaaggttttcctttggagatttggactaattcatttgggtgaatggctagattcggtagataatatggggcaggctttggcacagatcaaaaactctatcaaagacagtcttacacattgcagataatgaaataaagacaatcaagaaaccagaaaagcatgcctggaagtgagaacgagtaagaaggataatgggactggccagattaagaagtctgggggaaaggatttttaactgagaatgaggaatgaatgaattaatttctttctctctctctctctctctctctctctctctctctctctctttctttctttctctttttgcagtactggggtttgaacccagggccttgtatttactaggcaagcatcccatctgtgggctatagtcatgagctgaaagtttatagtgataatccaaattagaaattgtattagtttgctaatattacctagactgccaatttaaaattaaaaactaacttgggaaagttttctgtcctctaaaatgtttgagaatcaaagtaatccagacttgtggatttgttgggaccatccttcttcttgttggccagaattcttactgtgaatttggggtattctattttcttccttcagtctcaccacattatttaccagtgctggggcttcagcctagctagctagattatttgcctacctaggccattgccgaacatttgccaaaaaaggacagacaccagctttatagggctctgataacccagttttcacctcctggccccttctcttttatataaaccacagcattaaaaaatattaagaacactgttccatctctctcttttttgcctggtcacatctaggaaatttggccagagcttctgccatttcaaggtactattctttatcaaattccaagccaaacattccatttagataatcctttgtcctctggctaactccagatccaggtaatagccctttatttcttctcacattttcatgaggtgataactgaatttatctacttcccttagccactgtatcctttctagcattagttgttatttgttttctttttaatagccattctgacagaggcggaatgggttgttagtggagttttaagatgcatttaaagtgtttttatgtgtgtgtgttgactacatgtactatgagcgtgcttcatatctctggaggccaaaaaggatgccaggtcctcttgagctggtgttatgggtagttgtgatctgccatgtgggtattgggaactgaacctgggtcctctgcaagagcagccagtactcgtcactgctgagccatctctttatccggctcttagtgtagttttggtttgatgatgatggttattagacattgtttcatatgcttattttccatctgtactccttttgagaattgtatattagtgtgtatgtcctcttattaattggataatttgattttgatgggtagtttttaaagttcttcatatatcttatatattattaactcccttgactacatagctggaaaagggtttcttctataggctccctgtttattgagaatatgtctatatatacacacatgaacatagaaccttagagtaaagggggaaaacagaaaggccaataagttacatttttaaaatgaggaggctggagagatggctcagtggttaagagtattagcccctcttccagatgttctggacccacgtagtaactcataactgccagtaactccagtcccagggaatatgagcccctcttctggcatttgagggcaccaagcacacatatgatacacaggcatgcagacaaaacaccatacacatggaataagtgagtaaatagtgaaaacctatcagaacagattctttctggctaggtggaggggtgtggtcagttaaagttgaagtctgtcaaggctcagttgttcattggatctacattcactttaggggtgtcccttttttgcttatggggagctatttctgtccactttgcagtctgtgtactgggtagattcgcacttgctctagaaactttttttttaaagatttatttattattattatatctaagtacactgtagctgtcttcagatacaccagaagagggcgtcattacggatggttgtgagccaccatgtggttgctgggatttgaattcaggaccttcggaagagcagtcagtgctcttaaccactgagccatctctccagcctcagtctagaaacttctacttgtataccccatgggggctaatatccaagccaaggaatgtcttctgtgttgcccagtggggaagcaaacaaagagctgagatccttactgatgtatgggtctcagcactttcaaatcatgtacagcgttaaatgtcctgtaaaaggagggatgctgtagaaaattgagagaggcccataggacctgagcttcacggttctcagtcctgctagccggccgaaacccatggctgagagaggtagcccactaacccaggcctgagttgccacagttttctgcaggtgatggagtctaccccttttcacaaagggtgggacccaggacccacccatcacaacgtttttttccagtcagagcctatgtgctgcctgaacttctcagcatggcatatccagtctcaaatgaagccttccaaattatgaggattattagtatggattttgtctttactaagtatctggtatgcaggagcaatcactgtcacactaaatccgccccctggatttaaggcttgtgagaactatggcatccttctgtgactgttttaccagggcacactatgtctgggactcccggttccccccccccccccccccccgccagggaactgggcggactggttttgtggcctgtttgtttttctgatcttttcagctatcctagaattagttttgtgagttcagactatagcccttattttttttttctttttaccttcagaatagaatctgctactcattttcttgcctattcttcagggcatcacataaaagtaccagagctctctccccttcccttctttctgtccttcctcctgtgtctataaggtatccgttatatatttgcattttacacacaaaattatgtcttttcctttgactgatgttctttttttttattttagggggcatgtgttttatttcttttatatgtatgtatatatgtatatatgtatgtatgtatgtgtttgcgtgtgtgcgtgtgtgtgtgtgtgtgtgtaggccagaggacctcagttgtcattcctctgatgctgtccacctgctttgtttttgtttttgagaaaggatttttcactggcctgtaaattgctaaatactctagaccatctggtcagagtgtgccagggatccacctgtctctatctccccatcactgggatcaaagtgtacacaccttgcttagtcaggtccttgtatgcacaagacagtcacattactgatggagcaatccccccagcccctggttgttgtgtttgtttgtttgttctgttgttgttctttgtttttaccatgagttgtcaattccaggtcctgaggttatcagacctaggtttctggaagcctaaatgattattagttcttctgggtggctaattattattgcttgaatgaatgatgaatcttaattgttgttcagaaaaagaaaagatgaagtaaggaaagcccaagaaaagagaaagaaggccagggacaggaggcgagccctgaaggaaagagacagacaccgtcaaagaaaggaaaaagtgaaaaccaagcctgaggcccgtcaggagctggactcttcgggagagtgggaggagcggaagtacttgctggctcggaggcgggttgaagctcttcggttactccgggtactcctgaagaaaattgcagtaaggctgtttcctaactattctctttagttttggtaggtactagtctttctgaggcctagcctttggttttaagtattgtcccaccaacaatgaactgcgcggcatgcatagacatttcctttaaatcgattgctctcccttaaccccaaccatgggtttctaaaaacagtctagtgccatctcaactcggtcctcacttcccgtgtttaaacttcagacactttagctacttcatcttcttgtttgtgttcctataggatatgacagaaaaatgctagggggacacaaagggtcggtgtggtgcaggtgttccctctgtagccttctggtaacttcattcatccatctgtccgtaacaggtttggatgagaaaagagaagaacctcaagccttgtcaaacacacattagccttctcttgaactgtctggtaaggattttttaaagatttatttattatatgtaaatacactgtagttgtcttcagacacaccaaaagagggagtcagatctccttatggatggttgtgagccaccatgtggttgctgggatttgaactcaggacctccagaagagcagtcagtgctcttaactgctgaaccatctctctagccctggtaaggaatttcttacctcacagatcagttatcttcttcacagatttttttcatttatccaaggatttttatctgtttgtgggctcctagagatagccagaatcagataccttgaataatagccagagatatttctgaagtattcatttaaaagtccatatgcagtgatttaaataggaagaatgactgttgctgctattctagtaagccaattttgtttgttactgtggatagtgaactaactataggtcctatggataactaaacttggtaaaagcaggatcagaaaaaaacccaacaatttcatacttggattattgatggcaagcccagctagactggtttttggtttaccttaatgatgctcaagtgtgatattcttctgtaaaatctacctctttaaatgggtagggagcacgattctgaaacccattaatgcttacactgattacaagttaccagggaggtgctgtgctctgccgtgtggcagacctccgtgggaatacacagcaaaccttcctggggatgggtatgtgggcatcatctttcccttactctgcagctgtgtagaacaggttgcatcagatttgagcacaggcaaattcatgggcacagtgatatttttctacttgttgtttggcttttcttttctgacttaacatgcaaatgctataccactaaactgcatctttgttccctgtgtgtttcatcttaatgaggcaggccaggtggctcaactcggagacatcctcaacttgcagtccatagagaaagattggagtatgaaatagagggacagtttatttagtaagtcagttgaccttgtgggacttgtttcacccacatgtcttttcttgtactagggtttcctgtgaaggctacagagcattccttattcccctgtttccctagtacctattggaagacttaaaactgtaggcttgtcaagttttgagcaactaaaaagagtaaggtgttttaaatgccatggaatggtcacaaatctaataaaaattgctcttattagatcaaaacattttaatttagtagtttcctcagtatagtattgcttctaatctggacctatcttgttttattgtttgtttgtttgttttttccagagcagttttctttgtgttttgttttgaatttttatctacatttatttatttgtttgttttgtgtgtgaatggggatgggacacatgccactgtgtgagtatgtgtggctatcagaggacagtttgctgaggtcaggtctctcctttctcacatataggtccctgagttggaactcaggtcattacgcttagaggcaggcacctttatacctcctgagccatcttgctggccccatttgagttttcatgagagatcattaaatcttatttttttccttaaagggatccacacagtgtaatccacaggaagttggtgttatgaagtccgaagctcatcataccccagggactgcattgaaatcacccgaggaagaagaattaaacactcggcatcttctagattgggaagaaatgccaagctaccaggcttccacacttgatcttagtcaaaaggcagagaagcgatgctatcaggcttccaagtctgacaataaacaaaaacaaaaagggaagaaaaaaactaaggctcagttacagaaatcttcacacactcctggggtgaaacaaatgagacactcagctagaaaagaagaaactggaaaagtgttaagtgatgggtgtgattacagtttggtctctgaccagaattctttacagagtacaatgattgcagatcagtcccttgcaaaggaagaccacgccagttctaatgaatcccattcttctagacaagctgtgatcaaccgtggcaggaaacagaagatctatgaaacagatgaatttattgactacctattaaactattatcagactccagagtatgcccgattctgtcttgaagcaagtcacctaacaagcacatgtcagtggcagagagatgtctacgctaagggggatggctttcagatctatttaagaaaacaggggtaccactcaaacagcctgagtgaagaggagagcctgcaagggatagagcaggacgaagagcaggactggccacaagtgtatattaaagatcctgagagtaagtcgcaaaagacaggcaagatcaattatgccaaagaatttacaaagaaattaaaaaaccattgcaaggacatagcaagtgaaactgatgagcacctgtctccaactgatggagagagctatcctgtggaaaagattcacagtcacggagtcaaagattctcaacacataagaaaaagcccagtttcctcatcattaaggtcagtagatgtaggtttgccattggcagacttcttggaggaaattagtagcgattctgagtgcttcagtgaaactcttagcatgaaccaagaggaggaggaaaggtctatggctgtctataatagctccccggaaaaaagacctcttggtactgacaaaatcagtacttgcaaacagaaaacgaagtcgagtcagcagaccttgtgttcagagtggaaacatgacaatgagggaaaatactctaaacacagagttagggcaccaggtaaaaggtccaagtctgaactgagatactcgtggcttgaggaggaaggtgattccattagagttgacaagaacataagcaaaactagggggaaactagccccgaaacacatgcttgatgaaggccagtaccatgagtccagttccagtgatgaattagaaagcaccacgaggaagaagaggagacttactagcggtatgtttgaccagaatgtgaaatacaggccccttcatatgccatcaatgccgccaaaacgggctagagcattctatttgggatatttctccaggaaaaggcagactccgtggaagtcagaatataaccaggatgtaagaaggttcaaaagatatgaaaattctgaagattacacgcttgattctgataattactatgtcagtcacgatgacaaccaggagcacattgagtatggaagctacttaggagacagctactctagttctttgtattttaaaatgttctgacggccactttgagcaggaacacccttatttacaagaaacagtggacgggaagaaaaacttcaaaccaaatatagctatgttgttagcaaccacagtgcaagacctagaagagggttcaagtgcaaaagcttgctcctcttgccaaagttccaagtgtggatcagagtaactgcaggtatgtcagcaagctttggaaatagaaaacctgtaaattctaaagcttggtgaaacaccgtaattacaaaacttcttgatccaaggacagattttacattaagctttaatttggtgccagtaaaggagcagattagcattaagatggctgacttagccttcgatggctcttttgctgtcataacatcattcatcatctatcttcaaagaggacaatagtggacaaataggcatcttttgatgtgttcgtagattgggtcagaagcaccatgtatggtaacaaactttgctaaattttactccataataattttagataaagaagaaatccagaggttagaacatataatagattttatgactagaatttcatgaatattcactggaaggaaatgaatatattcataatactcaaagggtcatttatgtactgacagttctagaagaagaatctaaaagggctgattgccctttgacagctaagtagctgggactgtttggagttttcttgtttgttttatggaccccatatgtttccatcaaagcaccaggatcgaatttataaaatcagggggatttgcaaaggaaatatcaaaacatcctggcacatcaataatggcacttgggaagaaaagttgtgacagtattctatttcaggctctgtaatcctttcactcagggttgggtgacatcagtttgtaaaaagtcactgactatcccccacactgacttttatagaatagtaacaagtgcctccttcgtccttaacaaagtcatggtgttagaaagacttaagaaaagtccacagttttctagctgtggaaaaattgtttgtgtgtggaatttgtaagcgatgttaaataagtgatttatcttttttgctgactcgttttggacttcttaaatgtgtttttaaattgagatatttgtagattcctgaagacttaccccttagcacagtgcatgctctgtagaaagcttggccaactctttctgccttacattggattcaggacctcagggcagttagttgaccttcattttcccaacaaagctatacccgacctggcaactggctatcagtgaatttagagaccatctgcaacaagaatagttgtttcgaatccgcagaattggtgaagggtagcattttcatgacaatttcagttcagtctcaatttgacattctacaggaaagcatctgctagcagatgcaggtaggatgtcagtctgtggggttacttactatccttactatcgtgtcacacactgagtgcccctaaactgcctcttgagcagcctggtgtctgcagtggttgtgactatggtgtacctaaaggagaagccacaggttgtttctctgatctgcgtattcctctttgaagagagattgttcagtcacttcaaagttcagaaaggagtgaaacagatccacatggattactaagaaagaaacaacctcactttgaagccagtggttggtttcactattaaaactgggtttgacttactgaatctgaaagactgcacatgtggtgagagtgccttttttgttttgtttttgaggacgagcaatgactattcatgttcaaagtaatgttgcccaaagtagcctttgaaagcactaacagctcatatcttgtcagagagttttctggcaacacattactctcctccaattaaaaagctgcctcctttccctcccccacatgttattctattgaaacaaaaaacattatgggtttgtaatagaaagcagctgactgttttgaaacaaacaaacgaaaaaaaaaacccactcagtttcttccctcatttgatgttgtttctcgagagattttaggtatttttgctcggtaagaaaagacaataaaattgcagatctcagcagcatgtgcaaaggttgggatttctccctgtgatagacgtggtgctaagtcatcttgattcagcactttcgcgctgtttctttgctaaatgctttcctggggcctccaagtaacaatactgcttttgctgaaccctggagttttgtacccgtctgtggtaatgcattgtagatccgtgtcaaccccttttttgctgtaggccttacccgagaaaggtagccgagtaagatagcttactctgtgcttgtcactcggcggcttagtaaagaatgtaacgggacaaactgctatgactacttttgttcttgatactgttgttatttaagttgtgaagtgtgtttcctcatatcttctttttgtcccatcaaacaagggcctgacgttgttttatttaaagaggggtttccgtgcgcttcccttgtatgtgctgctaatcctgtaaagggaaagtctgctaagtgctttgttcatttgtttgaatttctcaggtagaaggccatgtaacctaggcattttgaaaccacaaccaaatcaatgtgtttttgttgcaaaactgttcaatgtgtgaattttaaaataaatgctcattgattcca

SEQ ID NO: 704 - DNA, 13039 bp, mus musculus
tcttcattttctgggagttttctggctgctctgccggagctatgccgaaagtcgtgtcgcggtcggtggtctgctcagacacccgggaccgcgaggaatatgatgatggcgagaagcccctccatgtctactactgtttatgtggccagatggtcctggtgctgggtgagtggcgggaagtggcggctgcaaggaaacatcgggcttcttttttctttctttttcaatctttctccccgcccccccccccccttttccttttctcctttgagacaagatctcacaaagtagctcgatcttgaactcattatgtagcctagattgtccccgaacttgttggtaattctccttccaggagtgcattaccactcttaagttcagggtattttttttttagtgactaagcgaggaaatttttctccattccttcagattgccagttagagaaattgcccatgaggccccgggaccggtctcgcgtgatcgatgctgccaaacatgctcacaagttttgtaacacagaagatgaggagactacttatcttcggaggtaagggcttaatgctctagttcactgttgggttgcggtctctttacgaggaatgtaaattaccctatgctagtgttaagcagctcatacagttaggcctgatactttgacgtttgtgctaatctcctaacttattttaattcaacaaattctttattgtactttgttgaaatggtactgaaatgtgcctctcttggcatttgatggctatgatgttccagttacaggcttgaatgagttagtacaacctgtaacttctgctgttgttatcaatattatttccagggctggggatggaacaagggccttactcttgtttagtgggcactctcctacagttacatctgcagccttatgactgtcatgtgtcaggtactgagctaggtaccaaatctgtgaataaggcacagtccttttaaaagaaatcagtttggaaacaggcttcttcttatgatagaaagaaatgctggtgctgtgaacaaaggctatgggaaaacaggtgggagaaggttatttattttacatgtgttgtggtcaggaaaagatctgaacgatagtggtgtttgtgcttggcttgaacgaagacttcactagttcttggaagacgatgcggaaacagtccaggtagagggaatctggaagcattatgagcatcaaatatgtctatgggacatttcagtagtcttctgtggccagagcatggcttactgttttatagaaaaggcttcataagtactgtggtgaggagagtgaaatgctttatctgaaggcaatgaaaagctatttccttgtgtgtgtgtgttttgatatgttcctgtgagtgcaggtgcctgtagaggtgaagagaagatgtttgattcccctggagctgaagttcctggtggtacttgtcaaccacctaaagaccctgggaaccaaacttgggtcttctaaaaaaacaatatactcttagtcacctcaccgagccatctctccagccccttatttccattttgtaaggagggagtaacatagttagatgtatatgtttccaagttgaggaatccttgatgtatatggtaattcaaagttacataaaatgaatgtagagcaaagtataaggctatagctcagttggtacagtatttgcaatcactgatactacatatagctggaatggtaatataatatacccttgtacccttgtaatcccagctctagggagatagggcaggaggattaaacgtttatatatatatatatatatatatatatatatatatatatatatatatatatatagacccttttcatacatacaagataaaacagatgagaaagagaaaggagtgaagatttacaaagtagacaaaaaaattgggacagaaccaggagaacctaataatgcagagaataagaaaggaaagaagggttggagagatggctctgcagttaacagcactggctgctcttccagaggtcctaggttcagtttccagcatttacatggtggctcacaaccatctctaactccaggtctaggggatctgatgccatcttctcattctcaggaataaaggccactcatttctttagccaatacttcattttctgagctcctttatatgctgagcactgtcttagtcacttgaatacactggtatattaacatgctaaatctgctatagtaaaataacacaacctgggtagcattaagtaacaaacaaacaaaaaatgaacaggctcagatttggaggctgaagtctgaaaattgtcagcagagctatgttcttgctgtcttttttttttttttttttttttggttttttgagacagggtctgtgtagccctggctgtcctggagctcactctgtaggcctctgccaccacacccagctcctgtttttgctgtcttactccttcctactacctatcacctcccggggagtggagagatgggggaggtcttactatgtagaccaggctgtcctggagctcattgaggtctgcctgcctttgcttcctaaattctgggattaaaaccatgtgccatcaggcctggcaggtttttgtttatttcttttaacttttgtgtgtgtgggggggggggggcgggggtagggataagacatgatggggctgccatagcctgcctgtggaggtcagaggacagcttttggtagttttcttcccagggatagaacttgggtcatggaaattggtgttagatgctttgttctctgaactacctctcttttttctgaaatttcttctccccctgctatccttagtgctccttggcttatccatgcatctgccattatctgcccgtgtcatcatgtggctttttttctgtgccttttaatttttagaaagttgattttctgtataagattttttgcctgcatatatgtttgtataccatctgtgtgccttgtgcccatcgaggccagaacaggaatcccttggacctggagttgcagatggttgtgggttgccatgtggttgctgggaattgaacttgggacctctggaaatgcagccaatgctcttaacctccgagccatctctccagtccctgccctcttattttaactttctgttgttgttttgtttagttttgctttgacagtctttcatgtagcacagagccttgagtgggatacttagtggaagtgtcctgacctcctgcttatacttcccaagtgctcacattacatgtgtcattttgtcctaggtttttatctcccccccccattatctagactactgcttttgaaaatcatcaactatttttaggatcattgtaataagcacatatattttttaaaagttctctattttaatagtatttgtaatggctattcctggttgtcaatttgattatacgtagaatgaactacaatccagaattggagggttcacatgtgatccagatcttgaggttggaagacacagacttttgacccagatcttgacgtggagatcttgagccatagtggccatgaagaggttaggtccaggcaaagtagtacaggcctttaatcctgggaaactgaggcaaggagatatctgagttcaaggtcagcctgaggcaaagcaagtcccagatctaggcatggtggtacaaatctttaatatggtccatacctgctattagagacctacataaggacattggaagaaggaagattcaccccttcttcaactgcttgcatttacttgccagcacatctgttagaacctacttctacagaagaccagctgaaacaactagcctcatgggactaagcaactactagattcttggagttcccattcatagctgcccattgttgggttagttggactgcagattgtaagtcatcacaataaattccctcaatataaagagacatcccataagttctgtgactctagagaaccctaatacagtattatatattaatatgtattattctgttagtacagaaagtaatttcatacaactacgcttcagtttcctgtatcatttggctagtcaagaaaactactgggtgaccctaggttgaagtagaaatgctgaaatccaatcagacttccctttagggcaaatcagccttagacctagccttacttagtggcaagtagtgtcttatttattggcagttcctacgccaggaacttttggccaagctttcagagttcttagcactgaccaacaagcaagtgttctcccctttgacatagttcatgctctagtactgagcagcttttccaaggacacgctgtgcccttttgttggccaaagcagggttctagtctgttcttactgtgtctcttttgtttttgtttttgttctttgagacaggatttcactgtgcagcccaagctggccttcagccggacccttctgcttcagcctcctatgagctggccttagaggcaaatgccaccacacccacttatgcctttctttttcattctgtaacttctaaattgtctagtttgttggcatataattgttcatagaataaccttttatttatttatttatttatttattttagaataacctttttatgtctatactgttggtacaaaaccctggagtttgaggtcctgatgacattagactaattctttgtacatagtaatcccatgaatactatgcatatataaagtatttcctttggatgaaattccattttcttttttttttttcaattttttattagatattttccttatttacatttcaaatgctatcctgaaagtcccctataccctccccccaccctgctcctctacccattcactcccacttcttggccctggcattcccctgtactggggcatataaagtttacaagaccaagggatctctcttcccaatgatggccgactaggccatcttctgctacatatgcagctagagacacgagctctggggggaagtcccattttctatcaggactctggcaggagcatcacctcttcatgaagtttctgtgactccctcaaatatgaataccacctctggtgccattacagattcctccatttaagaacttgatatcattagccagatgtgatggcttaagactgtcatcctagtatatggaagtctgaagctgtggaggattgcttgagtttaaggtcatcctgggctgcataggcaaactccagatcttcctaggggacttcaataagatcttaactcagaaaaagcttccttgaaatataagtttagttttcttatagaaggtaaattcttccaaattcattcagtgtttattataaatcttctgtatgtctagcattttaaattttatatctgtggtattttgtctgcatgtatatttgtttaccacatgtgcaccttgtacctgagagacaagaaggcactggacacctggaactggagttacagatagttgttaactaccatgtgggttctgggaattaaacctagatcgtctggaagagcagccagtgcttttaactaactgctgagccctctctccagccctatatgtagtgcttcgctcagccctggcgcgggataaggcagactctgtctcttctaaggggaatggatgatgaagattgcatagaaaaatcaaggactgatgattattagaagccatatgaatgaaacaaagatttggtagagaaagtcacgtgagaactgcttagtgaaagtggtcagggaaaggcctctgattaagttatgtatgcagtagcatcaaagtagatgaagagagcagccacagcagcgcggtgagcaaaacattctaggcagagggaggaatgtgtgcaaacggttgcctgccggaaagcacatgttcttttcaaaggaccgagacagaaggaagactgatttggccagtgtgtataaaagggagacaatgtagaagttgccgcagaagccagttatgttcttccgtggtggctggtaagccatggcagagaatctggaattgactctgtaaagggaagccacttctgcctcgttttccatagtgatttgggagaagaaactaatgggagcagattttagaatatgaggttggaagtttttatttcagataggaattcagattgagacagtcctagctttgttataacgtacatggcagagggcaagggcaagagagacattgactctgtattgactatagggaaaaaaaatctcaaatttccacatgctcaaaacaaaacaagaatcgaagacagatcacaaactaagaaagaaatacttgtgaagcccattaatagtgcaagtcttcttaatgtaaaagaaaaacgtgactgaaaatatataagctaatggttcaccaaaacaaacaaacaaacaaacaaacaaacaaatgtctgtcatactggggctaaaatgtatagcttcagtttaaaaccaagaaatgcaaactgggaggttctgttttctttgcttctgagatgtatctagctatgttagtgaaaatgtgtgtattaatgggtgtgtgtgtgtgtgtgtgtgtgtgtgtgtgtgtgtgtgtgtgtggcacgcacatgaatacatgcacgtatgtgcacatgtatagtctagagctgaatgttggggtgtcttcctctgtcagtctgcagtgtattccctgaagacagtatctcgctgaactagagctttgccatttcaactaggctggctggccagtgatctctcaggatcagcctaccttgatccccatatccctggggttacagtatatatagccatgcctgactttttatgtggctgctgaggcttttacctttggtccttgttctagcagagcaagcactcttagtcattgagtcccctccccagcctctgacacaacctttgtctttttttttttttacccatggttggtagaatccatagattcaggacccatagattatatactgattatatgactggttgctgttatactatagttaatattgttgctactataagtctagtcactcttgtgactgtttatattgtcactcttttgtctgctcagttagcatggtacctgaccccattagttgctcagtacctgtttgggaaagaaggaatgcatgctagagttatctgtttaataaatgcttagccagccagtagatctacacaatgaagagcgtctgagcttttggcatgaattctggtaagtgatgaataagcagaagaaatcagctagggggtgaatcagtagtgagatacactcttaacttttcctgttaacatccattttctgtgcaggcctgagggcattgaacgtcagtacaggaagaagtgtgcaaagtaagtaacagcagtgtggggcttgctggtcctaggtaagtcgaagcatgatgtgttagaaaaagaagtctctctttttgcatcgataatctcaaaggccttcaaaccaaatgctaatttgtttcccaaagatgctagttaaatcccatccctgaccagctgattataaaagtgagaacaatgacagcttttttttgttctttgggggcagggtcttgatatgcagttcaggctaggctggagcttctgatcaatcatttgcctcccaactactgggactctaggcgtgaacccccacggcaggcagaaacgtgaggtgacttctttcttttctttccagacagggtttctttgtatagccctggcagtcctggaactcactctgggcttaaaagcaaacaattcgagagagtaagattaaatatgtctgcaataaaatttacccatttaagtattcaatttgatgggttttgacagaaaaactccagttaaatagtgccaccaccatcgtgatagaagccatttccagcagtccacatgtcctttgcagcctgtctcctccgtttacccttccctggtagttgctgctttgtatccctgtgctcttgcctttcctaatgttttaggaaaatctatagtaaattctctattacatacaaatgcatgccttttatacctagtctgtctttctctttcctgtttcctgttcctgtttccctctccttctcccactctctgctggcctgcctacctttctgcatgccggcctgccctccctgcctgcctgcctgcctgcctgcctgcctgcctgcctgcctgcctgcctgcctgccttccttccttccttccttccttccttccttccttccttccttccttccttccttccttccatacatgtggggatctaaagccaacttgcagacagttctcaccttttccatgtgggtgttggggatcaaactcaggttgtcaggattggcaataggctcctttaactactcagcctctcactggcctctatacctagtttttctgtttggtgttttagggattgatcaaaattgctatgagattatttgtttctctttagtgctgagtatcccatcctatcagttcatttacttattcacagtactctttatttttgagtattctatggtatcagtttgtttatgaatttgagttacttctagttttagctattgccagtaacattgctctgagtattctagataggtcttattgtgggagatatatatgtatgtatgaagtagaattggctgggtcataatggaaaatggacaatgtaatttagttccaggttcatgtatacaatgtaatatgtagaccctaaagctaagaatcttaaaggatgttttttaaaacaaaatttacagttttaggctattagtagtaagactctcagtgatttcagttgttgttgttgttttgagtaggggtagttcaggctgtcttagaacttactatgaagaccaggctggccttgagctcacagaaatccacctgccaatgcctcctgagtactagttttgtggggtggttttttgggggggttcaagacagggtttctctgtatagccctgctgactgtcctggaactcactttgtagaccaggctggcctcgaactcagaaatccgtctgcctcccaagtgctgggattaaaggtgtgcgccaccaccacccgacgcctcctgagtactagtattaaaggccagccactatgcctagcagttgagtttaatcttggtgtaaggataattgtgtgttggctcttagaagactcagagcaggagcactgaatgaggcagaggaaaataagttgaagacaggaaggcatttgagtagctagccacactactcaatggatggatgaagctaatttttatcatatcttataggtctactttttagctcagaaagcataatggtcagccagagaaagtggtacttgtacaagatttgatttgccaaacactgcagtgatacctgtccatttctcttgatgctgtaaaatgaaatagcaaaggggacagaatgcccgaaccagtgttaaagcgcctgggaagaatggtagcagttttttactataaggccaatagcagcattagctagcatttcccaaactttgtttaatgtcagtatatacatgtgatgcagatgaaaatagccgagtctctggcctcactcatccctgcatttgccaaaccagaatattctggttgagacctaggaatctgatcagaaatttcaacatgcaccctaattaattcttatcaagttcttttggggaaaattgaacattttatgccacaaaccaaactcttctcagaatctgagtctacttttgcaagcgttaaggatggagaattagaggcctcccagagattcactctgccatttgcaggtgtggactgccgctcttctaccaatcccagccgaagaatgctcctgtgaccttcattgtggatggagcagtagtgaaatttggccaaggctttgggaaaaccaatatatatactcagaaacaagagcctcctaagaaggtaattatcatcaaaggacacagatggcttaagatggcaacacatttagccccaaatttacttagtgctggggatcgagtccaggacttttgcatgtcaggcaagcatcactgacctgtagcaatgcctgcctccccgactttttaaaatacggtataatacctgagaaacttgcatttgttgatgaaatatttatgaagaagttgccattgtcctgtacaagtagatgttataggactgtggcatttattatttgctttacatatagtagtttcgtaaccttagacattgtagaatttttattttccttttcagtttttcttttctttttagattgggaacaactaaatcctcaatgaattagactggtttttaaatatacgttttaaaaccgttaatagtgggctggagagatggctcagccattaaaggctaggctcacaactaaaaatatttaagtttggttcctagcatccatggctgtctcttcagccaccttttacatgatggtggtgatggtggtggtggtggcagtggctcatgcctttaatcctagcactccagagatagaggcaggcagatctttgattttcacaccagcctggtctacagagtgtgtcccaggccaggccagccaggactacacagagaaactgtcttggaaatcaaaaaaaaaaaaaagagccaaaaacctcaatagcaaatacttcataacactaccatgtagatagtcagcctgtccccaagaggcaggtattcccatgccctttctgtaggcagacatgcacataaagtacttgtgtacgtggctcatggatccttctgcggtgaacttagcttgatgcctcttcctactgttctaggttatgatgaccaaaaggactaaagacatgggcaagttcagctctgttactgtgtctaccattgatgaagaagaagaggagatagaggctgtaagtgtttctgctttcaggaaaattgaaatgggggaggggagcaagagcctgtgcagagcgagcagaacagttggcaacctagttttcacactctgctctgctattaagcagctctatgctattgagctagtgcctgtctccctgaatgggaggaacagctataaaatgagaacaaggaacctggatcctctcatcactttttaattttaaagccactgaactggattcaggactataattccagtactctggaggcttaggcaggagggtctcaaattcaggatctccatagcaagattctatcttcaaaacaaataaaaaatcaatgagatagcgcactgaatagttttcagtccctcccagcctggctctaatggtttgagtacgtccttaataccagcagttgcttttctgctatttcagtcaagtggttttcactgagggttcttagcaaatgatccccatggaaacctgaactttcctgggtcgtagagaagatgaggagttacagtcgtgcacttgagtagtataaatacctactgaggtctttgttgtggtccctgagaagtgcatcggtctgccttgtttcctacagagggaagttgctgactcttacgcgcagaatgccaaagtgattgaaaagcagctggagcgcaaaggcatgagcaagaggaggctgcaggagttggtaagtggcgtggggaggaagggcccaggtctacctgccttgggtttcgtactttgaatgatttgcaggagctgttgtgaatttctagtatagttggctgccagcgttctcaccccgggctgactgtgtttgtaaactctgctctacaatagtggctggagcccaaagcctgaattagaaatctgatttgatgggcctaactgggatactgttttactctgctgcttgtgctctaaagtcaggagataggagccaggtttttagtgctctccagtgtgatggtgtccagttgtgctacctcggtatacctgaattggagctgctatcactgcttttaaagccctgctagttttctgccttatccaggggattaacttagagctcagcacctctatgtaggttgggacctccattgttttgcttttttaatgcttaattgaatttgttctctgataatttcaggtatgtatgtatgtatgtatataaagtctacattctggttttttggtttggtttggtttggttttggtttttcgagacagaatttctctgtatagccctggctgtcctggaactcactctgttgaccaggctggcctcgaactcagaaatcaacctgcctctgcctcccaagtgctgggatgaaaggcatgggcctcctctgcctgctgatgtagtctacattctgactgcccttacccattccctcttatctctctcccactcctgtccattactaatttatttgattttttttggataacattttttttagataataataattgcttatttcattaatctcagacatactgcattggtgcttaatcaaattctatataaatgtctttttaattttttatactagcatataaagtaacaggtttcattatggcagttttgtaattatgtctcattatctttgttctcattctttccctcctccttcccggactccttgcccactctggttggtctccttcttccacattgtctcctctgctttattttgtttgatctttctctccctcccttcctccctccttcccctcccccttcctccttcctcccttcctccctctctttcttttgaagacaggatttgtccaggctgacttcagacttgctatgttgccaaagctggctttgaactcttgatcctcctgccgccagcgccctagtcctgtgattacaggacacactctgcttcctcttttgctttctcatcacatgtattccattagtccttttcccccttcatgaccttctttctagactcatgccctacacgcatacacataggattttaaatctaggttttaggagccaggctttaagttgatgagtaaggattctaaaaccatttttggcatgtacactgagcaggaagggagcgtgaacagttagagtaaacaagaaatgttaagagtgtcatgtgattgtgatatatcagggcctacttttttttctttccaggctgaattggaagccaagaaagcaaaaa

SEQ ID NO: 705 - DNA, 18663 bp, mus musculus
gggctatttgttaggggcggagctcctgaggtctctcccggagagtcgtaggtgcccggcgtaacggcttagcagctgtgccaccgctctaaagagcgtaaccgtggccatgaaggaagaaaaagatcataggcctaaggagaaacgagtgaccctgtttacgccgcagggcgccacaggcggctgtattggcgctactgccgaaggcgccaaaggggacgataggcaggatcgcaacagggacaagaaagaagctttgagcaaggtgcctatcgggtggtggcacaagagggcgggacatgtccacggactggggagcatggctgggaatggggctgctctcttcctctcccgggtaactcttctgtttctaactgaatggaaattgcttcgcactgtctcacgcactggtggaaatgggattagcaggttctgataaagcccccgaaatggggggatggagggtgggggtgagggaaaaggagggttcccagatgagaaaaggttagttcagagctgcgacggtggggtagttatgagagaggggagcagcaggaaagataggggaactttaattggcttgaattgctaaatagaccttgccacaccaggggttaggggtgggagtaattgtgaagtacgtgttaatgcaagcgagttgggggagcacattaagaggattgatgaccaacctggaggagcagacagatggagggcgatgggtaaaggatttccgtggtacacagaatggggaagggagttcatttagcgcattttagaccggtgagagagacaatgtcgcgacaccgacaaaagaccagaattcgttcaaaatgggttttaaactccatttaagaacagaacctgggattttccttgccccagacagttgtcacttccaggagtttgtataaacccgcgttatccatacctttgagtaattcatagcattggattgcaggagaatatgttcggtgtttttgtaagtgtctgtattttagagccgattatcagaagccatgattctggtatgccagaaagttggctgctatgtactgattttcctttcctcgtttgtttcctaaggtggtaattcgaagattacctcccactttgaccaaggaacagcttcaggaacatcttcaacctatgcctgagcacgattattttgagtttttttctaatgatactaggtaaaaaaaaaattaatattttaccctccttttcgctttttgggctagtgtctttaatgtgtatgtgtttgcaattcagtcagacacctgaaaccatagtcacgtaattgctttccgtctctacagcctttatcctcatatgtatgccagagcatatatcaactttaaaaaccaagaagacattcttttattcagggaccgatttgatggctatgtattccttgacaataagggtgagtatacgatttaggagagtttttcatggttacattgaacagagtgtgtgctgccacttgcggtatgtgcctgtaatcagagcaaaggatgcagaagcaggagggtgactccaagtttgaggtcagtctggactacatagaatgaccactgagagagagagaagaaaagagatagggttgaggagagggaggaaggggtgtgggagagcaatatacaatgctttctccaagtctgtgtgggttagacttaaactcctttaagataaaatgtgcaacattgaaagaatttttataaccctgagatagttttcttaacttatgatttctttcctttgatccagtgactataattaccactgatttctcctgtttgatactttatacttgtttcaaatgtcgacttcctgcctcaaagatgctaattagtatcctttatgttgctagtcctcagttagaatactgtttacctttctcacaaagctgcggaaaactaaagcctcaaattgcatctcccaggctggagatgtaacgcaatgattgatgatatgtgagaccttgggttcaattctcagcatcggcaaataacaggaacacaccacagcatcctgggatccaagctacacaatgtgtaacattaacagatttcggaatgaactcctgactcactttccgtttgctgtctggggtttgcagggtttagctagaatgtatccaagttgccttttgccacctttcatttggtttttgactcatggacaagtgatgtggggtttcctgtctgttttcatttcctcaattacttcaagtttgcaaatagtaaatccttgttgtggaatatgcctgataacaagttgaaggcttgacaactgtgtttgtccaatgtatatacacttagggtcaaataaggttctctcaccgtgccaacttttactctttgctacattgtaactcgtgcctaacacacggtgcctaattatcccatttcccaaactgtctttattttttcctgaccagccttttttttttgttttgttttgtttttgttttttctttaattccagacagggtttctctgtatagccctggctgtcctggaactaattctgtagaccaggctggcctcgaactcagaaatccgcctgcctctgcctcccaagtgctgggattaaaggcatgcaccaccatgcccggctatgaccagcctttttattctagtagataacaatgatttcttatttagcttctattgacttattatcctcttaatcagttttattacctgcatgtgtttattttgtgtgtctttaggctatggaacatgtggtctcccttccaccatgagggtcttgggacttgaactcagatcatcaaccttggtggcaagtgctgttacacactgagccctctcaccaacctgctgtggatttttttttctttttacagtttcatttattgtgcttgtttttaaaagtattttatgtgtatgggtgttgcccgtatgtatgtctgtgcatcacattcatgcctagtgcctacagaggccagacaaggggatcaggtaacttggactggagagttaaagatgattgtgagatgtcatgtaggtgggtgctgggaattgaacctagatctaagaggaggaagtattcttaatcattgagccgtcactccagcacctaaaatggagtgtttttttttttctaagatttgtagtgtcttccttccttccttccttccttccttccttccttttttcttttttctttatctttctttcttttttttttttttttgaggcttatctatacttttgcagacaaccagtgtcttttgcagggagttctgtttttctatttctgtattatgtcagcttaattgccataaacttgcacacagccactacactacggactagacatggggactctcatatactaggccatgtctctaccagtgagctatatcccaaacttgaaattaacccttttgaaaggatgatttaaattgatagttatgaaacagaaattccaagctcaccctggtcgtcatagccctccatcgccttgccttggttctgggcttctttgcttgtttccccagtctgtctcccacagtttcactgtcctttcacctgggtttatctgttctactcctcaaatatgtagtagttactcaatctgattctgcatttactaggattttcataaccttgtttcctttgtgatttggggttgtcctagctttgaatttctcatcctcttgccttcatatcctgagtactaggcttgcaagtgcatgccacccaacccaactccagttcttactttattctagttaatgttcatatgccactgaagacaagatagtattttgtaccttgtatgacattgtttggtgggaatgatagattattatctttttttagcagtcagtttttcattgaaatataatttgtacatcatagaattcaccatctgtaagtgcaaacttttttaaaattattttcctcatttacatttccaatgctatcccaaaagtcccccatatcctcccccccataagtgcaaacttaatggggttagtatattcacaaacttctacaaccatcactactaattctggagtgtttcatcatccccagagacacctgtatcagttagcacttttctcctcctcccccttcagccctggcagccacactgatctgttttgtgtctgtggattttcctactctgagcatttcgtatcaacagaatcatatgtgcaatctgtagttcttttggggttttgttttcctttgttttgactttttgaaacaatttctctatgtagaccaggctggccttgaacttgtgtcaatctttctgtctctgttttctgagtgctatgcaatgtgataacttgattatgcatatactatgaaatgattgatacaatgatgttaattacatctgtcaaactcacattggtacctcattcacaataatagctttatgaagatgtaatttacacatcataagacccagtttttttaaagatagggtttctttctgtgatcctggcagtcctggagttcgttctgggcaccaggctggccttgaacttggagatctgcctgcttctgtctcctaagtgctgggaccagaggaattcacaaccacagcccagcaaaacctacccctttaaagcatacaattcattggtttttcatatattcacagagttatataatcatcaccacaatttaattttagactggatagtcatcccaatgagatacaccatactcattagttgtcatccctacaactaactcttaaccattaacatctcctggatccctagacagggtctcactctatccaacgctgacctcaaactaatgattgtcttcctcattagtactcggatgaccagcatgtgcctctatacagagctaccgtctctagatctactacgtctagctgtgaattacatgcttgtaactccagagtttggagggtggggacaggaggatcaggagtgtaagacagtttagctacctagcaagtttgaggctggctgtggctagctacataaagtgtcctacttcccaaaatagctttttttaaagtttgcttctttaagagcgctctgatgtttaagattatgtaggatttttgagacaggagctttctaggcaacccaggctggccttgaagtcatggccctcttgctttcacctaccagtgctagcattatcaacaagaagtcactattctaagttctaatatataaattaacgaatattgaagaatgtattttcacatatcaaaacatgacactttagaagttgaatttcagggaacattgatttctctgctgtatcttttatttatctgttgctgttgttgattgagataggatcattgtgtgctgacctgaaattcttgggcttaagaaatagtcctgcttcagtcttcctggtagttgagactggaggtacatactacacatccccgtcccgcccccccccccaagtctgctgtcatactttttttttttttttggttttttagagacagggtttctctgtatagccctggctgtcctggaactcactctgtagagcaggctggtcttgaattcagaaatctgcctgcctctgcctcccaagtgctgggattaaaggtgtgcaccaccactgcccggctgctgtcgtatgtttgattatgttatcagtgttaattctatagttatgttaaatctagtaagggtgttggctttgggagactattcaaatgacatcaaagtaggtctaaaaaactaatgcattgatttgtgcatacatcttttttgacgtctttattgttaaagcaaggatggcattttttttcttaaacaggtcaagaatatcatgctatagtagaatttgcaccatttcaaaaagctgcaaaaaagaagattaagaaaagagatacaaaagttgggactatcgaggatggtatagtatagctccggttatatactacttccttttgttggcttttagctatttactttagtttttagttcttttgcatggtgccctcgtgaggtagactccagtatgttaaattagaaagagcacaaataatgagaactctatggaagctgtgctgaattgttagagtaggggtggggtttccagtgtttctgtttgctttggctagtggcatttcattcctctgccaccaaacagtcataaccactgaacagtaaatcattctgagactgctcaccaggaaatggtaagaaagggctgctgagatggctcagcggttaagagcactgactgctcttctgaaggtcctgagttcaaatcccagcaaccacatggtggctcacagccatctataaagggatctgatgccctctactggcatggaggtgtacatgcagacagcactgatacatttttaaaaaacgtaataaaatgtttggaaaagaaaatagtaagaaaatctatttttaaagactaataaatgctccttgcagcctctatggttgctgtgatttgactttcagttttctaaaacaaggtttgacctgtagtagaaaactttgtacaatttttttttttgagatttgtttttattttatgtgtatgagtaatttgcctgcatgtatgtctgcataccacttgtgtgcctggtgacaggagagaccagaagaggacattaggtttcctggaactggcaagtaggagccactatgtaggtgctaagtattaaacccaggtccaaaagcagtcagtactctttaactaatgagccatctctctagcccctaaaacctttgagaatgtgctgtatatagtgggggtgggaggaaaggtgtaattgtagagttcagaggacagcgcgtaggacttggttcttcccttatactgtttgggtcctggggacgggactcgggggtcatcaggtttggcagtaaatgtctgtaccatctaagccatcttgaaacaccccaccccaccccaagaaaaaaaccttatccccaagtaactttatgtaaagcaactaaaattgccagtctgatctcctaggctttgaatgtgtagttaacaatacatgtaattcttaggctaaacagaaatataaaaatggaaaactgaaataatttccatctaaggcaaaagtaattccaggtgttgtgattttggtaacattatattgaatatctgttgtatgtattagacaaggatttagcttcagtaattttaaattttatttcttatgtgtgtgggcgtttgcctgcacgtatatctatgcaccacatgcataggtagtgcccttagaaggggtgcttcatcccttaaaactgaagagagagaacatagtgaggcaccgatgagttctgggacttgaagctgggtcatctgagagtgcagctactgttcttaaccactcagccatctgtccagccaacattttttatgtcagattgaacttctagaaccaccttgttgaatttctgtcatttgttactatgataggtactttattaaacagtgacgactcaatagcacagctcttttttgatgatattaagattttcaatgtggaagatcaaacaaaaataataactcaggtgtatttatttccctttcttaggacagaggtatctaggaatgaactccaggaatcaccatactctccaaagccatgtctaggacgtgccctccaatttctcagtttggagcacctcgctttcctgtgttgactttttctagagtgggttatgcccatgcacatattgcttacatgctgttaattaagactctatagccgggcagtggtggcgcacgcctttaatcccagcacttgggaggcagaggcaggcggatttctgagttcgaggccagcctggtctacaaagtgagttccaggacagccaggactatacagagaaaccctgtctcaaaaataaaaaacaaaaaacaaaaaaagactctctaattcccgtttctcctataagtgtgactcttgatttgtagaagccttagtttttatctcctgagactctgggggctcaaaactaacacctcacccaggccaactaagtgatctccacctgagctgcaagcccaggcctggggcagtattccacctcttgtcagtgtgctcagttttttaatcttccatatagtagaagaaatgccatacttgtaagttaaatatttagcctagctaacacttcctttttgttgctaaaagtctctattttctggttccttaaatgattatttagatccagaatacagaaaatttttggagagttatgccacagacaatgagaaaatgacatctactccagagacattgctggaggaaattgaagccaaaaatcgagaattaataggtaagtaggaaaaggattttggccaatggcttttcagtctgactacctaagtcttgtctccgcctgcatgatttggcagctgtgtgatcctgcaatcattcccttccctgaaactgcttctatttgaacgcatacagtaaacacctgcctcacaggatggggccactgcatccatgagatgagattctagtggcttccttagtgttatacagctgtggtaataagtatgccaagcttaaagcttgttacagaattcctagccagtggtaagtctttgaagaacaattggtgtctcctagcagtaggttcttattcctaaaacttgacctggaaatctaacagctgaagttcattactgtaaaattgaaaatctgagaaattttagctcagatgtttgttttaaccaattgtaactagtgacatagagtttgacccaggatttccacccctaggaatttatcccataaatttgttctacttaaatacataaaaaaaccaaaccaagccaaaagattgtaatggcggcatacctttgtaattccaacacctggggatagaggcagagaaagatcagaggttaaaaccatcttcggttacatcaaccagaccagcctgagctatattagactctatttctaaataaataaaaagaaagaaagaaagaaagaaagtttttaaaaagttgtgttaaggtgagatggctcagtgggtaagagcacccgactgctcttctgaaggtccagagttcaaatcccagcaaccacatggtggctcacaaccatccgtaacgagatctgactccctcttttggagtgtctgaagacagctacaatgtacttccatataataaataaataaatcttaaaaaaataaagttgtgttaaaaaagatgccatcaaggttaatatcattcagcatgttcagcatgttgaaaaatgaacttaaatacatttcttttttaaaactcatttttgttttgcttgtgtgtttattgttttgagatagggtttatctgtgtagccttggctgtcctggaactcagtatgtagtctaggctggcctcagaactcacagagagatctgcctgcctttgtctccctagtgtgccaccatgtttgacccattgttactgttttcatggtgtttacatgtgcaggaggagggtatatgcccacaagtgctgatgcctgaggaggccagaggcttccgattgtttagagctccagttactgtgatttctattaatgaatatgcagaatgagctcatttctgattgcttccttagactacattcccagagttagaatgaggacatcagaatgatgggtgtttgtattgtagcccaagcctgtccgctcaggttctgtccagttgaacaaaacatctgctcctgtagataagaatgcacttagttatgtcttaccaataagaaacgacttgtaaaaacgttcagtatttcagtgagagctgatcttttttccttttcccttcccctttctctctctctctctccctccctctctctccttctctctctctctccctccctctctccctccctccctccctccctttcttcctttcttccttctttcattttttgagagggtctcatgtaatcctaggctggatacaaactgtatagtcatatagccaaggatggcctcaactcctaatctccataggcatgtgccaatatacccagttttatccacatttaaaaaatatattttaagcctccgttttgaagtagaatactctaacacttgtttgagttgatagagctgtagattttgtgagagatgtactcctccatcctaagtgggtaaggggatggtgaaatgtggactcctttcccggcttgattaataatctgcttatgctttatagctaaaaggacaacgccccttttgagcttcctgaagaacaagcaagtaagtgttccttttggtagttgtcttggctccttattagttcgcagtgaataaacattcgaaagccctggaatcctacaggaagatagctaccttcacaagttagccattaaacttcgttggccatgttattcatggcagttgtgggcctaggagtttacaatgcagacctggagagagctttgccgtcccagagacattttggagttccctgacagcctcaggggatatacaaaggaaatgtaggggcagattctggtcttgattcttgagagaatgtatagtaaggatgttgtagaaagaaggagagaatcagataggttagcaggtacccaaaatgcctttggggttaactgtgtttttgatatgtttgtaatcagaagagtgttgttgttatctctagagaatgagagaagaaaagagagaagaaaggaggagacgggaaatagagaggaaaaggcaaagagaagaagagagaagaaaatggaaagaagaggagaaacgaaaaagaaaagatatagaaaaactaaagaagatagaaagaattccagaaagggagaaaataagggatgaaccaaagattaaggtatgaaagtaacagaagctgactgcatgtctctgaaaactgcatggatctgtttatgcatgagccttgtgttgtggcaagttttgttttgtttttgcactttgcgggggccggggggggggggtagaaatagatttcctgtcatgctaatagcattaagttttaagctttagacttagaaggattcaatactttacccaatgctgtcatccttcattgcgatctttttttttttttttttcctaaatcactagtaatgtttggtatgtgggtcactagtctctcagttcctgctaaataaggacttaggtgtggcttgcatgaatttgggggttttgtcagcttttctttcataaatgatacatgaagttgcctcatctgtttgttttccactgtcttcaggtacacaggtttctgttacaagctgtgaatcagaaaaatgtaaggatcaagtacatgatacagagcacctagtatcatgtcgtacactcaggtcttagctaataagaactggtggtggtggtggtagtgttacatggtaaagctcctacagattgacttggggctttgtaaaagctgagctttttgacatctctctttaaaaggaaaccgaaaaccaggcatggtgactcatcacagcacaagggtttggtttgaagctagccaggcctgtggttccagatcctatcttaataaaataggatagaataaaatagagggaaccctgatgctctgttggtacccagaagccccagcaatataggttcagaggaaagtcaggctatatagcaccttctcatctttttttatgcctctccgaattgattgccattggagaagagtatggacagataccctgccttaagagctttctcttctcatgtgattcctgagcggctttcttgcatctagaaatctatgagcagcagatgcttactgctccattgcatataggaagaggaagtcttgtagagaaagctcagccttgctgcttccttcccaagggcatggcttaggcagcgagcatcccagagaagtacttgcagctagatcttcagaaagtctgaaagcatctcacatataatggcatggtcgccttcttctactttctggaaacacaacaaacagtttaaagggctggggtttcctgagtctcttttgggctcatcattgctgatacaggggaaccttctaccacagttccttccagcttccgccatgccgcaagcgatttgacttgctagtcctcatgaagagcaagacagaaggtagagtcagccatgctagagagcttctctaatgttcttattagagtaatgaacatcttggcatctaatgcagggagatgttcattagagaaacctgcacatctgccctcattttgctttgggcccttcattgtgtcaattttggattcccattggtagttgctgtgtgtgtgctgaagtagctcatgcttaattaagtgtggttcctttgccttaagttttaagcttttgctttgtgacttgcatgacgccttctccctgagatgaacctcttatgatgcatttactatgatattttgttttgcccacaaaactctgtctatccaacgcctctagcagaggtatctatgataactctttatagcaatgaggtcagaaagagcgtcatatgtggccctgaatagacatgaaacttcaaccttctattattctataaggcttttggattttaaaactccagtgccaagtaattgttgctatttatctctaatgataatgtgactatactatcataaatatgttgttctcaggcttcaggcagagtcattcctgcaatggatctctcctttggtaattaaggtatttggcattccaagaatatacacataagaaaaacaaagtagccgggcggtggtggtgcacgcctttaatcccagcacttgggaggcagaggcaggtggatttctgagttcgaggccagcctggtctacagattgagttccagaacagccagggctacacagagaaaccctgtcttgaaaaaacaaaaaaggaaaaagaaaagaaaagaaaagaaaaacaaagtaacaaaaaatacactgattcacttaaaagtttgacctgtagccaggtatggtggtacacacttttaaccagcactagggaggcagattgtaatttcctggcttgcctgggctacatattaagaacctgtctcaaagccccttcaaaagaggttgacttaaacccaaaggagtcttgataccattgccacaggatgctgaaactacttcctgtgcagggaatggtacattcacattggtagcttccacttaataaatcactcctgtgctcactggaagtttgagactaatggcggagataaggggtcttctgcagtctaaagttaaaatatttagtatattgcggggtttttgatagaaacagaaggcagtgccccatgtaccagaatgaaaaataaacatttttttctttaaaagttgctcaggaaaccggaaaaaggagatgaaaaagaacttgataaaagagacaaaaccaagagactggacaaagaaaatctgaatgaagaaagagccagtgggcacagttatactctgcccaggcgttctgatgtcgaactgaaggatgaaaagccaaagaggtcagtcagcagtgagagccgggccactaatgcagatgccgccgtgtcctggacttgtatggaattaaattatttgtcatggcgcacacaacctgcagtaacactcaggaggctgagataggaggatgggtagcttcaagatcagcctagactacatagcaagaccttctcaaaaaaatgaactactgggctggaaagatggctcagtggttaagagcactgactgctcttactgaggtcctgtgttcaaatcccagcaaccacatggtggctcacaaccatccgtattgggatccaataccttcttctggtgtgtctgaagacagctatagtgtactcatatatataaaataagtaaaataagtaaatcttttaaaaaaaaacctcttatttaaaaaaaaaaaggagctgctttatatggagtagagggaggagggtcatatgtttcaaatattctggtgtctccagctagatgaatgaccgctgtcttttttttccttttaaagatttatttttattattttcagaaatattatttatttctattattttgtgtgtgtgtgtgtgtgtatctgtctgtctgtcttgggtgtgcctatttgtgcatgtgcccaaggaggccaacggtgtcagatcctcctgtagctggagttacaggcggcagtgagccacctgatatgggctctgggaaccaaatttgggttttctgcaaaagaaatagactcttgacttatgagacagccctccagccctgacttctggtttttcttattttctaaaacaactcctactttttcctcagctgtaaaagtgcaccctcaataagatggccaacttagaaccacagtgtttccgtatttgcaatcataggatgtgtgaaggtttggcctcaccgttgttttctgttccgttctattttgtcttgtcttgtttttcagacaggctctcggagccctgggcacttctcacatcattaggcaaagcactctatcaactgaaaggtgtctccagccctcttgtttatttttcacacaggctcgatgacgagggtgtcagagattacagagacagggaccgggactatgagagagatcaggagcgcatgatccgagaaagagagaggctgaagcggcaagaagaagagcgccggcggcagcagcagaaagaacgctatgagaaagagaaggcttttaagcgaaaggaagaagaaatgaagagagagaaagaggcacttcgagataaaggaaagaagagtgagaatacagaatcaatatgctcattagaaaaaattgaaaaaaaagaggaagtggttaagagagaccgcataaggaacaaggtgctgctgtttttttattaaacttggttgtttttatgaggattccccccctattcttagaaggataaatttaaaggaatgtgccctatccccacccccactaggtattgaatcattgcaagctttctgccagtgaacttcatccccagtccctattgtggaattttcattttctttttttctaatttatgtatttattttttgcatgtgtgcacatgagtgtgcacacgtgcatacatgtccagtgcatgaatagtggtgagaggacagtttgtgggagccattttctccttccaccaggtgggttctagagattgaacccaggttgtcaagcttggcagcaagtcctcttacccaatgaaccatctcatcagcccaatggtaatttctttctttgtttcttttcttttttgtttttctttttctgttctctttctttctctctctctttttttgtttttgtttttttttttcaagacagggtttctctttgtagccctggctgtcctggaactcattttgtagaccaggttgaccttgaactcacagagttccgcctgcctctgcctcctgaatgctgagattagcagcatgccccaccctgcccagcttcaaaggtaatttcttactatcctaattattcctagtgagagtttcccagttgcatcattaatgtctttttaaataagggccatgaacaatgttcatagtgtgtggttgaattctattttgatctaaacaatcttttttttccctgatacataattgtttgttgtagaaaccagtttgtcctatgaatcttctcagactgtacattggcaaattataacttctttatctcattgaacatatatattctgtttcttttataattactacttaagcactagtactgtcatagacaacagcataaatggaaccataggttcaaaacacagcattaaaaatttataattaaacaatttttaaatgaaaataatagtcaaatcttggaaaaacagctgctaatattttaggctatctgagccatatagtctctgtcacaacagctaaattctttaaggaaatagacatgggtaatatataaaaatgagcttggggttgagtgtgtttctcagtagttaaaagtgctggcctagcttgcatggcaggacacagcttttatcctagcacttgggaggcagatggaggaggatctctggaggacagcctggtctatttacttgaatccaaggacagtcggggctatgtaaagagaccctgtatcaataacaacacttggggctggagagatggcttagcagttaaggggtgaatattttttattttttcaattgctagtacccatgtcaggcagctcacagacatatataactccagtcactgtgggcaactgcatgtacttatagatacacatgcatactacttccccacacagttaaaaaaataataaggaaaaataaatcttttttttttttaaggctaggcatggtgtatacctgtaatcccagaacgcaggggcagaagcaggtgggtttctgtaaggcaagcagatcttttcttttttgctagggatcaaacccaaatctagttaggcaagaattctaccactgagctaaatcaagccaaacttaaacatatttttgtgtagttttagatttttataatgaatttattgcatgggacatggtggcccatgtctgaaggaggatttcaagttggaggtcagcctaggctactttaggccctgttctccctctcccaccacaaaaggcgatttactggtagagaatcacaggcatgtagttgtagtttctccagtgacttacacccccccaggccagttgtctaacccctggctttgaatgtattaaacactctgttactgagctacagcttggcccttggttcttgtagtttctaagtttaaaaaaattaggggtaattaattcttattacctaatacctataaattaggttatcttgaggtagttttaaaattaggcgaatacattatatgcatgtacaaaattctcaaagaattaataaaatattattttaaaatttagaggggctggagagatggctcagcggtaaagagcaatgactgctcttccgaaggtcctgagttcaaatcccagcaaccacatggtggctcacaaccatctgaaatgagatctgacgccttcttctggtgtgtctgaagacagctacagtgtacttacatataatgataaataaatctttaaaaaaattaggcaatagacttctcaaaacatcacccttggcatgttaagtaattcttaaatgactacaggttgagcatagtgctaaacacttttaatcccagcattctcaagaggcagagacagatggatctctgtgagctcaaggccagcctggtctacatgggaagttccaggactgctagactacattgaaagatcctgtctcaagtaaagtgacagcagctagagctggtggtgacagcttgtaatcccagggaggctgaggtaaggagatattaaggtcaaggctgcctgagcaatttagtggtagcttgtctcaggataaatagaaaaggactgggaatatggctcagtggagcactaacctgccatgcactaggcacttgtttcaatccctcctgccaaaaaaaaaaaaaaaagtttggtttttttgttttttttttgttttttgtttttttttggaggagaaaggaaaggggaagttattatgtaacatatatccaggtctttggtctggatatatgagtgcataatttagggctgcggaatctggcccccatgttaaagcagaataacagtgttataacataaatggctttttttcctttcaggatcgtccagccatgcagctttaccaaccaggagctcgaagccgaagccgactctgtcccgccgatgacagcatcaagcctggagattccccagtggacaaaaagcaggaaagtggtattagccatagaaaagaaggaggagaggagtgagaagtccaaatggtcataggtgtcctgactgtccaggcagccaaagagcacgtattatgctatccagaagtgccttcagggcaaaggaacagagaacaagaaaaggggtcgctgtgctggtgggatgtactacagaggagtgtgtctaagcagaataagattgcaggctcagaaccgaaggacaatttcattgttttctgcagtttccacaagttaattttaatgtctcagaaaaagatggtagcaagaacattgcaagtgaaaaatgtcaaataagggcttaactttgtatgacagctaaaaagagcaggttcgaaaatcaatgggtgctcttaatcctggcttggagcatcttcgtttgagtggagcagaaacacactaagtttcgttgggatctaactattttgcattgttggtgttgactgttgactctgtagtgtaggagcaatgagcatgtaattgtagcacaagtagagcggaggatagagcaaattatggctgatggaaaagatttaaatagtcacgttacatctatatcctgtgtctgaagttttcataattacagcttgttttaattctgtaaatgtagcatcaaaaattccttgtaaacatctcgtttttgcctttagcgttttttcctattactaggtaaaatgtagcccttggctagttactgacaatctagtctttgttttatcttaggtctgatgatttgagtgcataccctcttccaggaaggaagctacaccattatctgttcctgttatggcagctttcagtcttagcttgtttttgtaatgctgtcaataaatttccacttcgttccggtttgaa

SEQ ID NO: 706 - DNA, 1447 bp, mus musculus
tgcttatcactagggctatttgttaggggcggagctcctgaggtctctcccggagagtcgtaggtgcccggcgtaacggcttagcagctgtgccaccgctctaaagagcgtaaccgtggccatgaaggaagaaaaagatcataggcctaaggagaaacgagtgaccctgtttacgccgcagggcgccacaggcggctgtattggcgctactgccgaaggcgccaaaggggacgataggcaggatcgcaacagggacaagaaagaagctttgagcaaggtgcctatcgggtggtggcacaagagggcgggacatgtccacggactggggagcatggctgggaatggggctgctctcttcctctcccgggtaactcttctgtttctaactgaatggaaattgcttcgcactgtctcacgcactggtggaaatgggattagcaggttctgataaagcccccgaaatggggggatggagggtgggggtgagggaaaaggagggttcccagatgagaaaaggttagttcagagctgcgacggtggggtagttatgagagaggggagcagcaggaaagataggggaactttaattggcttgaattgctaaatagaccttgccacaccaggggttaggggtgggagtaattgtgaagtacgtgttaatgcaagcgagttgggggagcacattaagaggattgatgaccaacctggaggagcagacagatggagggcgatgggtaaaggatttccgtggtacacagaatggggaagggagttcatttagcgcattttagaccggtgagagagacaatgtcgcgacaccgacaaaagaccagaattcgttcaaaatgggttttaaactccatttaagaacagaacctgggattttccttgccccagacagttgtcacttccaggagtttgtataaacccgcgttatccatacctttgagtaattcatagcattggattgcaggagaatatgttcggtgtttttgtaagtgtctgtattttagagccgattatcagaagccatgattctggtatgccagaaagttggctgctatgtactgattttcctttcctcgtttgtttcctaaggtggtaattcgaagattacctcccactttgaccaaggaacagcttcaggaacatcttcaacctatgcctgagcacgattattttgagtttttttctaatgatactaggtaaaaaaaaaattaatattttaccctccttttcgctttttgggctagtgtctttaatgtgtatgtgtttgcaattcagtcagacacctgaaaccatagtcacgtaattgctttccgtctctacagcctttatcctcatatgtatgccagagcatatatcaactttaaaaaccaagaagacattcttttattcagggaccgatttgatggctatgtattccttgacaataagggtgagtata

SEQ ID NO: 707 - DNA, 277120 bp, mus musculus
ctattattattttgacgactcccgagttgcgcccatgctcttgtcagcttcgttttaggcgtagcacagccaggcagaagaaaatggggcaaagcgtgctccgggcggtcttctttttagtcctggggcttttgggtcattctcacggaggattccccaacaccatcagcataggtaagctccccagagccagccagagggggccaggctcttctgcatttgaaacccactaccctagtggggctgggggtatcgcaacatgagtccctgtcctgcatggtttggggacggtgtctagggatgggggactgagctgagatattggagacctgagctgcaaagaactgacgagtatggggagcatccaagatgagggaaggggtctcccggggctaatgcgggtggacggccaggttttctgaccgaggagcaagggagtcaagctggaggttgggatgctgcaagaggctaagagtcgcggcttttcagctcgctattctggactttgccagggcatgcttgcagccactggaagttgtcccagggtgatactgcctgtctggccgcgccaggacgcataacctgggcccaggtcgccccgtcccgcgtctcaggcttcagtgagacaggacagtgttagaagaaaaggaacccactttgaaacccccagaccaaggaagtagctgtgtggatggaggatggggtgggaagtgggggtgatacaaggagtcgggcaagcagggaagtcacgcagaccaagcattcatgaattgcggctgtgtctgtctggagaccagctccagtagccggaagggagttctccccgcctctgcctgtatttgcaagtagagaagttagaattgttgcttttactgaactgaccccctgtattgtcataggggatgattgggacagcaaggggaacgaaattgtttttcttcccaccctatcccctgtaccccaggagggaaaatgaaccagctgtgtggctaagggtgggggtggggttggagtcagggttcggggccagactcaagcttaagaaagaaccaagtcccacttttagctccttcatccttcccctacagcagcctcctctttctcccgtctttttagtttcctccgtgtacaaaacccaggtttttcacagtggaaagcagagtttccaagtcttgaaagacacacaggttgaaaaaaatcattcctcagttgagcttcccagaaacactgaggtagcctggtagctcctgtttgttactttctaactcctgctgaagtaggggggacacaagccgaatctccattgcctttgcttctaggtggacttttcatgagaaacacggtacaggagcacagtgctttccgctttgctgtgcagttatacaacaccaaccagaacaccactgagaagcccttccatttgaactaccacgtagaccacttggattcctccaatagtttttctgtgactaatgcttgtaagtagatctgcgttggctccctttgggaccttaggggacctcatttgcattttgtttgtgatgtatggggctttgcaaacgtgtgtgctgggggtgggggtgggtagtgattgcctcaataagcagactgaggcagttgtcaatcctgggttcatgttgcataaatcaaccttgaaggattctgctgcggggctgaaagcagtgggcaaaaactctgaggtgaattatgtttgatgcaaaacttccactttcctccctgctaaactggtggtgttctctcccccgcacccttttctgttgggggaaaagaaagaaagaaagaaaatagcatggttgttcagggaaatttcagatggaatttttaaaaaagaagcaacagcagctccttgattgagagaatgcggggcatgcaatacttgagtggtgaagctgtgtctgctggtcggaatgggctgagtttaatgatggcctgacacataggaacaaaatatgagaaccctgcaaacaagtgaccttgaagcatagatcaggctggattccctggcttctttctttctgtgctacccagagtgctctgataggaactgataagactacaaactgattgcaagtgataaatgcatgtcagcctaaaagcaagagggaagaccgtgcccaggtgactttttggaaagccaatcctgcctgtgctatcgtgcctgcgcacgcgtgcacgaacacacacacacacagccacacactcacacacacacacatgattgttaaggacaacacagttcttaatttagagcaagaggttggttgtgggaagaagcttgaagcaggaaaactgaatacttaaaaaggggagtttcatcagccccaaagccatttctggaatccacctttatacccatggttatctcttttcaaagggggaattttaacagtaaaaccacaggaactcaaatggttaataacttgttggacacaggtttttgttttgttgtgtttaacttgagagaacattttgtgagaaacactgaattcttcatcagagctttgtttcactaaaagtttctcccaaatgaagccacttaacacaaagtatgtcttgtttctctggaatggtgtgctttgaaatctgaagtttcaccacattttgggaaatggtatttatgtctgttggaatttaactttgtatatgactttcttcaaatccttccatctccaaaaatgtgcaatccctaacagtccttaaacaggacctcaagagcaaatttcattggatttaaagtcttggcttgaagagaagggggagtggaagaagtacttttcaaaaaatgtaacagttatccgcctgcagaaaaatttagctgaaggtgcagattcttttaagaacatgttctgagacactctgtatttgacattctttagttttccaacactgacaaaaaaaaagtgtgaaagttacaaaatgtctggctatacttcctgtcttccttttgtaatccccgacctctctccagcatttacaaggcacatctgattcttaatcctgctgcactgcgatctcctcaagaggctgaatctgaaaggcagtttcctaaatatcaattagaacagatttaaaaccaaatacatgaaaccaacggggtgcattatcattaacaagggataatacatatttcatctcccttccctgtctttccactgatgaactctgggctaagagggtcatttggtttctcaggaatgattgatttccaaagctttgggttttgttcttctgatcaaactgctctgacactcagcagcctgcctccagctagcagaacctgaacaacagtcaggaaatgatctctgtcatgagaaaaaatctcaggtttaggaacaggtaataaaccatccatattggacagtaagtggccagtgaggggactgggaaaccaactgatcagaatctctcaacttaaacccatagcactcttacttacaaagctgggttatagttgcacacttaacaatgtaagagaaggggttagattcactaagcagcaagaaaaacaagaccaaaaggaaacctcctccttagttatgtcaaatacacacaggcatacacacttccagggcacacgtgggagaacaatctagaaatcagtgatgtatgcctagctgcctgttgcacactcagacttgacagttagctcagaagacagcagagagaagctgccatcttctctggtccctggaacagtcatgtctgaaagtcacaattgtctgaatgggagtagatctcaaagctgtctcctggcagctgctgcttggtggcttagtgtgagaaagatacttagtccaactgtagcctctgaaaacaacaattcaagtgggcagagaaatgttggcgatgtctgttccatcctccctgcccccatggcctttattgtttttgtggaagtatgagtcaaacctgtcagatacaagcaaacaattttaacagtacttgaaccaagcaaatgactacagatgccagtccaccaagtgattattaccaatgccacagaggaaacaaataatatcaatgccctctagccttcctatctggggaactctggtgaaaacctcagacgagtccaaatctggttatgtagccctcctatctagttcagtgtggaactggactagcaacaatgaaataagcttccttgtcatgcagagttcccagtttcagctttctttggggctgaagctgatctcctctctggatctccgaccctggggcaagcatatactttctagggcataggtatgcaggaaaacggaaatgtgaggagtaatgccttctgtccccgcccctgccctctgcttcacctctgcactgtcacctttctccatgcaaagtattcagaagtcgttctcacaatgaatcctaggcaccagttatttaaagactttactagcaagcaagcaagctttttcttttcttttcttttctttttctgcacaagcctcaagaggtttgcttaagacagactctaacttcattctgtgccttaagaggccaataaaagcctccctggctttgaaaggtggttcagttgggatcttagctcagaagagaatggaagtttcgcagaaagactcacctgatttagagcacatgttcccatttcataggaattaatagagtccactgccttacttttaagtttagccgggtaaaggcagagagaatgacgttgtaactaaaacggtttcagcattcatgcctccgtaaacatagaaaggcacacacatgattagtgcataagagaaacaatgcacgcccattttgtaagttacagatctagcatttaggggaggagaaaaaaagaaccaaaccaatgtgataattctctggcttacaagggtagggaaatatcaggagattgctcagtcccgtggtttgactttgctgtcccgtttcctcgggaagccccgttgattcccttgaagtcccctcctgtgtcatgccgctgtgcacttgtagtgcactccacactacaccgccccagcctctgcagtgtcagctcattagcacacagatctcatattccctctccgcactgtcattgcaaaaattgctgttgtacacctttacagccaacaaatgtgctcgtggattacgtactgaagcaggggaaaggcaaatgcaacctaaaaggttattcactgcagaattgtcctctaaatgcattggcttaaataaaaatctgttgatggaagaagctcagtgtggatgctgagactgacagtggatgggggactacttacaggagtaccaactctgatggagccctgggcaaaattccttttgtcagctaaacctaacctatcaacagcaaggttttcttctactaatgtttacaagtgacttgaaatctacctgcaaactgagaacttcccccttttataactgagcctgttttgctaccaagtgtacttagctgagacaggcttctatctcctacccacagagtcacaatctaattatctaattactctaattgccaggaaggagccacttaaccatttaggtccatttggaaaagaaatgtctctcttgatcacaagctctgcaataccatgggctttgttttggctttgtttgactgtttgccttcctcatataagcttagaaacgaagatgaataccctgagattaaggctcttgtcctgctataggttgtcaagtcctaaccattatccgctctgaccccacctcccccatgactgaaggatatttgcacttttgctgccctgcctcctctaccctgtctcctgactagtcctcaagaagctcactggcttagttttttggtccttttggccagctggcttagcctactgaagcacgaaggggacacctcagtggtgccagtcaaagatttaagtcaccttctcacaaggtttatcatcattttttttccttaatctatgctttgtaatggaagagggaggatggcgaggctgttcattttggccataaaaatagatggcaatcagcaggctgtaaaggtgagcttcctgcaaagtgtattaccactcatacaagacagcttcctattgatcttataagtgaaggcaatggagaaaggagggtttgcagaaaaataaaagaggaaagagaattactccgttattctatctgtgtttactgaaaagtggggccgttgtttttctctctctctacaatttaaacttgtttttcttctaaataaaactagtgttccatatgccccatcttctacctcaatagagattgttttcttaattgtatgtttccctccatggtccctcaaattgaatgagtagtgggagatgctttaatggttttggtccctgagatatctgtaacttccacggctacggggattcagagatgattggctgcttctgttttgacagcttgagaaaataaatgaaggtgttgaggtgttgttgtttgtcttcctttctgcataggagatttgtcatttttatacaattgatttaaggattaaaagacaacaaatattttttaagagatgaccagaaatttaggagctagaattcattactttggaacaggagaataaaagtccttatccaaatgatttgcctttggatttcttagatgggggaccactgatacattttaaaagaacttttgtaaaactttgtatctcctataaagatcaagaaaatcatattaaaccaaattttgactcgattcctttgcatgttggtagtttaggcctaattagaagggatgtccaggagacctcaccattaaagcaaccaatggaggcaatagttatgctttgaaaaggaaaggaggtgtccatgcacaaaagcagctccctccctctgaaagctgctcaggggccatccaagccccagacacagagttttaaatatgctcagcctaaagtctagaatcaacacaaagttagggatactgtctccccaaggagttaatgcttagcaaactgataatgtgggcaaaatttgtatttttcatatttctactctttttatcattatgatttcctttcttactctggctgtccagctcatgccgttgcctggtctccaaatgcctactcattggcccatccacactaactttacatagggactatttcctacactgagagtcttggtctttcttttttcttattagactgtccttgctcttagttaatgctccttaaggactatacactactttggggataccagcttttccctgaacacaacaatataacctaaagtggtagaagagaggattgaaatgcataacaggagattattaactttaaaacctgggagtataagaggcatcatgtctcaatttcaaaggaagatactcaaatgggggggtggttcttaggatataatattcatattggctttttacccaaatcaaagtcagcaggctttggatatggaagtgttttttcagggaaaaggtagctattcatagtaggatgggtatgagtacagctaaaccacaggctcagtttcaagtgaaaaacttgaaagtctttgggacaattttgggaatcggcccaaatacatagggtttcattttattgaagtagctgttgtaagagctgtaactatatgtgggcagtggcaggagatacattgtaccaaacgaaagtcattcaggagaggagaggagggtggtagggaagctgagtctcatgcagaaggtttctatcctttggaatggcatgtggaattgcatgccagtggtggtaacactggatgcactcagtacctagccaagaagcagctccctctcatttcctctagctttctcttaccttggctcagtcatatattgtggtccctctgcctatggaaggatccatcctactctcttctggactcacactacacatgagtgagggaaatgaatggtggccctcctccctgtttcccaattgtcacttgctttttaagcattgaccctcaatgcaacactgttttagcttgtttgcaaaagtcaaaggaccatagataagacgggaaacagtgctggtgatggtctcttaccatatgctgcacaattcaatacaaaatagcatttatcaacctttcatgcatgcaccatatgcatgaaaggcatgattaggatttaaaagtttactatgagcccaagacttttcatttctagcaagttcctggtccttaaatcacattttgaacaacaacaaccaaaaggccaaagttaagagactgtatttaccaaagtaaaggttctttgggtcacacttttatcattaagatttgtctaatgaaacaaagttctgcacaagatacatttgctttattctgagtctcatattcccaacaatctcatgtccatttcatccaggtaggtgtcattattagatgcccactgaaaacatttgcttaaagttggttcttgtaagagtgtggaatggtgagctacagggcaggctgagagagaatgtagcccatgagtcagaatgacagtgtcttggctccttgccacgtcccaaagtgccctgtttagaaactatatatgcaagagatctaaggttgctttgtagttccaactctttttccactttgcttctctgggtcaagacatgccagaggaggcatgtaacaactgcttttcagctgcccagcttctcttaaacagggttggaaacaagaagcacaacagaattctttcttttttcaagaagagactgaaaaatcaactcaattttcaggtactcagagtgaaggaagaagtgtagtgttgcttctgaacatatcttagctaaggactgatccaaggaagacattaaaagaattgccaatgacatttgaagactgaatctgatgcaatcccaccccacccccacccccaaatactgtcactctaatggtctgcctttagtctttactttaacaaatttacttatgtgcattattgcattagaagcatatgctaaaatctgagtatgtaatctggaagtgaatgagctaaatactttttactcacatttaaacagaattatttattccggctaacacctattacctttcagagtcctcagaaggagatatccagaacaggtaagtaacgtagaataagacagctacctgccaaagaaagttgagcaaaaaaaatggatggtggaaattaagaaggttgttgatagaaaaaaatggtcaagaaaatacacactatctctttcttcacattggttctcagttgtaaactttgcgcctttattcactatgctcttatctctgtttgactatttcaatggcatttgacccatgaagttgctctcttctgatgcagtgagcctgctgcctgctttctgcatgactgttcgttgccatggataatggtgaagttgggattttctgtagttaatgtgggaaacttgcagaagtaaaatcagtttgtaagcaaaggcagtgagcaatttttttaagttttaaaaattgttatgataaacctccttcccccttcagttatccatggttggctgattggttaccaataaaacaggtagagatcagcactcaacccacagaaaggtaagtatatggacaaaggtgttaatatggtgttctctgcatgggtgaattgtaaatttaagacagaactgggatcggacatttgcaggcagacagaacctgttatagaaccttgaatatcctttaatttcactgcaatctccaaagatgctcgttgattagtttaagtcttggattggaccatttacatcaaaatcaccaaagattttgctttaaatatgaattcctagtttataccccaaatgtatgaatcagaaaatacatgctttaggcctatctagcaagttttgtgggtgataataataacataaatctaatttgagattcatgtcgttaataaatcctgatgctataatgtgagatatgcagattcagactgcaaactattgaatacccactaagcagcaagtatcgtgcctctatgcattttcatacatgttgcctttttgggtaattgaactacaattgatccatgtaagcagtaacaaatttggctgccaacctgaaaatttaggctaggacttgagaaaactaagcctcatagtctctgggacaaataaagtaacaactctgagatggcaaatagaaacagggacatggttttcatttttactgtgtatcttcctatcttggcttgttagccaatgatggttctttaaatatgctatgaactagatatgctatgaactagatgtcatggtaaatgtcagttcatttattaaaatggatgcattgcaacgatttactgtagcattcattgtggtcttcctccccatgattgttataaacaaatttaaaacaaaagctgatataataactaccactccactgtaccacatggaaaacattgtccaaggaattttatatgttatttcccaaggaatcattacatttccagaagtgaggcactttcaccccaaatttatacaaaatagaaatcataagtggttcaaaattcataagcagctagctcaaggttacacagctggctctgtggtggcgccaagagaatttcctgcctctagagtcttactcaatttcaaacggagctgaaatcttaaatgattataagagctagacacatcacatatgtggtgcatgaggcaggtatgtttaataaggaagagtgaagtgtttgacaatctctatgttccaaagccctcaacatatacaagtcctatttttaacccaccatgaaagaaacaggataccttcagtagtccctaagatggctgaatatggaaagtgcatgtctctgacatctataccacaatatatggtatactctatttagcagctaattattggtttggagaaaactgttaactggtcattataactagtgagaaaaaaaaagagagaaaagagcaaagctttattggggggggagggaggaaagacaaaatccatttgtcttcttaacaaaacattaagatgtaccagcctaatagaactctctatctcttatgcacatatcacatatgtaatcttacatacacaacactttatacagttgttttacttatgtaaatgtcacctcgactctaactttccatcagacaacggtgaggtgtatagcaaggatagaatgctaacatggggtcattaatatatatttggcagatcaaaagaggtcttctcagggggcttgctttggagaaattacttaggttctcatatatactccccacaaattggagacactatataagttaagaatctctgaagaatcacctagggtaagatctcctatattttaagagacaggcttagatctttaagccaatgtccaaaagaaacttgtatttttatttgcttgatgttgcagacagacataagcttgatgttacatgccatcgtgaggcactacttgtagcttatcaatagcttgccatagtaagagtgagagcagcatgtcttctcatcataacaccccatttccagaaataagagcacaacacaaataaaatcttgattctcattaaaatagtaagcaaggaaacaatttggtatcctattttcagactcagtcacattctgtcccctgtcactttaagtgttctaacagtaagtagtctgtttcttagttcccttgaggcagagaagacagcatcttgtggcagaattttgctaaccaagaatccttatcagtcagtagcttcaatctcttaggttgaaagtaaaaatcattgacatgtgtagccagtccataaatattggacactacctattcacaaataagaaatttatttaatgaataagtttttatgttaattggagataaatgtctgaagtgcctatagaacctgttcgtgattaaaattttatgaatgctagataactactccaggatgatatgtttctcagtaaaggcatgcctagaatgtcaattaagaccaaccccctacatacatcatcatacaatttactttgaagtcataaagtaagttacagaaaagtgagcagtttagatcccatgtttctatggctttgggaaacaataaaagggaaacagagatttatgagagtgagtaatagaccaggagttaagacaggtacccagttaaagtcccagatctgacatcaactgcctctatcactatagaccggcctctatatctctgcttctagtttctatcatttttaaaatagagaggtctttctggatgctatctgagactttgatcattgagaacctatcactaggtcttactagcttactttatttctagttgaggaaatactatgcaaatggaatccccccaactctttctgtatctagaaagttctattcctgtttattgttctagctcacactgataagtcctgggatcaaactattaaatcataaatctgatggatagtgtttctacctagtcatcacttacccttcccaatcccaacctctttcacttattatgcaacgctgagcaagttacttgatttcatcctgcctcatagtccccaataatgataacccttattgggtggctgagagtttgaaatgaaatcacaaattcatataaaacattcacaatagtgtccagtacctactgcttatcattattgatatcatcattaatttaaaatattttgagctttttgtcctaaaaacagaaacctagtttcctttgaaaattgaaatcacttgtcacttcagaaaccagatttccttcctgaacagctgttcactgagcctttacagttctaagttcttcttcaaactacagatcattttttttctgccaagaaacccatcacaacaccccctcatatttccagcccaccaacctaacctcagacatctctcacccatgcatccaactttgcacatcccctttaactcttggcagcaataactactcaggtacctccatcaagaaactctgtgagttgcatatctctgcatgacctaaggcaaaatttcaaaggaagacctatggtttcccctcccaaagaaactatatattttttcttattcaatatactattaatctcaaactgactcatcttcacagtgtgtgtgtgtgagagagagagagagagagagagagacagagacagagacagagacagagacagagacagagacagagacagagacagaaagaggttactcagtttatgtgcaactccaccaacttcccaaaggcccaggatgcatccatttctcctatgaaaatgattgaaaagaaaacacactggccaagtactcagtgggcttgctctgcagccaggaactaggacttctctagaaatgggtctgcccactgagtaatatcagaaaaagcagcaaaaataaattgtttaggggtctgctagctagttcattcctatggacaatgcattagtgaatgggctttttggtttttttttttttgtttttttgttttttttttttgtttttttttttgttgttgttgttgttgttgttgttgttttcctgagcccgaggaactgagaaaaaaaatgctccatgcattttcctccctggtaggcactgctgtgcacacaagcatttctcatacatcttctctcagccctttccacctcttggtatcactaagcccttgataattctcttaatgcttctccctaaagatggtgaaagccagatacaaccccacttctggtatatttatgagtctaggcaactgctccagtatacaagagttcaagtctactttctgtaattctggatgtcctttggcctcctggtttctgccagaatcaacccactgtccttgattcttccttctacagcctatagacatataggaacacaaggacataaaaaaaccaatgaggaaaacaaagcaacacttccccctggctaaaagtgccatggaactgcccaggtttttatgtcattcattactggttcttgtgtcttctcccttacattttctgtggcaaaagattgttgtttacaaattccttagtagaaagctatttctcctattccatttgggaacacttaacagacaaattgtagctctaaaatggactacaagaatttgaatctcgactctcttattagcagtggcctgaccttgataaatgacttaacacctctgcgaaataaagacgaataaaagaataaatatgctacacagatgctgtgaatattaaataggaagatcatttatgcaaaacatttaccatgatgtgtggcacatagtaagagccaagtgtaatggtagctactattaatactgaatggtgaggtgcttaaaaatacagatctcaaattttaactgatcaagggatgcttttccggtttccaagccctagaaagcaactcaggttccctgtgattgtatagcctagaacaagatggatgggacaatctttgaatactgagaaggctattgagtataagagactaggtttggtggtaaaatatgtagagggagaatttctgtgatacatcataaagccaggttatatatacttctaggcctcaaccatgccacaattaagtgcaattccttaggctataatcctttcttatttactgtcttagaaatgaggatgattttcttactgcccatgttgctttggataaaggatcaaggcgctttggataaagcagcacagagggtggcgtgataacattggcatttgctggattaaaggaaagaacaaactttcttcagatataaatggttttttttttaatgttttagaagtggcagagtagaaaagtgaacccagacatcttcacacaatcaaggagaaaaatgtagtttgagctttctcatcaggcgcagtttatgtggactctttaccttcaggtgatacaggcagcacggatgcttggagcgcttccttttgactggatgccttttccccctttggatggatgatactgtctgagtcaggctggaaagagcaaatgaaggcaatatgggaaaggttaacagaaattttcctaacgtgactttttcctcatttcagtctcctgtctctccagagcaaaggttaagcatctaatttcataaatttgctagggagaatgctgcttaggacccccagacaatgcaggcagctttttccccctgtcttcctgtcacctggccttgctctatgtgcagcctgtctctgacaggctgaaatctgggtgatgaccaaaagcagcgtgtttttttttttcatatcccaagatattcatgctccaccagcttcatctcctctctcattattatacaaggccactgctgcttttcttatagattaaaaaaaaaaagacatggttctcagcaaagggaactgaggaatccaggggctaagtgactgcactaaggtcccacaactggtagcagaactgggttggcagtctggctcccaactcttggcacttcgctaagatgtcttcttaacctgcttctaaggctctttgctacacagtgatactctgtaaaaaaatgacaaccttgtcagttttaaataggtgctagaaaggaaaaccaaagtcacagcaagtcaattagggaagcagcaaagctagagtttcaggggccatgggtaatgataatgtgtatttagtggccccagagctaacttgtcaacattttaccaccctttgatttatcatgaggagtgggcaaaacaaaggctaaaggtgtagagcccacttatgcgtcacataatttttgaactacatcaagtacttctaatccaactacctcattttgtagatggggcaagtgaggacaaaaggaagggattcatcaaagatgatgcaagatgagaatttggacttctcagtgtggtccctcccatcatcttttcaaccttcccaccagaaagctatactaaagcaataccgttgaatctattacttttatttttatttttggtgtctctttctcttgaattatgtcacatttataagttatagtatcccaaaccaattttcaaatgtaatccatcttttagtgagtatagaagttaaaatgtcaacttcaatcatgatcagtgttttaaaaaatacttcaaaaatatatatgaataaaatcagctacattgagcagaaatgaaggctgaggagacagcatcgagatatagtgcttgcctagcaagtgcaaagccctggtataacccctgtcctggaggaaaaacaaaggaagaaaagagaggggaaaacaattagagaacaaggaaaaaaatggaagaaaataaccatggactttaccacattttcaggaccatatcctgtgcttttattatatccttttattatcttggggagactttctaagtctccaaaaattttaaaaatgatcaattttatttatatttattatatcacatagttgtttattacatacttgtgatacataaacaactatactctctatagttatacattgatatgtatacatataacactactgccaaatttggtacattcagggattttgattctcatttcacagatgtttacaattatgtaccaacttgctgtaacatcaatattctaggtcaggtttgagaacatagtgaacaaataataaataggaacttatcctttctgcaatgttcactgttcctccactggacacagcaaagaataaaaatggagtagcacatgcctataaccctagcacttagacagccgaggcagaagggtcatgagttcaaagtcagcttagggtatacaacaaaaccttacttcagaaaaaggagagagatgctattcccatgatacctctactatatggctacataaacagtatctaaacaatgttgacacccataggaatgctgtcatagaaagtaccaatcttacagggccccagtactgatgagacaggaagaatcagtctatcccagaaatgaatcattttattggttaatcaataccaagtgctcagtcctgaaattgtatatatactgtcttagttgaggtttctattgctgtgatgaaacaccatgaccaaaaagcaagttggggaggaaagggtttatttggcttacacttagacatcacaagttcatcattgaaagaagttgggacaggaactcaaacagggcaggaacccagtgtcaggagctgttgcagaagccaggtgttgcttagttacttactcaatatagcatgttcaacctgctttctatagaagctagtacttccagcttagggatggcaccacccaccacgggctgggtcttctcctgtcaatcactaataaagaaaatgccttccaggaatgcctacagcctgttttatagagacattttcttaattgagattactcctctcagatgactttagtttgtgtcaggttaatatgaaactatccagcacacatacaaataacgttatatggactaagcacattgtgcttataggtttatgaatgtgcgtgtgtgtgtgtgtctgtgtctaacaataataactacagagaaataggtgatgaatttgagaggatacagaggccctaagggggcgttggagagaaagaaaaatgatataattatattttaattaaaaataagaaagaacaaaaaagtgacaagggagatatatgttataaaacttaggcagactatatagaaagtgtggttatgatctgaagccaaattcctaagtttaaatcctatatataacatctaactttatatacatctcagtttcaaaaacacttttctatagttttctaatttgatctttataatgctcatttaagacatacatctcagtgtctctagttgcatatgtaacagaggatggcctagtctatcatcattgggaggagagacccttggtcctgtgaaggttctatgccccagtacaggggaatgccagggccaggaagcgggagtgggtgggtttgggagcagggttgggggagggtataggggactttcgggatagcatttgaaatgtaaatgaagaaaatatctaataaaaaaagagatacagctcaggtgtaattgtccccactttgtagataaagaaactaaggcctaaatatgtaaaacaagcaatgccaagttaaagattatgtagtaaaaaaggaaaaatgacccagggttaccaacttcaagtactttggaaattgtaaagtgtataaagttagatgtagtatgcagctgtcataaagtgggattacagtcacaaatgatgctagagactgggctgagtattaagagcctcaaaaacattttgtaaggaaaacaataagctgttatggaccaaaaattttgatcatgtaaaccaacatctttgtattatatatgagagacagacagacagacagacagagacacacacagaggcagacatacagagagacagacagagggagagggagagggaaagagagagagagcagcacacatcaaagtaggactagaactcacttctctcacatttgcagagtccccaaataatcatgactgcattttcttagttgacctttgttgaaaaagaaagagtaaggaaacaatttagttatttgtagaatccacgtaggctggaactacttaattgggatctcatgcaaggaaaaggaaaatatcctataactactatgttttaaaacacactatttgcattccaggtgtgggagagtaaggagccaggaaggtgacagacaagtcaggcaggagagagagctcctcggattcttcaacaatactctcttcaacaatgaccaacacagcaaataacctctctttgattattaacaatcattgtcatagttgttcctctgctatgagttttttgggaaaaaaaaacattggtaaaatggataaaattgccagtttcttgaaaatagagaggactatttattttcttgtagcatccatgatgtctacagcagcaaaggactccatcaccaagagcacctcagctctcactaagccctttggagtttataggtctaggtgctgagcaaatatgtgttgggcactttgatctttccattagttgtttcagctgaggcaagagcaaataaacacttgtgtcttgacaaccttttcaagttcggtgggacagaaagttataaaagggaaaaagaaaacaagaaaagatttttttcaatagcaggctatcaaggttactataaatgccatctaacaaggcagcccattaaaaaatgtagtccaaaatgtactaatatgataaacccaaatgaggtctcgttattcttagctctaaagttctgactgtccttacaaactgcctctgcagcctagatagtggccatcatgatctgtcttctgctaaaatactcctttcttcctccttttgaacaggaccgtagtcccagagggcagctcttgctttccttctctctctctctctctctctctctctctctctctctctctctctctctctcttatttaattatattcatttgtcctgaaagctattgcagagagagactatctgtatctgtcagccttggcttagggtctttggagaaagtgggtagagagagctctatcatgctgcctagataacacctcttgcaccagttgtttttcagctaaagtgcagctaaaatcagggctcctgaatctgaagtgggtggtgaaactctaagataaccatgataaaagagaaagggaagtgaccttttctgctggtgctgttacactatgataggggctcctttatggacccttaaaagggagaaattcctggcaagtcaaagtcagggcaactttacactgtgggaagtaaatatatggatcttcttagcccaggaaatgtaaatactgccagagaaggatcaatacatttgtgactgttaaggcaatgataggttactaaggagaactaggctgtttggggatccatttaatctctgagttcaaaattagtgaggacaaccagagcctctgacagcctcaatgaaatgagtcctgaaagcatgcatactctctgaactgtgtctgtattttccaattaatgagggagggagatatgctgtttatttctgttgtttcaaactgagatgctaaaatctccagtttgctttaaataaaatccttgcatccaggggaacaatatttatatttcaaaggaaaagaaagagagaatgagagaaaagaagagagagagagagggggggagaaagaaagaaagaaagaaagaaagaaagaaagaaagaaagaaagaaagaaagaaagaaagaaagaaagaaagaaagaaaggaaggaaggaaggaaggaaggaaggaaggaagaagggcaagcagaggcaggcaggcaggcaggcaggcctggaccccatcccccttattctgctactacaaactatctgtggtaccaaccatgtcctccataggcttcgccttttcccatttgtgaaataaggccattagagtaagtgagcccccagagtcctttctaacttccataacatttactacttcaaacggctccacaagcttcctctggactgctgaggatgattccttactcaaggctttccaggagctcagaagatgttcccaactccgcccaatgtgtcactcaagcctagcttccacgatacacggacctgctctaaagtttgtatttcatgaacttttgccccactgtctgaggcccctactcattttaaacagagctccatatattagaggcaacatttggtagactttaacaccagagatggccaggcttgctgatgcatactagcaatctcagcacttgggagactgatacagccacatcttcaagaatagactgggatgcaaagctacttcaaagaactcataggctatgtagtgaggccctgtcttgaaagcgctggaaaagaacaacaacaacaaaatttaaactaaccaagatgtaaatctgccttgagtgaggattcctgttctgttattggcagccaagcgatttcaaaaatttgtctaaataagctttgcgttagtttcctcctctgtggattaacagcataatacttcttctgttgtagtggaattatcaggattaaatgaggaaatttataccagttctcagcatgacacctaacacacagtttattctgtcatcaatgcgaaattattctccactaagtaaatatcaagctaaaacttaagattgataaattaataaatattgaggtaataactggttgttgttgtcatccttgttgttgttgttgagacagagtctcactgtacagccctggttggcaggacctcctaatatagaccacactggccttgaacccacaaagatctgcctacctctcactcccaagtgctgggattaaagtggtgtgccaccatgcctggcaataccataaccttgaagcagtggctaatcacttagcttcttgggctgtgtatgttctgcttcctataaggacatgtatatactcatcagaaccattttggaaactggacagacaaacacgagaacattttcagatgagcctggcatttgggtacagaagtactacttacttaaatattactttcacctcccatggagccagttgagtccatgggagtcctaaagggtggcagatacacagggaacttccctaaaatgactccttgatatggctcacgtgttaatcacactaagcagtattttactcttcctgttgaaggtgtaatgtgaaactgtgaaatgagaataagtcgaggtaggttgccactgtctcctggcttgttgggttcttactgtattactaccatgggccagggggaggaggacaaagaaagcagcttagcttggtaagacaaggctaaatattatcagagtgagcccacctcacttttgagacaggagaatctgttctctgggggcaacatgaaatgaggagggtgagatcaaagtcaacaacattgtaagacagattaataaagaagcattaattattcctcaagttttgcatgcgcgcgcgcgcgcgcgcgcgcgcgtgtgtgtgtgtgtgtgtgtgtgtgtgtgtatttgggaactaaaatggaggaatgacaacaaatataaagcatcagttttgacacggaaactccattggtcaccttcaacccacggtttattggtcccttccctttcttcttaggaaagcttagtataaaaactgttcagttcgtggcaagttggaagcaaaggaagaggcaaaaagagaccaaggacccaaaatccacttcaaaggcatgaccctagtaatacaacctcttctgcttctctgagtaagaagctctcaatattgggtggcaagatcccattaattagctggcatctagcagtgaacttagactctaaaaattaatatctaattttgttgtctttgctcaccttatgtttaggcagtgatgttggtgagactttgtgggtttagcttctgccatttctaggagactcaacctcacagtaattttcctcttcctctggtgggttcagtcttttccaaccccctattctacagtgtatcctgagccttaggtatgaggcttataatatagatgagaacaagatcagaaataaagatgatctcaaagctgtatgtcagggtcatgatagaggaaaatatgaaagaacatggccttcgttgataactgacactttgcagaaagaagacctatggattagatcccttttgtattgctataacaaaatacctaagataatcaagttataagaaagaaaggtttgagggggttggaaggtgaaggggctctgatgttgggatgtaaactgaataaataaatcaactaataactaattttttggatgattattttagtagcttcaatccatggttgcttggtcccttccctttgttcttatatcagctaggtacataactctggagcataaagtgaaggaaagttcttcatctcatgacagccataaaacaaaaaaagagacaaaaagagaccaaggttcccaaatcaacctcaaatgcatgcccctggtgcccctttttaaggatgctacaacttcccccacgccacagtcaggtgactagaggtgcaactcatagaacattcggagccatttgcggtctaaatgtaatattccaggaatgaagcctgattttaaaaaaaaaaatctattacacaagaagttggcaagggaagtattaatagtatctacgttttatggttaaaggaataggttaagaaacttaaagcgtcactcccagtaaaatgccagtctggcatgcaaacctaagtctaaccctctgttcttcccattcgccatgctctttcctttttaactagacctatgagggaatgagtagttccatctaagctaattttccagataattgaagcagtcatcttttgggagtgaaagtgctatttttatttgaaccatttttttaaggtctacaatgcgttccatacctctgtgccttgttctgcagaatgaacagatcactgcacttttaatcctccttctacagtcacagccatctacctctttactctctgtggctgacaatgctgactaccttgtaggttcctgaagctagcatatttgaaatggggttcatcaaaaagcaggctactaaaatgtggcaggtgtcagtgagagaagagtacacagaatgaccaactacaaaaattcatcagactgggtctagttcatgtaggtacagatagctctaaggggctaaataactttgaagacaacaaaattgaccctcgaattgaaattcccagtaaaaagtcagaaacatcaataggagcttgaattgtgttcgttctacttcactgatccaccatgggaaagaggtccatcacaggtgggagaaatatttcttccactgatactgttcagaaatccccgcacatagtgagaatgaaaggcatacctgcagcatttaaattctgtacacacaatctaccctttcattgtttgctccagggcagacaactcctcccacctcaccactgcacctccatgtttcaaacgccacgagaggtctatttcagaaagatttctgtttcaagtggtgtgtctaaaaaggtgaatcttcactgatctggaaaccaagtcccttgtgtgacgcatagcaaattattgtgtgcttagcctgtcacttttcctttccttgtcccacctataatttcaaaggggggtggtggaagaagcatcctatacgaaagccctctttaagtttgccaacctattggcctgctgcaagtacttggatcttttcaaattccaatcagaatgggctctgctttgccttctccatctccggcttctctgacccggcaaagtttcccatctttcatcctgtcacttagctaatggtgtgtgtcctccttgcatacatcccatactcactgcttcctttcactagtggagtcgtcagcgagctgctcggcagatggcttactggctgctgctcttgtcccctcgctgcagcaatctgttgttctaaatcaaaatgttaatgaaaaataaaagaactcactgccaatgtctgtctgatttaaattaatatagagtcataccttttgaggcaggtttttctggcacaaggttctccatacaggctaggcatactatgcaggtttttttttctccctctctctctaattaaaattaagcgctttcatttccccgagtctcttgtggcacccccaacctgttctttttaataataacaaaggcctaacaaacattcgatttcagtgttccagggaatggcatctcacctggtgaacataattttgagagatattatatgtgatgtctaattataaacatactttgattagatgctgttttcaatactgaaatgacacgtttactaaatgcttcaagtgcagctctaagttaggctgtagttattgaaatctctttcaatccatttgttttaaaactgctggcaaaatcattgctaatttgctactttatttacaagggcccttcactttctatgcactcagcacagtattcatttctgcagcaccaggactgcgcctctctttagggaaaatgtatgtgtgtgcaggaacatcatcgatgtgaggcaaatttttcagcatcaatttacagaagggaacatgatgatgctaacatacctgaaggaggggggaagaatcaccttgtctcaacttgacaaaaagtgtagaaacccaaagcatgacagcttcaaccaattgtggaagacaaccctgtccatttgtttcccccatgacttctttctagacactcttaggaagagttaccaagaagctcaacagcgaactatgcttgctatagagtgcacaatgctataagtgatttaactttaacttcatcaaaacaccgtctgtttcaaaaataaagaagctagtacatagttaactcttttgcccgaagtcatgcaactagtaagtcacagaagcagagaacacccagctcagctctaagaccttcacttttaaccataataccattctatagtgtaggaaggaccacaaatgtcagcatctttggaaattactgttttcattttgacccctaggatgttttatttgctcaaacttctgtgtaagcaggcatcaacaccaatggggcttacaccatgctaaatgctgagtgtcactgccgccaaatataaggtgaatcaggcatatcaagcgtacaaggcagggcaggaggaagaaaggcctgtgtttgagggtaagaagtactttactaatcactaggtccatcctctcagccctatacactgggtctgtgcaatagcatggacaacagatcaaaagaagcaaggcctggaaaacttatgtgtgaagcagacaaccgatcaggggctccctgctggaacactccaggtcaggtcacccagatacaaactcagtgtttcttatactggaagaggagctgccacacaaaggaaataccccggaagcctagccttcctcctgctgctcagaaaacatacaatcttctcagaaagcagacaagagaaaatggtatgcctagggattcactggattttgggagttgtttgtttctttgttctccgggtttgttttgacacagggtctcagctagtagcccatactggcctcttgattacatagtcaaagacaaccactatctcccctagagctgggagtttaactcagtttgcctaaggccctagatttggtgcaaagcactacaaatttaaaaaagaagaagaagaagaagaagaagaagaagaagaagaagaagaagaagaagaagaagaagaagaagaagaagaagaagaagaagaagaagaagaagagaaaaaaaacccttaaatggaaaggaatggcaaagaaaggcagaatttcccttcttaaaccttactttggcagttatattttttgtccttcccagagactaaaggaaataggaatttggaaaggcatgcaggagatgttaaatagtacccagtgtaagagccaggtttcctgggtttcataacccaccttgtttcttaggtatcccagcccctctggaactcacacaggctttttgtaaactgaaaaggtcctatggaggtctttccaacatcaaatctttaatgattttagccctcactacatgttaataataaatcttgcctttcccactatttaaacaaggaaacacgaggaataatttgaccaaaagaagcaaaaatttgatctgttttgtagtcttacagctcaggccactggagccggtcccagcccgacgtgctagataattattcacccctctgagtcatcaaatcatagactctttgaaaccctgaaataaaagagccctaaaggtcatcttttcctaacctgctgagctctcctttgcctaaacaaagctgatgtaagtagtggagctaaatccaaatttatagcacacctggatatatgttgccggtgctgggttgagcctgtaacctttgcccccaaacaggttctcccttcctgagagttctctttactagtgtttattgattccagaatgcctttaacaagggcctggatttttgttctgccctgaatacaaacaggatagaaattctcctggaagatgtgataacatctaaatgcacataccatccatgatacatgtgactgtagagcagatcatataataagagcaaaatcaaagagatgagaacctgaaagcataaaatacttagaaaagaatgaaatggactacattgagaaggaaggcaaggaaggatggagacactaatgtggtcaacttactagatgtgtttaaagtcaaatctgggtttacaacccaatcacattatacaactagttatctcacctttacagttctcttaacaactccaagccttagtcatttacatactgtagtatgggataatatctattaaacatgaatgttgagggtaaaataggatacatgttctaagctataattacagtatgcttaagtacattcttggcttgtaacgtacagtgttgtactttgatagcattgaaggtgtgtgcccttgactgtgaccctgcagcactcataggaagaaattatgttgatgttcggatcttcagccatttgtaatatgtctaactattgtaaccgcccctagaggtaaccaaaaaattgattataaagaactaatcagaatatcagttattctgatcattgaaagcaatgttcaaacttgcttctttgaaaacttatcatttcatttagcttctttcctccatcctcctccttctgcttttcctttgggattcgtgtgagttgcctccatttcctaccacacattctctttctagcattacgatatatatcttttccactaatctaccaatatttctcttttatgtccaacaataatctctccctcaccaaatcaaggttattttttaaatgtgttgtcctcctaaatctcttcaggatatgcaacatattggtttccccattttttattttattaatttaaaagaatattatgtacaataatggattccattaagaagtttctataacataggatcaatgtactttagctgtccttacttcttaccaccgcttctcaccaccctcctccatataactcatctcctcagtcccatgtttgccttcaggtcatgtgtgtgtgtttaaatctagattccacacaaaagaaagcacacactatttcttaactgctgagccatctctgcagcccaagcacgcactatttcaatgttctcttctttactcctctcccatggtgctctattttttccctcctctctattctcattgttgaggcgctttcctccttagcttctgctgacattacattttaactcttctctaattttcaacctgctccttttttgcctgtgatgtcatgcaagtgccttcattctaggcttggaccatcttcatcaataaaacaaaggtttaaaaacgggatgatatctaatgacatttccatagccattcagtgtctgggagtgaatgagatatccctgtgtttcttgagttgactctagcaggctattacattttaaatattttatagccactcttgtctatgttagcagttgatgtacgtgtacatactacataaggctggggttttgctgctttattcatatttaatctacattttcttcccctctatatttgcatatgcacatatgaaatacctgtatattgcatggcatctttcttaaaaatagatgtaaggtactttctaaagtaatattttgttgtttatgcaacatattagtactttaaatgtatattgcagatattcttctccataatccatttaatttggctattcagaaaagagaacaacatttatttagccaagtgaaggcatgaaaaagtgtaagagccaggactcaccaatgtcattaacaaatagcccgcaaagaacgtatttgagagtttcatactgacatatgttatacagaaatacactgcagtagtataatgagccctcctgtcatttgtccatgtaatatctcttgaaaatactcaaatggatacattataaaatgtttactgatttttattcttttactcacaattcaagtgctatacatgatggtttcaaagggagcttgagactacaaaggaaaagatcggctacctttgtcttaatatctacaccctcccccaaatcctctgaatcagtttttcttgtttcaactgaaaggcaataataatgtatttcctaaatctaaggggtactcagtaaatatatcttagtaatgataagatggaaaaaaagcaaccttcaagtgtacaaagtagagaatgcttgtctctgctaaggaaggtggttgagaggagataagggtccttaagctgctcccaaagcaagtcatgttgtaagaaaagcagcggaggttttgttggtttcttgctattttgccactgaagaatatatgaatttgaaagatcttgcacactaaggagctctcttgatccatggaccataaatgtgtcagtaactcagcaaaacttgatatactgccttctcacacacagcaggagaaactcagtggctgagtcaacaggccctcagatctctgtcaaaaattcaaaatgtatgaatttatataaacatgacacacccttgaggtcagccctctccctgcttttccctctcttctctcctctcaacagtaagccacctaccactaaaacacctctcaaaatctaacagataggctgatttttattgtattgtaaagttttattggtgagcactctccagggccagaatattcaaattaatagacttggctagtcaagttaccagagaagcaccaaatatgtggtgtaaggtttaccaatttttaagagtcagaataaaataaaattttgttcctgactaaaaggtacacttcatgaagttatctttcatatatgattcagcaacactctggaagatcttcacatttgtaagtcaaaattgaagtctttgaaacattgcaccattagtgactgttggaagaaaagacaaacaaacaaaacaaagcaaaacaacaacaacttaccctaacatctctaggaaaagaaataccctggagaataaatgttgctggaatggtcacaaaatactaacacagtaagggtctggagagatggaatggcagtttaagagcatttgctattcttacagaggtcccaaattcagttcctagcactcacatggaagctcacccatctctctatctgccactgcagctccaggggattggatgccctcttctgtcttccacctgctttgcatgcatatggttcacaaatgtatatgaagacttgcagttgtcaattcaaatattctcgacatcttatgttttatttttatataaaaaatcttaattttatggttttaaaaaatggtggtgttttattttgaagtcatatttacttttctctaaacttctttaaggcaattatgatgttacccttagaggtcaattttactatattgcattgccacaactttagattttaaaaggttccacaaaaagccaatttatccatctagagctccaggtgggttagtgccaatgacaaagtgtttgttgctatgcgccaagcgttatatttaagtttctggcatgaattactaattacttataacttttgtgaaaaaaacaagaacctcaacattctctcattcaaagcaacactatttgttcaattagtttcagggattttattgtattttttaggtaaattgatgatgatgatgatgatgataataataataataataataataatatctatccttagtaacagccattaaacattggttcatgctatgtcaggcacttgctaaatgctttcacaggtataatgttgtttaaatccaattctactgttggctccattttataaaaagagacattgaacctacaaaaatgagagtatacacaagtcttcagaattctttattcagacagaataacctcagtgtataattgttttaattgtttattatgaagaaaagatatttagtaagcatgtaccatgtgccaggaactgggccaagtactttatgtaagttggttcacttaatgttctcatcagccttctggggctgctatttttagatatattttatagatgaaagaaagaaggggactggaagttaagttttctcaaggtcttatggctagtgagggcagaactaaggggttagtttagataagttttagactgaagtcccaacatgttctattacaaagacactagaaatgtgtacaaatagacttatgaatgtattttgattgtccattattctcataatcatgaagtcaccctaaagacattgccaacagtaaactatatacagagcttcctttagttccatggcacacaggtctttagcattctgatcacctttacttttcagagaagagagcaggaacagtttgaagccattctcaagaaagctccatcaaggtagcttttgggggagatgaattaacacttctagggcattaggttctctgccgtaatgcaagaatccagtccctctcttctccactgcctgaaagctttaacagcttgctcaaaccaaaacatcatgtcagcatttctcattggaatgccttgaaacgattggtaaaaatagcagattctcaagcccaacctctgaaagcacaacttcgacatctgcattctaacaagtgctccagatcacttgtaacactggaaagtttgagcaccacatacagtgataaagcactcaggccccgtgttctgaatttgggatgctctaacataaataagattaacttgttttcgtgctatgcaaggatgcaatcatgcatgacattaatagaccccatgaaatgattttgcatagtacagtctcctcttaacaatcacaatatacacaaaaatattgaaggctccaagaagtccttgaaagaatgtaagcaagttctttctcaactcataggtaataaacgatatttgcttatctgcttctgcgaagaagaaaaggaaaactcaatgtgtacttggacaatgtgctataatgcacctgtgtttctcaaactacttttagtggcctaggaaagggacatcaggagccccaccttagatttctagtatctattatgtctagagtgctcctcaaatctagtttcctgcataatctaggtacacggctataaggcactctgaaataagcatcagttgtcccaaaggtgatggtggttgagggacatcattatagttgctctagcaaggctaatagaaactaaacaaattctgaatatgaaaactacctggagacaacattatgatacttgctatttaaccatatgactggtcaaaaaatgatgacaacaacaacaataacaaaaagagcggcttgtttatacagtgtgaactgtttgctgttatataaccagagcccagaaattataaacagaacaagttcccaattctgcagccacctcaatgtagtggggatgataggtgggcagattccgtctcccagttgctctatggtaagaaagccacttcaccactctgacttagtcttttctcagaaagccatgtttagaactaaatgaggcatccacactaacctcttatctcaaaaatgaaataaaatatgtgccttcctatttccctctcctctcttttcctggcagagcactgtgatgctagatttgttagggcagcaagtaggcaggaaatgttgctgttgggtttggagcagctattctcttatgagggctgtgtcctttaatgaactccaatgtcagtaactcaagggcacataaagggtactgagatagctcttcagttccactaacaaggaaacaacatggattggggtccacagaggtgaaaggacaagtcctgccctcaagttgctctgagaatagtaacaaaactgagtgtgcctagtggtggcaggtaacaggcagttggtaggggctcaaggaagggatgtagctggtcacagaggtcatctaaagcagtggaaactgtgttaaagctaagaaaaatcactgaggccaaagacacccaatgtcttctttctctacccagaaaaagaaaatagacagtagtctaacctagggatgcagttccaaggctcagttccagcagccagcacagagccaatcacaggctgctttgtgcttttgtgcctggcgttgtactacatatagcacaaaaccagtaccacagaggtgatctctgccctctaggaaggaaagcaatgatgaagacaaacctccagagcacatgaaagtaatcaaaaagccagcactgaacagataaatacctcactcacttccaccattcgggttcctgtccatttttctctcctatggaaaatcttagataaatcaaaactaagtgatcaccaagtccccaaccacccttacctctccatgctttgtccagagatttggggatgcttgtcttagtattaacgcattgatttcatcagattgtatgactgtcggtggtcagatagagctttcctaacatttattcctcctttcagccattatttgttctgtgcttggagtaaggttggtggagaaaggatggagggtcatttccagatacttgcatgaacagtcccatcctgtaaaattttccatttgagtcttaagcatcttcaaccgtggaacaaactcacagaagctgctgcagtccccttcccacttggcatttcttcttatatccagcagagctctggaaagcaacaaggttgggattcctcaggtagagggatggggaacagtggttgagaggcaggactagactcttgcacttccctttaatggtgtgctaagactccaccaccactgaggaaaagccataccatgtttaaagagggctctatatgaatggtacagggttgtttcttaagtgagaaaaaggaatggcagacaaggggattatattaagcaaacaatgtttcccctgattttctttcagaattgtgtctagggagatactacagtgaagaactataacagaataaacacttaggattaaactatgtaagccatctccaagcaaaagcgaggtgtgaagcttggtcaaatcccagccactcagcttagaatccacaggacaactgtgcttcctaactgattcttatctaagtcctcaaatagattttttgtactatctgatgctgtcaaagggcaaaaggtgctgatagaaccacagacaattctgcaatgccaccccccatcagaacaaagagtgttcaaatcttgcaaagccaacaaaactgcagcataggtcagctgcaaagtcccccctcatcaaagacctccctgagccagcaaagtcaaggccatgagctcagggccctcagaaggtcgctggagaggacagtgagtctgcaggatgagtcaggagaattgaaaaagcccagccagtaccaaaagccagacctctagcacagcagccaaggcaaaaaaaaaaaaaaaaaaaaaaaaaaaaaaaaaaaaaaaaaaaaaaaaaaaactctgtaagaacctggagcatcctgataatgggggtggggagagagaagaagaagcaacagaaaagataaactacctttccttcgaaatggcaaaagagggaagcagatgctctttatccttcatatgtcccactttcagtgcccccctcaaggatgccattgatgatgacaactaagcaagcatctcctacatcatactctggtaaccaccaacccctaacaaattcacttctctcaaagcttcccactatctttgaaatggcttccttccttagcatagctctgtcatttcattgtaactgatctggaccactttagcagttcatgagtcagtatagttcccaccggggtcaaatattggcagttaaacaactgtctcttagcaactgagtaattctactccaaagagtatatacagtggaaggatttcagatgaagaggagtactgagagagagaaagatcctgcagaaacctacattcaattctacatgtagcaatccatccattcctccctccttgtttgagcataagctagccatgcgactggcaacctggacaaaagccttaatgcaaaggtgcaacaaaacaccttcttatattagcctcaagacataagaacttcttctgaatcattaccagcagaaacgtgctatgggagaagtacatacaggaattaagggctgtatttcaaactgtggagaagaaactcataataacaatccactctttaaaattattttatttatttacattccaaatattgcctccctctcagtcccctcttccagagttcttcccccttccccctccccctttgcctctgagaggatgcctcccaggcattcccccatgcctggggcatcatgtgtctataggaacaatccattttaaacagtttaaaaacaaactctgtcccataggtgctagataagagagtatataacctgaaaagtctagccatggccccagcttgtgaatctgctatttggacatgagtagagggcatggctttgctaaaggccacaggtaatgactgacaatggaggctttttcttgatgattggggatgagttataaagctaacacttgcattatctcatatattagaagctattgactattgagaaaagcatttgacttgtgaccagtctgatttcctaacatactatgcctcttcacaattgagttttcaaagaaaggcatctagtcaaaagttttaaattctagaacaagcaagcatttgatgatcctgattatttttaatgagacttctctggacaaagaatgctgtgaactctgtgactagaagtagacttgcctgagtagaatcatacttgtctctggttttctccctgtatgtattctatatctcagcgtccccattttttgtccttgagtctcatttctctgaggagtttaggggtcccacttgcatttttcagtccaggtggctgaggatgtcttcactcttcagttcttgtctctctattccatcccatggtaagatgcctcctgtaagaatcctgtttccttcttacacacctacccccccccaaaaaaaaaacagcttggagacttaagagctattgttatgtattaaatttgtcatggcaaataatgacttaaattcctggtccttcaaattagagcagcctgcttaacaagaaatacatttcctgatagccttttaaggcaattttagcttgtggcaataatagtaatgaaaagggggattagtggtgcatctttcatcacatggcagaaatggctgactatttttccctaaatatagggtgggaggggctttggttcatttcagcttacaaaggatgtttaaatcaaagagaatctattcctgctgcccagcatccgtcactaaatagtgctatgcagttttgctttgtcttttgtacttttgtgcttttctgaactgatatatctatccaaggcaaaggaggttgctaaattggtatttcatttttccttactaacgtcctgaaatgtgcctacttataacttctagccctcatttcatgtgtgtgtgtgtgtgtgtgtgtgtgtgtgtgtgtaagagagagagagatttatttttaattaataaagatcagtgagcaaaggtcttaccaagcaagcctgatgcctagggctcaaactctgtcatgtaaatgttggctggatatggcagtcctccttaattccagagttccaaaggcaaagacatgggatcccggatcagcctgggtagctaccctagccaaactggtgagtgtgggggtcagctgaagaacctgccttaatgaataatgcagagagtaatcaagaaagacctttgacattagcctcagttctccactatatgctcacatatatgtgtatgcaaccatacatatacaagctctcacgtgcataaacacatgtatgtacaccacacacacaccgcatatgacagaaaaagaaactcaaagaagttgatctcattttatccaacaactgcattattaaaatatggtatgggtgggaagaatattatcatagctacccccaccgattcaatctgtaatgaaacacatcacaagtaatagtaatctgatatatccatttcaccaataagcaaaatactgatcttacaccaaaatgaccagtaaggaacagcaattcttaaaatattaactcctcctgtaagagctgataaatagtcactggatgcttcagactctccttcagacctccacaagatccagtgactaatagggtaatgcctaagacagtctttaaggctattcctggaattttttctgatttgcttccagtgtcttcccatgtgaacatcacccacaatgccatccaccaagtagcaagtactgtgttcatgaatgtggaccaccatcacttgattaaggctgtagtgatgacactgaagtttctcttagtacagtctgttccatgcatttctatgaagcagaacatccacgaccttcaaaagatggacgactcaagccttgtttccaaaatagcacttggcaagcagcctagactcagatggggacaggagacacaggctgtgggcattatgggccagccccctgtcacatcacctcaggggatcctcaacctcatgggactcactagaaaaaaaaatcttttaaatttgaaaagcagaaattatctagtccacctgagcaccctgggagcaggtccgtattcttagcttcatgcttcaagtaccgagtttagaacaaaagcttccgttcaaggtcatttgatgagtcagtctactgagtggggaaggaagagaactggagaacaaacagcccacatcagggtcaaattgagctgttgagctacctcaatctaccagaaaggtctaagcaaaccatttgcattcttcccttgtagagaacttgagaaattgtcttggacggatgttagtgaacaaaagggaggaagagtaatgttagtggggcatcctttgccaatcagcagtctagaaatgcaaacttgtgatgacctcgtgatataggtgaatacatatgtggacagatgctatgtctgctgtccttatctgagtttcagcaaattcattctttctcaggaagagtctcattctccaaatggaccttttctcctgtcaactttgtactaatgtatcaggattctccatgacaaacagaatcaatgcctatgtgtgaatttcgaaagtctgaatttaacctttaaaaaagatttattttatttacctgtatgtgtgtggacatgctctatgtacatccagacccagacaaagaccacaggagtgtgcaggatcccctggaactgaagtcatggatagttttgagcatctcagtatgtgtgtactaggaactgaactcaagacctctgcaagagcaatgactgctgttatccactgagcctcctcttcaggcccaaattcaccttttggcccttcgagctctcttggtaacattaagagagacaaatacttgtgttttaattttcccctttatgaaataatttgacatagtcacctgcgttatgggttggaataagaagaaaatatttttatagataagaaaaacatttgaacactccaatacactctaaatgcacgaaaatatattgcctgtctttacaaatactcagagggaacatgaaaaatcagttttttttattaagtatctattatgtgtccagcatttctatagtcattagtttccttaatcctgacaataatcctatgaagttgatattacttactataagtaaaataagggataaaattatgataaaatacattcctatgtccaaagtctgatttttatcttacaaatacgtaaattttatcctaaagaaaagcaacagtagtatccaaattacaaatgactatgtcacagcaggtcagtatagcatcaatatgtacctataatgtaaaatatgtgcaaaaaatgtaaagtgtacaaaatatggcacctaatattatttatattacagcagcataacatttggaaaatattcaagataatgatagtcacataaaagaaatgagtatatccttaaaaggtgtcaaataacaaaactccctatgttcaaatgatacatatggaaatatagaactttgttgagataaaagaagtagccctctaggaaaagaatcttcagggcactacagatccaaactttcttccctggccaatggtaagctactgctgtagtggaatgcctgttccttatagccttgacaaaagataggatgagagccctgagagaagggggactcacagaaacagtgtcatctgttttatctgcacattagacaagaaggattggactaaaaaaaaagatttttttctgtacacagaaagctgaaaatagggaaaactggaattcactccaaaatatacatgattttcctatacccatgactcttgactcatgacccatgacgacatttgcagatgaatgtggttctcagcccccattgaggaaacttcttttgtgattagtagaggctactacagagaattgcaactattcaaactgcagaggctaagtggctatagggtattcaacctcagttgataaatctgcaccacaagccctgcatataagggtcaggaaacatcaaataagacgggcaagatagaatgtaagacccagagccaggatgcctgctgctaagtagtagcttctctcttgagaacataacatggaaatacatggtcatcagcaattgaaatgaagtgtccaatcctaactaagacttttgctatgcaaaaccctacatctaaggcttggaaaagagggcagaaggattgattttaagagctagaagaacagaatgcctgttgttacagagtgtactctagatatgagagggggaatatatatccatgaactctcaacaatatagttgccaaaataagaccagcataatgacaccagttgacaaagcaacatgaacaggggtaattttatgatggcttacccttggatgaagaggtcaatggctgctgagtggagaatcaatttcctccagggatgagaccccacaaaggtgttctaataccaagtggtaagccgtgtgtatgtgtgtgtgtgtgtgtgtgtgtgtgtgtgtgtgcacgcatgtgtgcgtgtttctatcaatactaattaaagaagaagagataatgaattgggaagagggcacagaaggagtttagggtgaagaatggatgatgtagatgcactactcatgtatatacttctaaatcacatttcctctctccagtatcataccttgactgatagtgacacagcactcccagccctttgttactgaagtacacctcattatgaccaccactcttgtcatatgtaccaaacttctgcaaatactttgatgcatgctaaatatttctctttaataatgatagacttgtgaccaagaaacagtattccctgctaacacagctaagtgactttccggggacatcaaattcattcatgggctcatcttgccatcattttctctgttaggttatttaaaatataagcattcttgaaagctaaaacctttcatataggaaagattttatacaatggcctccatagcatccagcatgtagcttaaggtatcagacacataaaagaaatgatgaatgaaaagcattcttttgcatgtacaatggtaaaagtatatcttcagtcttgtaatgttgttggaattatagataaatttaattaaacattacaatacaaacaagataaaacaatagattaaaactaatggttagctgctgctaggaaactctcttctttcccaatcactaacttagcaaaatttgctataatgtctcatctaatagcatcaatcaaagaaagtagaagacacctcctgtcattatgcctcagtttccctactttaaacctagcagtattgctctagagtagtggttttcatccttgattcacataagaatcaacttgagagatttttaaaatatggatgccaaattccagcctcaaggtttcagatttaattgacagtagcaaggcctgagctttgatatcattttaaaattccccagtgactctaatatgctgccagggttgagaagcagtgggctagatgatccctaaggtttcttcttactctggaaatcaatatgctgactatagttggatctcttctggtatcacagctaccctgcctgcctgtttcctactctcccctctaatactacacaccacttgatctatcctagctcgtcattgcagcccatttacctattgacttaaaattttatttgctcttgggacttccaagcagtgctatttaaatctgatttctaatgctatgtgggtcattttgccaccagagaagatcccctgatattaggatatgttaggaaagcatgagctgccctgtcctgcttccaggttgggaaaagccaagtagtaagtgtaagcaacccaggcgactactagtggtctgtaagcacaatccccagctttctgtttctctggattctttcatggcaatcagcctgcccattccattcggccctttgtcaagaatgtccttgacactaaaggaattgatttgttctccctttgctttaaataataagccaaccattatgcaggagttttataggatattgatttaacatacaaactgcattatggcccttgaatgctacagaaagaaccaatacctcatcagccaggaacaccaatgtagtgacatcttagcattttctttacttgtcaaaacacccatgagctgtgggcttgctgtaagggagacatgtcaaggatttagaaatgtcagattaaaatattctgggctattttcaaaaagacatgagcatttttaaccagtagcattctatcaacaatgccttatcagaatgtagggctgctaaagaatggtatgaatattatatgggcaacagaaagtacctcaaggtcataagatcatttatttctagaagcaatctgccacaaacatttgcttgatctgtatatacataataagagctgaaacagtatccgcataagaatggaagggagcctagagaggaatctgaataaagaaaatctctctcctcccaagatcctaaaatacaaacctaaaaaacttagaatttggaatggtcatttagctatatgtaattcagaagtcctccacagctggataagaacagtggtgctttgttgtaggcctttggtcaaattgccaacaggacataagtttgttttttgccttcactaccaagttctttgaaagagtagtaatatatccaccttgaatatgttttctttacacttgccccataatgtgaattataaaagctggtcacattaagatactaatggttccttaatagtcacaacctgctgttagctcccagtctcaattctaattgacatgactataactatttgctactgtcaaccacctccccacttcctttgttttgacaagatctctttccagattctcctatatctctagtttttatttccagtcaatggcttacacaaacctttctttatccaccctttatataatgaacatttatcttgatattcacttttaatttttttaatttttaatttatttttatgtgtagaggtgctttacctgcatgtatgtcagtgggtcacatgcatacattgcctgtggaggccaaaagaggctgccagatcccctggaactgcagttatggatggctgtgagctatcatgtggttgctaggaatcaaaccagggttttctgcaagagttgccagtactcttaatcaccaagacattgctccagccctgccccattctcacttttataagttcagacattctatgacttacagaagtgtcaaagctctcattatttctctctctctctccttccttttcactcactctgctcctccccatgcctcttctgcaacaaaatcttcaagacatcaagctcatattgtcacatccctttggagtacctttactacacagtccagtgaacccttatcctcattctaagcccagtacctctcttgtactatttcggttgctataatcattttctaacttgactcccatctctgtctcttctgaatttccttcattttcctggagtcttttctagaaaacacacacacacacacacacacacacacaatatatatatatatatatatatatatatatatatatatatatatatataaagctgagcttccttctgcctgtagaataaatctatgcatcacctctagatacctaataagctgtgtccattttttctttccagttttacttctgttatgtgccctaccatctttcccactcacaaacaactcatccccacttgtcttatgctatattacttcttaaatatgccatgcaagctcaaatcacagtgttttggtttatgctatttccagtatctagaagaagctcccccttcctatttccaaggagtatgttatttaaatatcaccttgtccaattaaaatgtcaattcctgtgtaaaatctttagaattaattatggtcttctctgatctccgaactttctatagatcataattctagcactcatccccattcttcttataattaacaatgtgagagctctttatttaaggcctggaattctgcctctgtcgtgatgtttaatatcatagatgctgaaatcagataaacaaagaactgagcatttgggttcatagttactgggtgcatggtttcaggcaagttcactggtatctcctggtttggagttcctctgttctagatattggcaaacataatgctgcaggaagaataaatgagataatctccataaagccattataataccctgcacacaataaacactccacacatgtcacctgtgactatttttcttctagtgttggcatatagccttgcaaagaatgagcactcaataaatggttactgaataaattaacaatagcaaggaagctctgagaatacttgctaaatgggtactttcttcctttattgatttagcattcctatcagcatccccaaaattggattatgtattgaatttcttttctctgacgtcaacacactgcattcataattgtgataaccaaaagcagttcacatgctctttatcactgaatcttgaacctgtctcatcattattcccaacatgtgtatgttttgaagtatacatttcaaacttttcccccagaaaaatccaaaggctttttccctactctgatgttgggcaaagaggatgatctaattaatgtgatagctattcatatggcaagcattaacttttcaggtacaatggtaattgaaatcagggtgtttaaaactatcattattgcagcgatattcagctgtgtcaagttgggattttggatatttaattcattcttaaacccttcaaccaataaaaatgggttgagtaatgacatttctaatttttactccctttcaccataatccattttgatctcttgacctccattttagttgtgaatttctgaaaggttacctttaatatccaactcacagtaatcagtttaatatcccttgacaaagaatattcttttaaaaagtcagatcctagggctgagaagatggttcagtggatgaaaatgatattgtataagtctgagaacctgaattcaaattcccaaagtctatacaaagcacagtttggtagctcatatctgtaaacccaatattacagtaaaaccaggagaatttctggaagcttgcaggccagctagcctggccttttcagggtgagcagcatggcttgctgcctcaaacaaggtggaatacaaggaccaaaactcaaggttgtcctctgattttcacttatggacacatgcacacacacgcacaaacacacacacacacacacaaatacacatgcacatatatacaacatgtttgtgagtacacacagaaataaagaaaatcaaattctaatatgctctaaaacacttgttatttgagaaaaataatcaggcttcttttgtaatttagtgccataaaaggtccagaggaacatagaaaactcatgtcacttatgagaggtgaatataaaaatcagacacttgaaacattattttcatcaacatcatcactggtgtagtaatcaccatcatcgtcatcgtagtcgtcattgtcattattaaaaccaatacaactctggtttaacaagctctggaaaaatatattagttcatccaaacacaattagaattatttggtgatatttttccattcttacatatttgacagttctgtttcaaatcttgcctcctgagcatccccacctacattggaaggattttaagactttcagggaaaaaatgtaattctcattatatctgtctacaaggcttcttgtggtttcaatttttcagagaaatacactataggagtatagatattctaccacaactctagagaaaattttatatctgtacatattatccatttgaatatgcacatttaaaattagctgacaaacatgtgtattgaatgttagctgataaatagatctttagtgtccatctgaaaccaaccatgcctattacctaccctgaacaaagattggcactagcactttttatttcaatttatattgtaaaaaaaaaaacattgggataaatagaaatggtggttccttaatgataataaccttaatcttctcaatattaaaaatatgtattaaatgcaaagaatactgaaaaattcaattagatacaaaaaaacccaactcagaatgcaaataatcattcttatgtggatttgtcattgattagccacgagaatggaaaggacctgatgttttgatatatgccaaatcatagttgtctgcaacttttagcttcccatgccaccttctgtctgcccctctgcatacacacagctcagaaactaggtaatattttagcacactatatttttcattcttatacatgtatacaatgtatgtcgatcatattcatttcccactctccccccccccgcaaacttttcttagatccatatctctacccaacttcatgtcctttctctcgttatttttagtaactgacaaagtcaaatttttgttgctcatgtagtcacatgtgtgaagtcatctactagaacatggttaaactgcctcaaacttaaagaacatatttattttatattattttttttacgtttatgaaaacctgataggggtgttattaaaagcttggagttggggctttcttgccttttttccctcaaatttatcttcctttactgtcttttgtttcctctatagcctatattcctcctttgttgattccccttctcacttaattgtctagctaactgatttattactagatttcaagattgtgttgtcttgtccttaaatcatttaaggcattttaaagcttctgtccttgacaagaccgtgaagtttttgacagctcatacctattattcccttcctcgctgctcgggtacttgtcatgcagactgtgagctacttcaggaaagcatcacgccatttccatctttgcctctctagcagttattgcagaatctgtcagtggagatagtcactacagtaatcattggatgagtggatgagtggatggatggatagatggaaaaatagtgtgttcaagaaaagttatccagctgattaatggatttcattgcactatccaacaaggaataactagcaagtattaataaatcagttacgaatggtccttgaacacttacctattatactcagctattctgggagtagttgggggtaagaaactatgggtctagaattgaacattgattgtgtgtataagccccaaatgaaacataattatcccattatttgggtttgtgtcaatatctgtgtgccaactcaggtaaatatttttttctagcacaaggggtgaaagaaattggaggcaaagcattgctattttttatgaagcacttgttctaggtttatggaatagcccatgtattagaacttgtcatcagttgtatagtatcttctttcttctcttacccatacttttcatccaataggaaaggagtttgagagacatcatgtcttctagtgaaatttttgaaaccaattggtggaagactagtggggaaagattagcatatgaagcatgagtaatagtcaagtctttttgtcctttccttgttagtctcttcttccattttaaggtctgtagccttccaaattctagtgatattcccctggtacctcttaggggaaaaattctgcttcaataacaataacagagcagcaaaaatgaaagatggaaatgatcataatagcatgggcttgttgccccaacactgtcagcctctcaacagccaaccccacagagttgccctatgcttgtcaatgagaagataaaagggatatggaggagacattttatgggaccatttcagctgctcattttaaatacacccttcatcaaatatagtgagctgggacttagagatcacagacagctgggctgcttgaaaaggaaaaccatattatggcaaattgtattattgtacatttactgagttccagggtgtctggaagggactctaaggtccaagggaacatttcaaagcagtgttttgaaacattgccaagctgaggataagcccaagggcagctaatgggttcagtaacatgaaactttggtggctgggaatttggttaggggctagaatagatatttttttaagatatgcaatacttggcaagcgacacaaaatgcatattttttatgaaaagatttggaaacaccactgagtagactgtctggcttcagtgaagctttctagtattgaagatccattcaaaagcagatgtctaaatctgtagttttatgggagcacatcatatgtccagcatcattcactcagtacttgtggtagcaccattcataagttcaaaggctgagaccaagaaattgccctaacaaggctcaggaaactgggttttatataggagacctgggaaaagcatgatgctactgatggaaggaatttagggttgccagaggaagagggcagatcaacataaagctccataaagcagatcatttaattatgtaatgcatgttaacaaaatggggcacatgctttattgaagctagattgccataggcaacctacttgcttaattgaaaaggaggaatgtctcactgggggtgaaatgttagaaattctgttcaacccactaggaccctgcttatctccatgttaagtagggagagcttgcagtgggaaatttaagagatggaagattgattagataccagagactgacctctcctcatctttacacacacacacacacacacacacacacacacacacacacaaactaaggttgtatcctcaagactaagaccaaagtcactttgaccccctaaatatatagtcttctcattcttttatgtatgatgcttatgatacattcatcatgatgtccttgaagctatagattaccctgaaaatcccaattactacatataaccatagcctgcttctactattaccaccatgctttgattctcatgccattccttgcttgcttgcactcttgtgtctataagaactcactactaactaaaatcctaaattaatctagatggcagtccctaccctgcccagtttgcattttctgttaggaatttctcatcagttgatcacagagccccacagttggtcatgctctcttggagtagaaaagagggtcatgggcttagtaaaatgaacacatgtggcttagcaaaaagatcatatatttgatccaagttgtgaaaacataatatgtagggggctagcatggtctctggcaaagtgttcaagtggtagtcattattatgattaaaatgaaggaaaaatgtgtgccaaaaggactaaacctgtctagatagtctggatcactaatcaaatatcaagagggacataggaatgctaaaataacagggtcagacatcatccatggtggtatatatctgtattcccagcacccaggagacagacaagaagatagtgagttcaagggcagccttgactaaatagtaatgttaaggtcaatctgggctagataaacaccaaagagaacaggaatgtttactaaatgattgaactgggggaataggaaataatgaaagttcctacacttcagtactgtagaagttaggcctgggtctgccttccagccccatgctcccagagataagactcagactcaaatatgtttacaaatacgttgaccatatagctagactctcctatgactatatataacttaaaatatcttaccaattctagtctacattttgctatatagttgcttacctgtgctcaggtaccatgcatcttcacatcctcctagcccatctcctgcctgcctctgtcctataattctttctcctctgggaagtaccaactcccagttcctgcctaagccattggtcataggctttttaactgataagtgatgcatccatatactacacaagatattctttctacaaagcacaacttctcagtgtttttatttgaattgtgcaagacctcttgcctctctgtgtaggagccctagatggttttcagtgccttactgggtttctgggacacttccaacttcaggaaaacagtgcttcatgttgaacactattaaaagggagcttattgggatattgtctgattctcctgaatagtctatgatcttcctaatttacccccaactccttaaaccaaactcatccatgttaaatcagttgttatagtgcatggctgtaagtgagccccagcactgaagttgccaaagtaggaagaaagcctaggaagaatgcaagaccaggaaggactgcatgacaatatcctgttcaaaagccagacaagaacaactaacccatcttatgttccatacccttaggaccgtggccttacataatgcaaaacctagttcatttttaggtagtaatgatcactaatcctagagcatctagatgtaatattttcatttaatgagccctctgtgccaacataattcagtttcatagaaatttctggaacctgagtaggctggcatgggagctattcatggtcatataggagcattttagtagtccttaaaccataccatgtgggcagttttgcttcagatcattctagcaagttaactgggtataaattataaaaataacaaaaatatgagaaaattgcctactcaacctatgtgcagggcctcccagctgtcactttatttaattatgtagacattttgaacacctactctgaacctggcactgagttggctgctgtggatacaaagatgactatgacacattctgcagctcccagttctatggtccagctggggcccaaacaaaactttgagctgctgatttgattggcaaagaaaataaaacagcaggaaaaaaggctagcagctgttcacttatagtcactttccatcagagacttcccttctaggtttaaacacttctttttgtttcacgcacaaaggcaatgaagttcttcctgtgaaagcacctaatcttagaggtaaaagctaaacacagaggagtgaattctgcacagcacaaattgacattctttcctctaagcaaatcgacattacattagatttggaataggaacccactaataagacatgtttatagcatggtcatacaaaatattagcacagtggaaagccctaggaagaacactgaccacagacaccaggtagtatttaattgaaaatgtttctgccatagggaagaactattaacttaactttaatggaatttttaaatgtccacaacaggaaaaaaaaagcaaacaaaaaccttagaaacaaatggcatacctttggccacatatccataaaatgaaaaggggatctgagctgaatgagcttgaataggtattagtaatttctttactcaatcaaatttcttgagcccctctgtttcacatattgtactgtctagattatgataggaatatagtggtggtccttactctcatccttattgacagacactaaacaaataaatttattactagcaatatgctccacactctgaaagtcaagtacaggcaactatgagatcaatctggccttgttgaaggaaataggagagatcatggtttaggctaagaaataaaaaacaaagagccgatctgaaaactgggtacaaagtgccatgtggctgtggatggaggcccatggggagagcattctagacactatgtagaagcccaggcagtctaaagctatcccagctctctcatgcttctcctctccagcatgtacattctttacagtagcaagatctccactgtgcttgtttcatcttgattttcagaatcatgagttacagtcatctaagattaacattaaccattcattagaaagtagaaagatgtttgccagggattggagttaagggaatggatgaggaatgtttaatgcatgcacagctttagttttcaaacaaatgagtagtgacaatagtgttgatgagtacgtattaatgtatttaatatcatagaactatacacttaaaatgattatggtggtaaattccaggatctctgtattttaccacaataaaattttaactatgaatttttaaactacgatccctcacgaatgctatgatcataaccaaagcagctctgtaacagccattatttctattctatgcattgtgacttttattttctcacagatttatttgcataagaacatgaactctggggaggtaatgactgtgtttgttttgctcactcgcctagcctcaacatagagaattcttattggcatggaaaaaatgctagggaaatagttggtagagttggaatccaactaaagcagtcttattctagatcagccaatgggaaaaatgcctccaatatctctgtcttgtaggccccatccacttaggtctttattatctcttatctagaagccacagtatattcctaatttcttatcttcactagcaccattcataatcatctcgaggttgcatgactcttcctggcataagatttaaacataaggataagctttgggcacagcgttccaaatgtcacaggatcaatttagtttacatcctactctaacatttgctttctagccatgatgaaattcatgaagtcatggaacttctgggcctcaatttcctcatctgtgaaatggggagccacttggaaaatgacttcttgtcaccgagcttcagtttctggcttgtcttccaggtctcttcaaatgatcttcatggataacaggctgtaaccccagatctccagttcttaacagcttacctcctgtgaaaggagtcccttacaaaaaaaaaatatcttgaaaataggtctgatagcatgagaatttgctagattttcagcttctaagagatctgttagcatgcaccaaatatgcagaaatcattgatgtcgcacctattttgaaaatccattcctactataggtgcctttgtgtctaccaacatcctttttatgcttaagatctagaaatgaagatgagtgaagtgccttctgccagggagttagtgagcacaggttgaggccatgaatagtaagtaattgttggagaagcgttagctttatagagctgttacctgcttggtaagggctataagagcttgtacgaaaagttcaaagatactcttctcccatgtttacttttgcagaaaagcaatgccacaccaaaattaggtagacagtagaccctgtttcatagtcaaatatattccactcatcttcttgttttcttccatttccaaaagtaatacatagggtgctagaattgtgtcagatagtctcttttgcaatccttcctccttgtgagctatcacctacccaaatgctagcacctaggttctggctagctgtcccataatagaactctaacattcctttgcaagctggctttgtgacctcagcaggacagccaatttctagccacttcattatctctgtgctcattgctgtttcacggagcaacattcttcgacatgacaaatgccttcctcaagccactccccatagtttccgctttgacaggatttgtaccctctcttctggaatcgagctcacaaatattactaactctgaagttctgatggtattattataagctgggtggaaaactgacatgtagaaggaataactctccctgggatgggccagttcagagtgagcttcttagaggaagctgcattctaagcaggcagtcagcacagccatcctggctctttgaaattgaataggtggcaatccaattacagcatgtatctgatcatttcatacattgtggaaacacattgagatcaaaagagccttcatttcacaggcatgaaacattcccttccacacttggcctgctccagatgggaccttagcacataaataagacaacatcatctagtaaaataactctgttcattaagagctaaggtatccactggtaaatggcttatgccatcaaaacagtataccaggggataaggtaagtggatgcaaaatgacaaaatcccttctaaagaggcctaactgcattgcaaactcaaatagcaaatatgcattgaaggccaggataattggtcctttatcttctccttataaaaacaaaggtttatttgccctttaaatggtccaataaaattaaattggcaccctgtagtgtgtgctgaatacataatcagaaataggaagcaataaaaaaaaaagagtgagaaagcaactgcatggaaaaccaaaagttggaacacttagagaaaaacaatgtaggaatggaacattgtttgtactaagaccttgttgttccataaagaatcccagagcagccacttgtgaaagctagacattcccaattgtatccatgatacctccaaggcaaaaagctgcctgggtttgaagcacccacaaaaaagaaaaaaaaatgagatggaggcaaggcagggctagaaaagaagtgagtgtctaagaaggggaaatttataacatgctaaaagtaaatgaaatgttcataaaacaggactgcttccttgtattcagaatgtcttttaaaggatattccctgtaatctttccagagctgcttgtgttaagatcttgagagaaaagcacaacaaaaaagcctcctagtacctaagtatgcagcaatccaacctccagcgaaacagacggggcttgctaactgatgaacagaaaacacaggcaataatagtcatcatcataaaccaattgctttctgatttctaattttgatggccagccacgtaaagatttatttaatgagcatcagcgaggtgacaatacacttaggtattaacagaatggatgggagagatggggaattgtgtcattgttcaattatttcttttttggcatcaaatatattcattcatatattcagagaagtaatcatgcctgaaggatttgacttggaaattgcagaaggctttccagaacttgattttgtacagtggctgaggaggtcagagaatgcttcctttaaaatatgtttgctagagcttcatggtgaatggagagagatctagaagtcatctccctacctccacacttgggatacagaggagttctcctgaatatattaagctcgtgtgctgcttgacagacagtttctccaaattttataggggattctttcatcgctaaagttttattttctctataattttccaagacagccaccaaaggactctgcccttagagtgccagcctcaaatgccattattgctgcctggctgggagtacatccagtgctcccatgccactcgggaacttaactccttcctagagatagaggagaaggggctttgggccaaagtggaaacctcaaggataaagatgacagcattgtttcactgtttgaaggagcctaagcactataagaaaacggatttttaatatcaacttttccatgtaaaagctcaagagacaactagacccaaacagtgtacagaaccaaaaaccacaaaggaataaaagaaatatactcataattgcctaatcgctggcacagaactttgaaccctccccctgaaagggcgttttccatatgacttctggagcatttaactaagtacaactataattactactattcctataataatgggtttcccatagatctttatattttatattcattatggataatacacaaaatatctctttagggtatatctctttagtgtccttgtcagcatgctgacaagaagctggagctcagaaaagggtaaaatggtcatagattgagtcagcaaggacttaggaaatagaactggagaattgtgcctctcagtaccaatttatgtcatcagctctttaagtgcctaaagtatgaagccaagtattcaaaacctgactcgaaatgaacagagcccatttcctcactcgccaaagacatcttgatcaccagtagaagcaagcaaacctcagctaggttcaggcatgtgactatcaaacgtgggcatggggacaagggcttctgtcactcagcaaaagcatggatctcttagaagctgagggaactgagggagcctaacagagaagaggtttcagccgggtttctgaagatgagagaaagtgatggtggcagagacttgtgaaatgccacttcatgcttagtatgcagcaggagcagatggagaaggttggatcagctgatggatcagctgaacctcaaagcacatgaggaagaactttgggagataaatttcaatagtccctaagttttaataatggggagccacataatatgaatcaaacacatactactttctcaatacttattacatgctattgcgtgtaacgtgcttcacactcttagcatgaattttaagatgaaaggttttttacacgacatataataacaaacaatatggaacataggacccaggttcagagtcccaatatctaaaacaagatgcactgtgctcagacgtctgccttgaatgttcttagacaacctccgaggactaacctgagtgtattctttatgactgaatatgcagtttctctagggaaatgccattgttatctgaaaatctgaaacttttatttttccccccatggcaattctcaaggaaatttcagaaccctgattctccttcatcttagagcaaatggacagtactggtatggtcagatatatccttagatagcacacaaaatttacaagttcatacatgactgggcagccaagcactagaggggctacttcttttgtctgcagaagaaactacatgctacaaatttcatgtgcttacttaatgctagctatttctagctatttttagtcagttgcttccccatggagcaagttaggtgcttcctacgatacacacttcctttaaagccgctgaaggagattcagctgttctgtactgcagcaggaggttagagtgggaatccatttaaatgatgttctgcaccagtgctttctcttctcgcttcaccaatggattgagttctaaaacaagatgtataacttggcagacacacatgtggcctgagtaccagagatgctagttaaagccatatagctaggctagaactgaaggatattgccacaaggaacctaaccccatcgcatgcaaatgtgggaatatgtgctcaccttctcaactccacacttccctaattatccctaactgagccaaaagcagaagaaagccctttagctctcatcatcgggtaccagttcgatgagattctaaggctgtgaggagggacgcattcagatggtgctcatagggtctaaggaagcgtgaggaactgcgagaaccgaaaaaggaataagatgtcacctctcccaggccataagcagtgaagatataaatcctatagaggaaagcagtgttcagcttgggacagagtgtggtgagacaatggtgcaagaagataaagaaaagcatttaacagatgtgttcgataagcagcacttcagtttcagaaaacagtatttacttttgccatatagatagtctttagcatttttcgttctacttcatttattttttaaatgttaggtcatgactcactataatgatttcataagccactaatgggtagtatcctgcagtttgcaaaaacattactgtagggagagggaaagaggattagttttcattcgttgttgccattctccctgaactatccaactttggcctgaaacaaaccaaaagtgtggatgatgaatacaatatacacatgcacacacacacacacacacacacacagagagagagagagagagagacagagacagatacagagacagaaagaggcagagagacagacagagaaagagaaagagagacagagggagattaagataaacacagagaagagaaagatgaaagtaagtgtgaggtggggggtcatgactataagttccattcaggaggtcttttcaaggggaatttatgtaaatattcccagcagcttgatactgctcaataaacatatagtttacaaagtctgctgcatgttcatgcttaaggcacataggctacttgaatttacatatctgatctaaccatgaagaagatcagaacctacctggtggatggcagtggttgttgctagctgctttacccttctcctttgtctctaccacaatagcattcagcattgttttctcaggcaaaatgctcctctactgagatatccctaaccagagagacattcttctaggaggcaacctacagtctcagatattttctgattcccctatgtgaactatgttctatttattctcttaatgtctggtctgtcagaagttggctgcaagccaatcatactgtaaaagtcctatgtaattcagacttaaatgttcatctcccaccccacatttacagctttatggaggccttcaccatcctagccaccaaaaatggtattttcaaccttatagtaattgatagagaagacaataaaagacagaaagtattttccatggactctcataatagactacaaggctcctaagttactaactgcctacatattggcagctgtcatccatccttagaaactatccctgtcctcaacaaagaaaaatatgaaagcagccagtacaatgcctaaaacagagtaatggttatgtacatagtaaattagggtgtaaacattgatataagtagggttaggggacaactttaataggatctattagtctagtactatctatgatgatggaaatgtttcattgcccactccactagctgttaaccacctgcagttatggaacacatggaatgtgtctaatgtgaccaacaaagagaatctgactgtatttactttaaactcatttaacattaatattttaaagtgtgtgtgtgtaagagagagagagagagagagagagagagagagagaaagagagagggagagagagagagagagaatgtgatgtgagatagaccacagagcacttatggaggtgaaagggtaacttactggagtcagttttatctctttcaccttcacattggttccagggattaccctcagaccttcaagctgtgtgtccaagcacaagcttgtgtagtacatgcctctacctgatgagccagcttttcaacactaaatatttgagacaaggtctcactttgtagttcaggctagcctgaatcccacaatctatatcaggctgaccttgaaatcttattgactctcttacctaaacttctcatgttcagggactgcaggcccatgcccctacaacacctaaataattatattcatttaagccttaaatagtcacatatgatgagtggctaccagactggacaaaatacatctagtcactcgttataagaaaaacattttgagtaacagccactctttcactggtaggtagcattttacaaaagctagagctttttctaaatgatctccaagagccaaaagttctgtcttctaaggaatgtctttctcccattagtcaaaaggctagagaggatatacgacagccaattttagagaacttagttctcagattaaacctaaagtgactgctcccaatgaagatagttttcaaacagatagcaggaaggcctgctgaggctgctgcctgaatgtaaggcctaaagtaacaatgcttctgcctagacttttgaggtacacaattctgcacagaccccgatggtcaagatagtgaaaaatagcttgcagtccagtgaaaaacaacctcttcacattgatgcaagcaatcatagttacattcagtgggccatgcacaaaaaataaacatgaaagttgcagggactcgtttccttcggaagaaaaagtgtttcatacaaacaggaagggggtgagagtataatggaggtgcaaattactgagacacattacatgtatttaagaaattgctaacaagtaaataagtttttgaaaaatctcgggagtctaattaaagtgatcaaaagtgcctttaatttaaactcactttttcatatacatggaaattttttgggttttgttttgtttgctcccttgcttcaggctgttggactacttttaaattatggagattttatagaattctattgaaataataagttgaatggatttttataaccaccaagcctgggaattgtgaaaagcctaacgacttttcaagcgtaatgttccatcaggcctgcatttgttaaatattacaaggctgctaacttaaaaaaaaaaaaaaagtcttctggaaaccagaaatgttgaggactgtggattttaggagttggtcatgtagcagtaattttacctgaaaaatgagcctacaatttgattcctaacaataaagtgtaatgagtcaacttttgatcttaggcaatgacgccaaaaggcatgtctttcctctcagtatcctctttgttttcctctttttttctgcttcctctgcataaaactccatgaaaaacagtaaagatacatggtcagagttggtaagaaattaattccatctccatacctaggaacaggttgaaagaaccaaagtcagttttaatcattcatactaccaaactgcacatgttagaagaatacatttgcaggactaagaagcactagccagagtatttatcaactaatcttccacatcctgggaagtgttggggtgaagaaagaagtagctttcagaacaaaatggcccttagttctttttttttttttttttttttttttttttttggtttttggtttttcgagacagggtttctctgtatagccctggctgtcctagaactcactttgtagaccaggctggcctcgaactcagaaatccgcctgcctctgcctcccgagtgctgggattaaaggcgtgcgccaccacgcccagcatgacccttagttctgttatcttcagcattttgtctataacttagataacactacccaaaatgatcttatcaaattttcagatgacagagagcaaaactgatttttatttattaaccaaatcacacttttaaattacccccatgaaggtgggtcaaaaccatgaggatatcttaaagaaattgaagtattttaaggacaaaaataaaagaccttgtatatccatatttgtggggcaccagtcatggcagaaatcctttatatgtatgtaagtgtaggagaccatggaggccagaagagggcattggagtccctagagttggagctacgggtggctgttaactgcccatcatgggtgctgggaacctaaatgagatcctctgaaaaagcagtatgtactcacaaccactgaaccatatccagcccccagaaattcctattaacgcataggcttatacattcaagacctcaaagtaggagtatattttatagaaccacattgggggcttgtcaaaaaaaatatcattagcattctaggtggcactgacaaatatgtcttgtgtataccaaaatggaggtgaaacatcattttattcatttacttgtttgctttttgataggttcaatctcactagcacttgtaccccattttggctacaaacataaggttttgacaaaccgtaacatattcagaggaagatgcttagagtgatgatgtgcctggacctagacccatgttatacatcaaaagaacagctggtactaggggtaattagcttgaagaaaaggtgttctactcaaatctatagatgtttggtggtctactattagaatatgaagtaaatacttgacctttggcccctgtctctagaaaagatcaacagttagtggaagttacaaggaggcagatttatgctcaataagatgaggatatttctaatagaatcatctaaaggtagaattctgaatgacatattttatgacagggtgagtttataataatcagcagtatttaagaggatatggtatgaacagaatttcaaggcctacatggatagcttaagtacaggaaaattctgtctcaaagactgtgtgaaagaattcaaacagaatgggaagtatacatgcaaattcctaaccggtaattggactaagtattttattactttatatcatttctaaattgtgaaattttcaaacctatagaaaatgacataacaaaataactatggtttaatttttaagaattgcttttatttggagacctgcctcactttctctccaacagtatgagctaccaagtgaaataaatgcttttcgaatcatttatggcatgttaccaagtttgaagctcttatctgtccatgacaaattctagggtttattctaagacactacgaaagcatcctttttccatctagctatagaaattatttcatttactatgaatggatcactggctcaattggtttttcaattaggagtattgatagctcccattttaaaagagtttcaagtcaagatggacccttactatgtatgaggattgacagtgatatgtgctagatggcagagaccaaagctgaaaagaatgaaatcctgtggagttattcataaagaagttgatgattcctgggaactcggtaccaatatggcctactcactgacactcagtaagcaatctcggtcatttttttctaaaggaatttaagttactttcacttattctcttcacaccccaatgaagaaggcaggtcacatgttacaaatgacagatctggaagttcaatgaagtaactggcccaacgaaagtcacccaaagtattcagggttgtcataatagaaatgtttatcatgcagtgggaattcaaaggtcattagatgaatgactaaattaatgaataggcaaacaaaatttaagttcatatcttatgactgggcttcaaatcttgaaccacattatcttaacataaaggggttgatccatttcaatacattcctggacatttctgacattgctaaagaaaggtggtttacagttaaaggtgtaaaatgaattttccagaatacatgcatttgtatattagcactgtatttataagccattatagtgaagtaggataaaatgttgataatgagtgttttctttgttggcagttagatacatgctatgtaattgcagaaataactagttagactgtcagaaggcagtgcactcctgagagtagaacaaaatgcacagaggaattaaccccaagacagtcattaaaccttagaatcatcatctggagaatggaactgacaccttgttctgactcaaaattacatatacccactagggttatggagctccaaggccaaaggccttcaaggctggtgggaactgatctgtataaacccagggatgctataagctaacttccattccatataagctctacctcatccggttccccttctcctccatccccagattaaatttttagacaataaaaatgcaaggccagaaatgtaagtactcatttggtgggctttgacgtgtccaaaataaatacttttgctaagtttttaccataaaatgactctttggggattttgtagaaatctatgtattatcattagatttttttttccctcctactcaggatggaagtcgtcagctaaatttatgattttcagtgtggggagcagataaaagtcttctgcagatgggaaacagattttgaggcattttgagttatcatcactgtgctgaaatggtactcatggaacccaatgaatggagtccacagatgctactaaacatctgattagtgcccaagacaacttgcacgatgatattccaaacaaaatataaatagtgtcaaggttgagcaaacttgagatgagtcatttgtaaagttgcattcattggtccattaacaactcatacacaggaataatcctcacagaaatggatattgagatgcttataatttgactaatcaacccaaacaaaaaggagaagaggaatctaacaaaggagaaagtactgcaagcctgtgcccagttaaaaacactgttgtcatactataagaaagactgagatcatgaactgaaggtgaacagaggataaacatactttatatactttacagcactggttctcaacctgtgggtcacaatcgaccctctcacaggggtcacctaagacaatcgaaaaacacacattgcaattcataacagtagcaaaattatagttatgaagtaggaatgaaaataatcttatgattaagggtcaccacaacatgaggaaatgtattaaagggtaacgacattagaaagggtgagaaccactgttttagaggccgagtagatggagcattacaaaacagcagaacaaagaaataggagagaaagaagaggcaaatatatgctctcttgggctctgtcttgagtgactgggtgagggtaacatgttagaagaaacatggagaagaagagccgattaataggttgggaatgcaaataagaaaacaatatgctcagtctgcgatgccttagggctgtttaatggggagttggaaatgcagatctagagctcctaagtatctacttaaaattcatccacatggaagtaaaaagaggtgaaatgagctgcctagcacacagcaggacctttgtaaatgtctgttgaaagaccattatgctcggtgtaagaagcaggtcagcagcaatgtctttgaaaacatcttcattgaattgttgggacaagaggaaactgagaaggaggattaagggaggtcaagtgaagagcatttctttttaatttatttaatgtgtgcagatatctggcctgcagaatgtctgtgtaccacgtgcatgcttggtgcccacagaagtcagaaaaggccatcagatcacctggcactgtagttacagactgttgtgagctgccatgtgggtgctggaaatcaaacccaggtcctgtggaagagcagccagtgctcttaacctctgagccatctggagaggttccaagtggccagaagttaatgctatggaaatggaaaggagaattttaagaggcagaacttcatcaacaatatcaaatggtgttcaatagtcaagatccatgacatccattaataaagctgaatgcttcagtaggcatatgggagcagagtataggagaggttgtgcaaactgaggattacaaggtttccatcattacttcaataggcagaatgagagacgagttagaaaaacagtttatggtggtattagggatttgggataattggaatctttcagctgatggtcatcctgacaagacaaagacagtttgtagattaaagatacacatttgcacatcataaacattatgccttttctcagtgtattgctgcattattgaatatcaggttaaaaagaaaatcattgaggacttgtagaattgaagtgatatgtgttgtgtggcacttgagaaacctaaaaggtaaaagtaggctcaatcagaggtagtttccaggtaagacagtgcgctcccttcatactgagaggattgatccagagttaccaacctcatttcactgtttggcttattagcttaatatttgctaccaaaaatcattacatccaattcacagttctaaaacaacatacatttgttactgtccaggtctggaggtcagagtctaatataggtcttgtcatattaacattgaggtgttagcaggactgcattgagctccagatgccatgaaaaggagctcattagaatgccttttctgatgtttagagggccctcacattccttagaccatgcactctttctgattccaaagctagcaatggacacttaagtctttctcatatcactcctttaagaaatcactagtctatatgatctcttcaagtctctccaagtgttgtgcttcattgagctgctagaattcaatatactctggcattacataaagaaacttcccatgatccatctggatcagttccttcatcgctatattgttctgcttcatgcttgtttcccatgttaaatcagcaagagacttcagtttccttttttctgcttgattcaaaggggtatgaaaagtattctgtaaatggtccacaatattgttatttggatctttggaataattaagttgcttggcacttttaattatgctttttgaactacgggtggtgtaattagatgctaggctgtacattaacagtacctgtcccaacctttcagatttgggagactataaataaaagtatgacagctgggtccagcttttcttgtcactcaccactgaagggagcacagctggagaactacaacatagtccctaggaaaacaggatgcagtcagaaacaacatcctcaatgagaagaatttgatttttctactaggggagaggtggagacaggtattcctaagagaaagacaagcaaacaatttcatatcataaaggttcagaggccataggccagagatagcgttttaggaagagttagaggcagaggacagtagctcattcgtgagccaaatcaccgggattccttttgtaatctatgattacccaggaatgagactgggaaaagcagagaaggaatggatcagacaggcaaaagagaaaacaagctgtgctacctagagatgcagtgtgagactgagggcaacaacagtggggaagggtataaaagaacctgcggcattaaagggagcaaagcatgccaagggaagaaaagctgactatttgaaattgatatattcatattttatttacttatatcatctattggattttcctgtcaatgatatataagatgtaagaggacagtttctcctccctctaacagtgcccatctagcatatcgtagaagctcaataaacagtttttgagtaaataaagagctagtgtcaatggagtatctctctatacttccatactagacacctcctataaattagcccagttaaattttcacaacttttctgacataggcaccattgctatcttgattctattaaaaagaaacaagctcagaggcacagaagtaagtagcaagtaacttacttaacaagtgatagatgtcagcatctaggcttctattagctactttccccattgctgggaagaaacttctggcaaaaacaacttaaggggagtttgttttgactcactgttcaagggtatgtctataatggtggggaattcattgggccaggagcatgatgtggctggtcacattatatccatagtcacgaaacagagagatggatgctggtgctctttttactttctcctttttattgagtccagggaatggtgccaccaatagttagggtggctcttcccatcttaatagtccaacttctgaatctgcgtatatagcaatggtctacccaaggctcacagaaactaattattctacattaaatcatgcagccaagaactgaaatcaaaatctgcctgctttgaaagatagtgcccttttctctttatgaatgactttagaacattgccaagacaaatatttctcccatcagtgttttaccaagaacagccttctgaaatgtaaacaaaaaagtgggtacaatagaccaaggattcaacaaaggaaacatattccttcaaaaagcaccaatatcaaaactatcaccaatctgccaccggctctcttttctgggtgttagaaggggaaggtagctgagatctatctatgtgcctggactgaaaattaaaagttgaaggtatgttactttctgctaggcaaatacttatccacactgccctagacagctctggattggggatattgaggaaatgctgagaaggcatccctaagagcctggttcataattcattgtatgaccttctacagatacttttttatattgcagattctttatgataggtagtgtcagaccagtagaaatctgctcaataacatgagctccaattttctcttttatatacttatctttctatatagatattagacttttgtacataaaatttcaattctagcagggctggtgatatatgtctttaatggcagtgtttgggaagcagcgatctatgagacagatctatgagaacttgaggctagcttggtctacacagcaagtcccagaacagtcatgcatacatggtgagactctaatctttaaattttttcatttcaatgatttccaacaccaaatactgtgctttgaaaggcaacaaataatgaaaaagctagagtgagctgtgaggaacctaatgagctttttcattttatacaagggaatttgcatcatttctacccctctctctcccgttccaactccctttcagttttatgacctcttctttttaatattgatgttacatattgtacttaaattaaatgaatattaatattgttgtatatacacttatacagtgtgtgtgtgtgtgtgtgtgtgtgtgtgtgtgtgtgtgtgtgtgtgtgtaaaacagattattctatgagaaagttcagtgttacattcaactgtattctctgcaaccaaggatgattgtaagaatctgctctgagaggcgctgctaaggatccctatgtcccagctgttttcagaagctacttttgtgcctgctgattgtctggtctctgggccttctgttcatgctacctacacttattgccgtgaatgaaacaaagaaaatcctctacaagtgtcagtatttgctgaacctttgctttatatgaagacagtagaacatggagtgaaattctcttaacacttgttgatgtccatcatcatgtgtgtgacttttggacttgaggaaaggttgtcctaacatgtgaaatagtagagaaacatacgacacaaagttattcgttatgttacatttcttggattgactgatgagtttctgggtctttattgtattccaaataaataagcaaatttaatgaagtataaaagctctataaattactcccaagtctcaaaatcatagatataagagcaacacagcacttctttttctattagccagattctcatcgctataatttcttttcacttatttgacaaaaacaaattagtcagaatggggttctccatgctgaaaatatgctgcatctcttcaaagcctgttttatgcagggtaccaaggtcttccttttgtgattactagttgggatggagctgagaactaccagttattctctgaatcattttagttgaaagaccatgatcacttgttcaagccttttggttccatgaccattaatagggacagcttcttccttgaattttaagtaaaataagcattttccgtatttccttaaattttaagtaaaataaggatgaatttgaatttcagataaaccacaaataagtttttaatttgaaacatgcatatgttaaagctgatttattttctgtatgaaatacaaatttaattggatatgtatcattatctgctaaaaatgaaagcagataaatagatatctcatacaagcagatatttattagtgacactgttggatttggactacaaggactataagttttagagtgttcatgtcactacttactaactgaaacatttttgatgtccaaatgagcaattaaatagtaaaggtatcagtatttcttggggtccattcagaaattaaatgagactagttttatattacttaacaccgtgcctaattaagactagttatcactactattgattcttgttattttcaataacttctatttcacttactttaacgtttactgttgtctgtttgtcatcattatttttcagtatttgaccttatatcaaagttctccatttacatgattcaacatagaatagatttttccttagtatctcctttcatgctaacagaagggttgtttgtttgtttgtttgtttgtttgtaagtgttccctgttactttcacctttcatcaactagctgctattctatttttttaaatttttttattcggtatttttctcatttacatttccaatgctatcgcaaaagtccccgacacgctccccccccccacccggactctcctacccacccactcccacttcttggccctggcattcccctgtactgaggcatataaagtttgcacgaccaatgggcctctctttccagtgatggccaactaggccatcttctgctacatttgcagcaagagacacgagctccaaggagtactggttagttcatattgttgttccacctatagggttgcaggtgtccctttagctccttggatactttctctagctcctccattgggggccctgtgatccatccaatacctgattgtgagcatccacttctatgtttgctaggccccggcatagtctcacaagagacaggtatatcagggtcctttcagcaagatcttgctagtatatgcaatcgtgtctgcatttggcagctgattataagatggatccccggatatggtcgtctctagatggtccatccttttgtctcagctccaaactttgtctctgtaactccttccataagtgttttgttcccaattctaagaaggggcaaagtgtccacactttggtcttcgttattcttgagtttcatgtgctttgtatcttggggattctaagtttctgggctaatatccacttatcagtgagtacatgtcatgtgagttcttttgtgatgattgggttacctcactcaggatgaagccatccaggacaacccatttgcctaggaatttcataaattcattttttaatagctgagtagtactccattgtgtaaatgtaccacattttctgtatccattcctgtgttgaggggcatctgggtattttccagcttctgcctattataaataaggctgctatgaacatagtggagcatgtgtctttcttaccagttggaacatcttctggatatatgcccaaagaggtattgcggaatcatccagtagtactatgtccaattttctgaggaaccgccagactgatttccagagtggttgtacaagcttgcaatcccaccagaaatggaggagtgttcctctttctccacatcctcgccagcatctactgtcacctaaatttttgatcttagacataatgactggtttgagatgaaatctcagggctgttttgatttgcatttccctgatgattaaggatactgaacattttttcatgtgcttctcagccattcggtattcctcaggtgagaattctttatttagctctgagccccatttttaatggggttatctgatttttctggagtccaccttcttcggttctttatatatattagatattagtcccctatctgatttaggataggtaaatatcctttcccagtctgttggtggcctttttgtcttattgacagtgtccttagccttacagaagctttgcaattttatgaggtcccatttgtcaattcttgatcttacagcacaagccattgctgatctattcaggaatttttcccctgtgcccatatctatgaggcttttccccactttctcctctataagtttcactgtttctggttttatgtggagttccttaatccacttagatttgaccttagtacaaggagataggaatggatcaattcgcattcttctacatgatatgcaccagttgtgccagcagcatttgttgaaaatgctgtctttttttccactggatggttttagctcccttgtcgaagttcaagtgaccataggtgtgtgggttcatttctgggtcttcaattctattccactggtctacttgtctgttgctataccagtaccatgcagtttttatcacaattgctctgtagtaaagctttaggtcaggcatggtgattccaccagaggttcttttatccttgagaagagtttttgttactctaggttttttgttattccagatgattttgcagattgctctttctaatttgttgaagaattgagttggaattttgatggggattgcattgaatctgtagattgcttttggaaaaatagccatttttactatattgatccttccaatccatgagcatgggagatctttccatcttctgagatcttctttaattctcttttcagagacttgaagttcttatcatacagatctttcacttctttagttagagtcattccaaggtattttatattatttgtgactattaagaagggtgttgtttccctaatttctttctcagcctctttattctttgtatacagaaaggccattgacttgtttgagttaattttatatccagccacttcactgaagctgtttatcaggtttaggagttctctggtggaatttttagggtcacttatatatactatcatatcacctgcaaaaagtgatattttgacttcctcttttccaatttgtatccccttgatctccttttgttgtcgaattgctctggctaggacttcaagtacaatgttgaatagggattgcttccagcttctcaccatttactttgatgttggctactggtttgctgtagattgcttttatcatgtttagttatgggccttgaattcctgatctttctgagacttttatcatgaatgggtgtttgattttgtcaaatgcttcctccacatctaacaagataatcattggtttttgtctttgagtttgtttatataatggaataccttgatggatttctgtatattaaaccatccctgcatccctggaataaaacctacttggtcaggatggatgattgttttaatgtgttcttggattcggttattttattgagtatttttgcatcgatattcataagggaaattggtctaaagttctctatctttgttggatctttctgtggtttaggtatcagagtaattgtggcttcatagaatgagttgtgtagagtaccttctgcttctattttgtggaatagtttgtgcagaactggaattagatcttctttgaaggtctgatagaactctgcactaaacccgtctggtcccgggccttttttggctgggagactattgataactgcttctatttctttaggggatatgggtctatttagatcattaacttgatcctgatttaactttggtacttggtatctgtctagaaatttgtccattttgtccaggttttccagttttgttgagtatagccttttgtagaaggatctgatggcgttttggatttcttcaggatctgttgttatgtctcccttttcatttctgattttgttaattaggatgctgtccctgtgccctctagtgagtctggctaagggtttatctatcttgttgattttctcaaagaaccagatcctcatttggttgattctttgaatagttcttcttgttcccacttggttgatttcacccctgagtttgattatttcctgctgtctactcctcttgagtgaattttcttcctttttttctagagcttttagatgtgttgtcaagctgctagtgtgtgctctctctagtttctttttggaggcactcagagctgtgagtttccctcttagaaatgctttcattatgtcccataagttcgggtatgttgtgtcttcattttcatcaaactctaaaaagtctttaatttctttctttattccttccttgtccaaggtatcattgagaagagtgttgttcagtttccacgtgaatgttggctttgtattatttatggtgttattgaagatcagccttagtccagggtattctgataggatacatgggacaatttcaatattttgtatctgttgaggcctgttttgtgaccaattatatggtcaattttggagaaggtactatgaggtgctgagaagaaggtatatccttttgttttaggataaaatgttctgtagatatctgtcaggtccatttgtttcataacttctgttagtttcactgtgtccctgtttagtttctgtttccacgatctgtccattaatgaaagtgatgtgttgaagtctcccactattattgtgtgaggtgcaatgtgtgctttgagctttactaaagtgtctttaatgaatgtggccgcccttgcatttggagcgtagatattcagaattgtgagttcctcttggaggattttacctttgatgagtatgaagtgtccctccttgtcttttttgataactttgggttggaagtcgattttattagatattagaatggctactccatcttgtttcttcagaccatttgcttggaaaattattttccagcctttcactctgaggtagtgtctgtctttttccctgagatgggtttcctgtaagcagcaaaatgttgggtcctgtttgtgtagccagtctgttagtctatgtctttttattggggagttgagtccattgatattaagagatattaaggaaaagtaattgttgcttcctgttatttttgttgttagagttggcattctgtcattgtggctgtgttctttttggtttgttgaaggattactttcttgttttttctagggcttggtttctgtccttgtattgtttttttttttctgttattatcccttgaaggactggattcatggaaagataatgtgtgaatttggttttgtcgtggaatactttggtttctccatctatggtaattgagagtttggcccagtatagtagcctgggcaggcatttgtgttctcttagtgtctgtataacatctgtccaggatcttctggctttcatagtctctgctgaaaagtctggtgtaattctgataggcctgcctttatatgttacttgacctttttcccttactgcttttaatattctacctttatttagtgcatttgttgttctgattattatgtgtctggaggaatttcttttctggtccagtctatttggagttctgtaggcttcttgtatgttcatgggcatctctttctttaagtttgggaagttttcttctatcattttgttggcaatatttgctggccctttaagttgaaactcttcattctagtctactcctattatccgtaggtttggtcttctcattatgtcctggatttcctggatgttttgagttaggatctttttgcatttttttgattgttgtgccgatgttctctatggaatgttctgcacctgagattctctcttccatctcttgtattctgttgctgatgcttgcatctatggttccagatttctttcctagggtttctatctctagtgttgcctcattttgggttttctttattgtgtctacttcactttttaggtctagtatggttttgttcatttccatcacctgtttggatgtgttttcctgtttttctttaaggacttctacctgtttggttgtgttttcgtgtttttctttaaggacttgtaactttttagcagtgttctcctgtatttctttaagtgagttattaaagtccttcttgatgtcctctaccatcatcatgagacatgcttttaaatccgggtctagcttttcgggtgtgttggggtgcccaggactgggtgagttgggagtgctgcgttctgatgatggtgagtggtcttggcttctgttagtaagattcttaagtttgcctctcgacatctgataatctctggaatctgttgttacagttgtctctggttagaacttgttcctcttgtgattctgttagtctctatcagcagacctgggagactagatctctcctgagtttcagtgatcagagcactctctgcaggcaagctctcctcttgcagggaaggtgcccagatatctggtgttcaaacttgcctcctggcagaagttgtgttccactcacctgaggtcctaagatcccgtggattgtgctctggggaccttgggggtatctgcagactcagtgcccaaggtgacccagtgctagggccgactggaagggacttgtgaccctggtcagtccaagttttctgcttccccaattaatgctgtctcaggccctcacgattggattggaacagaagttgtgttccactcaccagaggtcctaagatcccatggacagtgctctggggaccttgggggtgtctgccaactctgcacccaaggtgacccggtgctggggccggccagaagggccattctttaattaatataaagagctttactatctatatgttttaaggccacttttaattcttgaaatcaaaagctctggtcttttatgctggagatggtgctagagatggtagagtaaatgaaaatctttgaaaagcctccctcaagttaatggctgattaggttactcaatgaatggctctaatcaacatcaatttaaataacatgtatagaaagcaagatattggagatatcaagaactcacgttctcataatgtggtgacaaaatgaactagattggtctctacttgccttcctcctacttttcatgttttctttcctcatgttgtatagtgactttactgtttgtcctctcaggggaggatcctaggttctagagttctcttctctaacctgcttattcccatcaccacatatccttctgtctccctacaactaattggacacattcatttgtcttaacataataatggctttaatgattgcacttcatccctctcccaaactgcagacttttaatttaatggcataaaactaaagaaatgagcctaacactggaatgtatggtttcatagcagatatgggagaccatgcaggacctcttaaatcacattgcattatgcccattaatgtctgcttcgcatgaatggaaggaggcactggtgcagataatcgaaagatcatttccacttggtttgggaatgcaccacacagtgttgttgtagctgatttgctttgctaattatgttctactgaagctaatgttgaaattggttcacattttttaagctcctctgggccagaaaagagatggggtagcagcatggcccactttgaaatgaaggaaaactgacaacaatgaggaggaggtcatgaaatgtctctatgtaggctaatgagtccactagatcaatggaataggatcaaagtagaacttggtcaattacacctgggcacaggaagtaaccaattgcctcctgtggttcaatggccactgaaaggtcagccattcccacagcctgttgacagtctgaaaccctctaaattagcagtctagatgaagagtctttgttatagtacaactgtgattgtaccattcttggacatagcaagaacaacacatttcctggtagatacattagcagttagtctgactcaatttgcatccactgcattggctgagggggaaatgaactgaagatatggaaagacaagtttgccttggtggtggcatggctacactaaggggtcactaggtaaccattgtgggaagataaaagagccttaagtgccttagaggtgagcaggaacacatgtacacgataagacaactatcacctcgtcccttcctcagtttctcggcctctgtaaacacagataatatataactaatgccaatgaagatttttcttaattattttcctgttggtcaactagactatggtaggattctatatatttttctagagtcttgactccttgtttctttgttgttctcatttgtttgtttgcttgcttacttgctagctttttgacatggcaaattcagagattaattatgcattgactttctaaccttacaagttgccacaggggacaactgacctattgaaatgtgtttctttctttctcgttgcagtctgctcccagttctccagaggggtgtatgctatctttggattctatgaccagatgtcaatgaacacactgacctccttctgtggggccctgcatacatctttcgtcacacctagctttcccactgatgccgatgtgcagtttgtcatccagatgcgcccagccttaaagggtgccattctgagtcttctgggttactacaagtgggagaagtttgtgtacctctatgacacagaacgaggtaagaagaaacatctatttttctctgtgggtattcatgtgatgatgattttcacactttatcacacatgcatccatttcttctaatagacaaagtataattctcttttaaatttgtttttagtacttagtataaatcaaacattaataactatatcaatggtaattttagaacctaattttccaaatcatatacatatatccccctaaagagtgacttaggttaaacccgcagacattatttttgcaaaagagcaagcccagcaaaactttatttgatctaaaatatataaaacatagaatattattagataattttttatctaaaaatactaaaatttccatgactgctatgtgtgtacatatgtgatctactatgtcacttagtaatgaaagtccaatctggaaagttttagaaaatgaatctagtgagattattattgccttttcaacatacagtaattaatttgttaaaagatacacatcatgctccaactaaatgtattcccaagtccagttgtctatgaggattttctcaatgaaactgagggacgttatcatcatgacattccatcaaacactgttcttatattagtcatttgcctggagactaaatgaggatggtttgggtctttctgactccaggtttcagatttagggaaggaagatacacatgaaaggtctgtcttctcagtcctgaccatacctacagggaagctctttctcctcaacataatttgaaaagttcatttgtccttggaaccccttggttttctttacattcctcttatttagctacagcaccagatcatgtcagggaacacataaacctgtgtgtgcctaagatatataccagcaaaggggattgaacttcaccaatctggatcaagatttgagtgttataattcaagatctgatactagctagctttctgatcttgaccaagtcatcaaggctcacttgaccttggtctcctcacctaaggtgaaccccttttaatgcagaattccatgcctctgtgatttttttgaaagtatgccagacacaagaaactttgtatcttggaacaaattgtaacttgtctattgccagtgagttaatctagtgattctgaaagctgctatctaccctttgtggtgtattccacccctgggacagattcatataaaatatagttccaataggagagagcaaaaagaaaaccattcatgcaacaattcatgaacaacccagaacaatgtttaattgaatgttatactagcttctggttgctttaaagactgtaaaaatgtatcattctagaaatgagagatttcagagacaactacttgtctctatggtaggaatcattgaggaaagaaaaacaggaacaccatgaagtctcaactttaaacaaagaacaacaggtaattggagaaccctgaaaatgggaaaaataatcttctccaaagaagactcccacctatccaatatcaaggagtcagcactgagatcatatgcataatattatattgactgagcaggttgtattcatgtatttaggaatatttttatatatgtcacaacaattaaagaaaaagagactgtatttgagaaacagcagtggataagagtacatgcgaggggctggagggagagaagggaaggaagggaggtaattatagtttcaaagctaaaaaattgtgtgtgtgtttgtgtgtgtatatatgagcaaagggcaatgtaagaaagaggctccatgtatctaagcaaagcaatgttgtttaagtattatttaaaatttctaaatttactcaaggaattttctctggttcaaaacacagagagtgaattagctcatttccatatattgaatatagttcaatatggatcattgtaatttagttttcagaactgaaggttgaaatcagcagcttctctctcgaaactgtaaaaattaacgattatttctgctaatgctataactgcatgcattccaaagaagacccagctcatgcattctctcatcatcatctatctatctatctatcaccatctctgctcattaggtctccaatgtgaaaaagaaggctaacatatatctatgtctgcttcttatctcattaagtagtatgggcaactgttttgtctggcagtgaaaagaaatctccctgactgatataaatctgtttctctcctctgtagctacttaacaggaaggactaacctaatatgtttttgagaaattcattacataaactttaacattaattttcatgttggaaagtcttctcaaggtattattccaaaatctatcacaaaactttaagaattttctattgcccatatgggaaatgaatacagtttgttctttaagattcagtatccttataactcagacaactaaccatccttttctccctatgcaaccttatgagactctcatactactcatttttcattgttgtcaaaacgatccagatccaggactctgatttatcaacttcctttcctctagtactgcttgaaatactctcctttattttgataatgaaaatcatttcagtttttctaaacctatagcaaattgtacctccctcttcattcatttaatagttgtttaagtttacagtgataagcaagacacatatggttcctactgtcataaagactactttctatgagctagtgtgatggctcaatggttaagagcactggctgctcttccagaggtcctgagtttaattgccagtaaccacatggtggctcacaaccatctataaggggatctaaggtcctcttctgacctgtggatgtatatgcagcagagcacttatatattaaatgaataaaatttgtttaaaagattgctttctaataagagagacagacaaaatcaagtaaataacaaattataattatacatttagataatgcactataaaaaaggattataatgtttagacctaatttataaaggatgccaagtgacagccttaatgaggagtggcattataatctgcaactaaaagaattgaaggatacaggctaatgtggaaatagtctgtgaaaaccatctgtagaaattaatgaaagtcaagtgtgggtaacaattagtgagaagaggggtggatggttggaggatggatgtagttggaagaacagagataagaggagagctgtattttagccaatacaaccagggtaaggaaagtagattctacagtgagaaggcattacaagattataagcagaggggtcaaatgacctgatttaagcttctacaattaatggaatggttaactaaggaaaattaacaaagaaaaagagccattgtggtcctgcaggtcagaatgataacaacttgaccaaggctggaggtaaagaaaagtccgagaagtagaaatggtgatgttttaactataccagttttgaggagcagaaatcttgcccacctctaaacacccaaaacccacttttgtccacactattcatttggtgcttaacataacatatttgatctggtatatagcaccccaacccctcatctccaatgtaatagtaaacagttctttaaattacaccgtacagtatttgttatgcttgcttttatacatcaatgatcacctcttgctttggtggtaaaatggtggggagatattataagatcaaaaacaattgtagatcttggtccgggacccgccgaacttaggaaattagtctgaacaggtgagagggtgcgccagagaacctgacagcttctggaacaggcggaagcacagaggcactgaggcagcaccctttgtgggccggggacagccagccaccgtccggaccggaggacaggtgcccgcccggctggggaggcggcctaagccatagcagcagcggtcgccatcttggtccgggacccgccgaatttaggaaattagtctgaacaggtgagagggtgcgccagagaacctgacagcctctggaacaggcagaagcacagaggggctgaggcagcaccctgtgtgggccggggacagccggccaccttccggaccggaggacgggtgcccgcccggctggggaggcgacctaagccacagcagcagcggtcgccatcttggtccgggacccgccgaacttaggaaattagtctgaacaggtgagagggtgcgccagagaacctgacagcttctggaacaggcggaagcacagaggcgctgaggcagcaccctttgtgggccggggacagccagccaccgtccggaccggaggacaggtgcccgcccggctggggaggcggcctaagccacagcagcagcggtcgccatcttggtccgagacctgccgaacttaggaaattagtctgaacaggtgagagggtgcgccagagaacctgacagcttctggaacaggcagaagcacagaggcgctgaggcagcaccctgtgtgggccggggacagccggccaccttccggaccggaggacaggtgcccacccggctggggaggcggcctaagccacagcagcagcggtcgccatcttggtccgggacccgccgaacttaggaaattagtctgaacaggtgagagggtgcgccagagaacctgacagcctctggaacaggcagaagcacagaggggctgaggcagcaccctgtgtgggccggggacagccggccaccttccggatcggaggacaggtgcccgcccggctggggaggcgacctaagccacagcagcagcggtcgccatcttggtcccgggactccaaggaacttaggaatttagtctgcttaggtgagagtctgtaccacctgggaactgccaaagcaacacactgtctgagaaaggtcctgttttgggccttcttcttcggccaggaggaggtccaaatacaagatatctgcgcaccttccctgtaagagagcttgccagcagagagtgctctgagcactgaaactcagaggagagaatctgtctcccaggtctgctgatagacggtaacagaatcaccagaagaacaatctctaaacagagtcaactataactactaactccagagattaccagatggcgaaaggtaaacggaggaatcttactaacaggaaccaagaccactcaccatcaccagaacccagcacacccacttcgcccagtccagggaaccccaacacacctgagaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcaaagcgaggcaacactagagatagaaaccctaggaaagaaatctggaaccatagatttgagcatcagcaacagaatacaagagatggaagagagaatctcaggtgcagaagattccatagagaacatcggcacaacaatcaaagaaaatggaaaatgcaaaaagatcctaactcaatatatccaggaaatccaggacacaataagaagaccaaacgtacggataataggagtggatgagaatgaagattttcaactcaaaggtccagcaaacatcttcaacaaaattattgaagaaaacttcccaaatctaaagaatgagatgcatatgaacatacaagaagcctacagaactccaaatagactggaccagaaaagaaattcctcccgacacataataatcagaacatcaaatgcactaaataaagatagaatactaaaagcagtaagggaaaaaggtcaagtaacatataaaggcaagcctatcagaattacaccagatttttcaccagagactatgaaagccagaagagcctggacagatgttatacagacactaagagaacacaaattccagcccaggctactatacccagccaaactctcaattatcatagagggagaaaccaaagtattccacgacaaaaccaaattcacgcattatctctccacgaatccagcccttcaaaggataataacagaaaaaaaccaatacaagaacgggaacaacgccctagaaaaaacaagaaggtaatccctcaacaaacctaaaagaagacagccacaagaacagaatgccacctttaacaactaaaataacaggaagcaacaattacttttccttaatatctcttaacatcaatggtctcaactcgccaataaaaagacatagactaacaaactggctacacaaacaagacccaacattttgctgcttacaggaaactcatctcagagaaaaagatagacactacctcagaatgaaaggctggaaaacaattttccaagcaaatggtatgaagaaacaagcaggagtagccatcctaatatctgataagattgacttccaacccaaagtcatcaaaaaagacaaggagggacacttcattctcatcaaaggtaaaatcctccaagaggaactctcaattctgaatatctatgctccaaatacaagagcagccacattcactaaagaaactttagtaaagctcaaagcacacattgcgcctcacacaataatagtgggagacttcaacacaccactttcaccaatggacagatcatggaaacagaaactaaacagggacacactgaaactaacagaagtgatgaaacaaatggatctgacagatatctacagaacattttatcctaaaacaaaaggatataccttcttctcagcacctcatggtaccttctccaaaattgaccacataataggtcacaaatcaggcctcaacagattcaaaaatattgaaattgtcccatgtatcctatcagatcaccatgcactaaggctgatcttcaataacaaaataaataacagaaagccaacattcacatggaaactgaacaacactcttctcaatgataccttggtcaaggaaggaataaagaaagaaattaaagactttttagagtttaatgaaaatgaagccacaacgtacccaaacctttgggacacaatgaaagcatttctaagagggaaactcatagctatgagtgccttcaagaaaaaacgggagagagcacatactagcagcttgacaacacatctaaaagctctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacacaatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaattccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaattcttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttctggaaagatcaggaattcaaggccaatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcacttttttgcagatgatatgatagtatatataagtgaccctaaaaattccaacagagaactcctaaacctgataaacagcttcggtgaagtagctggatataaaattaactcaaacaagtcaatggcctttctctacacaaagaataaacaggctgagaaagaaattagggaaacaacacccttctcaatagccacaaataatataaaatatctcggcgtgactctaacaaaggaagtgaaagatctgtatgataaaaacttcaagtccctgaagaaagaaattaaagaagatctcagaagatggaaagatctcccatgctcatggattggcaggaccaacattgtaaaaatggctatcttgccaaaagcaatctacagattcaatgcaatccccattaaaattccaactcaattcttcaacgaattagaaggagcaatttgcaaattcatctggaataacaaaaaaccgaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacaccatgcccctccttagaagtgggaacaaaacacccatggaaggagttacagaaacaaagtatggagctgagatgaaaggatggaccatgtagagactgccatatccagggatccaccccataatcagcttacaaatgctgacaccattgcatacactagcaagattttactgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaaaatgaaaaaaaaaaaaaaaaaaaaaaaaagaagcacaaggaattctgtagggtcatctggtggtgcgtgacttctgtgttcttcagatgactaaagctacacatctcaaatgaataaatttcattctttgtactttaaaaaaaaaaaacaattgtagaatttttaaattatatgagatgaggaagataaagagagatagaaaggaaccctgataatcactttcaaataagctaaatataccacaccatgactgttctgtttaggtccagggatgaataagaaggcaagcaatgggttaagcttcagaggtcatttaaaagatatgttgcacaaacatggccaattttctctctggcgttatcaaacactgaataaattggtggaatatactgactctgctctaatttccgcctacagacaaatgtctgattcaggatttgcaagtcactgcttcacttagttaataaaatgacatcttgcttcattaatatcaagttagaaaaatatgcatttggttctacatacataaaaggtcagtgcttaagaaaattatgaggttaactaactgtgttacctaccccctctataacctttccttttatcgacttctctgttacttgtttacctagtctttcccacagtacagcatctctatgcctgccctccctgtcgggaataaaaccacatctttgcctacccttcctccacaccttcacaaatcttcatgtcctgcattttgttcccgttgattaatagtctttctctgctaatgacaacacctcagctcaccaatttattcatgccaatttatatggttactaatgacttcgtgtatccaggagaagagaaatttctattcaggcaaggaacttctatagaaatagaaccttaatccaaaaatggttttctttttattattatcgcctttaattggcacacattagttatacatattcatgagatacaatgtgatattttgatacatgtatacattgcgtagtgatcaaaatcagggtaattagcatatgggtcacatcatctatttatcatttctttatagcaaacacactcacaaaatccccttgtggttattttttgaagcatgcagaatgctgttaactatactcatgtttctgggcaacaggatactaaagcccatttcttccttctaaatataactgtacccattgaccaacttctatccatcttttgtccctcagtctctggtaaccaccattctactctccacttttataagtcaactttaatctccagctctcgggtaccaggaatccaattcgggaggttacgtacatacactgattcctctgcatagaagattctaaaaccattccaagaaaatggccacatctttcagttattacacacatggggggggtatatgtgaaagtgttctaaatagtaacacaatctcctccacaatagtgacttacctgagaactgaagccaggctttcttgagtacatgaagccactccttggcttcaatgagcagaccccatggagatgaaagaacctggcctagctgtgagcttagataatgagataatagtctgggtggcctttgagacaactagtggaaaccttctttccagcattcaataaactcctgctgtctccccttctgaatttgaaactccctacccggttctcaagtaagtctctgaaagtcaatagccctttaagagacattgttatcttctttgaaaggttgtgatagaaacagagaaacctataggaattattcttttggtcaacatcaaactgttgagatttctctagcattagaagctagctcagttgtcctagctcagttttaaaagaagcacagttggtctctgactttgacaaattgacaatcctattgtggaaaaaaaaattgaaaccaactgttgccatccctactggtgacatttgcattcatttcagcatggaccatgaaggaaaaaaaaatagagtttctcagagagctgcggtgttggggaactttgagcaggtccttgaggtcttaaggagtaaggagatcccccaagttaaggagggagggagggagggagggagggagggagggggctttcctggggggattatgaatgcttccagcttggttgggttttaattctcctgagatgggcagaagcttcctgttctcacacctgtcagcatgctgacttccacactgtctacaagtcttaacttcatagtgctcttttaccaaataaagcccagattctctctcttccacatctttactgcatttctcttatttttcttcttcttcttcttcttcttcttcttcttcttcttcttcttcttcttcttcttcttcttcttcttcttcttcttcttctcctccttcttcttctcctcctcctcctccttctcctcctcctcctctttctccttcttatttcttcctcttcacaaacatacacacagacttacacagagacagacatacaaagagataaatctgtaattctcatgttagtgtgtgtgtgtgtgtgtgtgtgtgtgtgtgtgtgcgctcgcgcgtgcgcgtgcacgcatgaatgcagtgcaaaagaatttatgctaggcaaacttctaccacttaggtctgtgcccatatctcgaaaatgttttgtttaggaaaggtcacattaagttgtccaggctggttttcaattttctctgtagcagctcagatagaccctgaacttgcaatcctgctccatcgtcttcagtagctgggattactgacctgtgcactcatgctggggtatatcatattttaaaaataagagcagctgctatttcttaagtatttaacatatatactaggtcttgagtttatagattatcacattttatcatggtagcatttatatacttctacacctgatggaaccaaggcagaaaaaaaaatcaaataatggttcttagacttatacaacatcaaagtaaggagagaaaaagtcacgtatcaccctaggtctgccacattttacagactatatgctttgctctggctagcatactgcttcccactgtctaaacatttaaaggcagcaagtaccccttccttcaattttctatagcagttcttcaaaggacactgtacttagacctccatacttcaattgtatctgtgtagatgcaatccagttctcaatttacttcttatattatagtgatcacaaataagtacaatatcttttttggcacaagaataccagggatcaacataaacagatggtcatagacccaagttcaagggcagatgagtcaaaacgatggaagcagagaaaggacaatattgttgatgcaggcagaatgcaggtttggaatgaacagctgtggtgaggcatgcatttaaagcaaagagaactcacacatccctctctgtggctaagatagtttctggaactcagaaaaacaagaatctaaaagttcatactgccaaggggctatatgcctagttgtgtcaaaaagcaaggaatgaccaacggtggattataccaaagattatctttccagccaagtgctgtgagtagcaggtgcctccatcaaaacaaatgctgttgctttgttttgctttgtcttgtctttttctcacccacttcaagatttaatgaaaggatatacgaaggtgacagatggctccaattctagtcatgtccatttgccttctgggaaaagtgaagtcaagagtgtttttattgaaatttaagttacttttttatatttgaataaattaggaaggcctggagagtacattatcctgtgagagacagatactaaattcccctgtttgagcagcagtaatcagggttgacaggacctaagacagttggtagtttttgcagcctgcttaatctattgtgatgagtcttcaactatgagagcatctcgagagcctgtacaataataccagtgaatgaatatttggactgggttgtgaataaaagactgtgcatatgtctataatgagggtttcattgaaaatgaaaatactgaagctgtcatatttttaatacttcgatttgcacatccttgactgctttggggcataaaaagagaaagtgccgagcaatttgttgtcagctcttgaaataaattatcatttaaacacttcctctccacagaggttattagcttagtagctccttcattcctggggttggactatcagtagggggagaataaaaaaaatcataagacattaaagtatcctttcaaaagctggatattagttactgtggaaattgttctcttagtagcttaacatacttttgctgtagctctccaatgctgcagattaggctgcagcaactattaataaatactgtcatattttacagctgtcatgcaaagctgaaaaaaggcttcgctgtgattagatcctgtttactgtaatatttccagctcagactcagaaaggcagttttcccataaaggtatttccataagtagaatatttttccattaaatgacacgactaattttaatatagtgttaactccttgatcacagtgaatttgaggtcaaattgatttcacagccagaggaacgttcatctccaaagacacattaaaccaaaccatcgaattttctctcttgggttgtccttcctgtgtggagatggtactcctgtcacaaatgtgctttgaatagccccctccctcttagaaggagaagtctatagagccctgcttgatttcttttcctctgccttcctgtgcccgactgaactgtttgcaagacagctattcagggtttaggataggggtgccttcagtaggctaactagaattgtgttttctgtccgagaatgtcattattgcagcaaaagaaatcaatcttttttttttctcaccacaccaccatcatgctttagcatgatgtttagaactgtatttgcatctttagggaaagaaggtgacagctggcagagttgctcttttgctctgaccttccattgctttcattaagttccttgaggaattaaccctcagtgagctgaatatctggttcttaataaataaatgttcctcatagtattaggggctagctgcaatttgctactatttctaggtttgagcctgattgattgttgaaaaggagacagattgtgtagtaatcttgcaactgtgactttaaggtttgtctcttggaaccctatagacatcaattcaagtgagggtaaagtatgtgaattgcaaaatacagtgtatatagtctttagtatcaagctaaacagagtaacatgtccaattaattttagttcttgtgattttattatactttcaaaacgttacccctcattggagggagaaacaaattctgatccctcaggggacatatgacaatatatatacaaattttagtagtatggaaaaggaatactgttaaacatcctgaagcgtacaaagacagcatcctctcccccagcatggaagtatctgctacaaaacgttggttgtaggaagacactattgagtcaatggactggtttctggaactcttcaagagaccggttatgaaccaatataccagtaattgagagtttcattttatctatgttgtcattaacaacaaagttcaatatccactagtctttaattatgaatagtttacatcattgacaaagagatgagttaggagtaatgcacatgaaacaagtatgaactagcacaaggcaagagctatattgtgtggaatgaatttcaagccccaagggatactaaagaagagagagttgctgatggacaggctagagctatcagggaaggcttcatggaagaagctatatttctgagccctcaatggaactgcttcacctagaaccaaaacaacatggtgtttccatcaatgctctccaacatcagagatcaggacaagatgtacaattaaaaaaatgaaaagagagcacagtgccttttacaaaacagaaaacaattacagagctgttgaaaatgggcaataaacaaagaacgggagggcgctactggcaaaattccattttctcaactaatgctccagcaagagtgcaatttccagcaaaatcaacagagctctctccccttgtctatcagtcaaatgcattgtttgctagcaccatggctgcacaggatgcctcaactgaaaaaaaaatttaaagagcaatacagaatatgatatgccaaggaatgggggcagtgggggcacgttagcatggagcccagcttgtccattccgaaaattgtctgtggagcagacaaagaagaagaagaagggactcaaatagtaaaaagtaaagactactttacttccccattttcagggatccattccaatcaataagttgccagtgtcagttttgtcgactccacaaaggatctgatgaattctctggtgctaactgcctcagcgggctttctcagcagtagaagggaggctaattaagatcatgtcaggcaagaaggctgacaggttaggttcctgggccacattgaacttttagaaggtgttgtttcaacttcactgccgacaggcagcatttggctaggcactgatttcatagtaggtctccagttcacttccacaggtccttgcatcaacaggcctccgttttgttaaggacttacatccttctccttggggtaattaagcgccagtgtgtttgctttcaattgcattactctggctctctttcatttgaatttttaatatgcttgtaaacaaagacaacaattaatagtctggtcattttccctactaaatcatgtgtttgtgtgctgagtgtcttaccaacatacagcatctagaggtgagcttaggacaaataaaggtagctccgcatctcacagaaggtagaaaatgggagaggcatatggaactcattataccaagttgtagcttagactgaaaatataaatagcttcccctcccccaaataaaggtttccattatttcacagataacggatctacagtgagttattaagaacaagagagatatttggagggttttttgaactaaggatttcacaaattacatagtagattgttttttgagcccatatttatattctcataggcatacaatcatatgcaatgctggcactataacccctaagatttaacgttaggagtatatcattcatctcggctgtataaaggaaaggaaaggctcagaaatagatacatgttatccaggaacattctgtctcctctcacataatcagggtttctaaccactgtcaaaagataaacacagctggacacccgacacttgagcagattttagtcagtaacatagtattgcaataagggaaggattcagcataaactgaagtcatcttcaattcttacaaaagttcctgggtacttgagagaaaacgtgagtaactgggagaatgtgagtagctgtcctcaattaccgtgtatgtgaaagatccaaataactaagaaagcttgctccacagcaaacccatgcagttttgttaagcagtacctactgaactcagcctccggctatctaatagagactgggccacataggcattatacttaggtattgactagatcaaatactaaattcatttttcaaccttgaatttctcaaacagacattttagaatgggctatgatcaccatggaatgtggccttgaactgttggaaaatatgtctgagttttgctcaagttctactaggccaagcttgagacctcctcaagtagaggtcttagaggagcctgagcagagtttaattaaggacagaatctttgtagccacacaccaagaacaccctgttctaagggatgagtggtccagttagaggcatggagagaatgactcatcaaaccggaactctggttcgaagcccatctctgtcttaaaatatcaaattcaagttgcatgtccttttgagcccccagtttctacatctgtagaatgaaggatgaattctgacattctgcaattaaaattgtccatcagtgcagggttatataagtgaaggaaacagggtgcctcttcataataaactcacagtttagaaagacatcccagatatgtaaaccaatagaatctaacacaaatgttaagtgatgtaaaattctggaagctattatagcatgtcttttcaaatgactattcttcctgggggttgaatacgcaaataactatctacattgactcctttaactagtcagagactacttaaggcatccaaatgtttcctatttggtcatctcttagtggtcttaaaacatagtctcacagtcattttcaatatctatgtttcctgtatatgaaagaaatatctcttagtagaaattatacaagaatttctataataagaggtgaagaagctttgttgcttgaacatatcatttcccaaagattcaaatgcctcactaagcagaagagttaaaaattcatctgagttttacagaggctatgacccattctcagttctggatctctgcatttaatttcccctcaaccatttatcttgatgctctatctagacttctttttccccagaaaacccttctgttccatgtactttttttcagaaatcctatctttgagtcttttagattcattttaggcatttgaatgtttttgactagatgcatatatgtgtactatgcgcctagtgtctaaggatctcagagccctttgaactagagttatggatgattgtgggacaccctgtgggtgctgatactcaacctgtgtcctctgagagaatgactgctcttaattactgagtcatttctacagccttgaaatctcgtctttgaatgttccactagcatccttcacattccaccaccatgaactctacactagtactctataattgtgagcgtttcaatgtgccacatggaagacaccctttatggctttagtctcttgcatgtagcatttgctttctgtcatttatattccttactcgatttccatccaaaacacacacacacacacacgcacacacacacacacacacacacacacacatgtatgcacacatgcacataatgaacatatacacatctatataaaaatctggaaaatatcttatccttcaaagtcctgctcaaatagtagtccctgcttactgccctctgccctcctagttatttgcctatacttctagcacagcattaaacataaaaaggtattattattaatattagtagtatttatttgtttacgtgcttatcttctgaacaataccaccagcttattgaggatggggttgctgacttgttcatctctgcaagtgctatattaactgctgagtaaatcatagtgattgattgttactattcagcaaatgaatgagggaatgaaataaccttagctataaacaagatgcagaattacataggctttggagatataatgaaggtcattgacatgtgcttaccatacagtttgaatagaacatgttctcagatcatgcgttggatagttgtgtgcctcctgtatactagcctaaacatgattttgagtcttcctgtgacccaacctccgtaccaaatatatcacattcctacaccaactgagaagcaacacagatatttgaatgctagcgatcatagttagaggctctaggtaatggacagattttcaaaactcttcatggttcctgaacctcagccaagccaatacaatccattcattgaggactctcaagggctaggatgtagctgttgcactacttcattacaaacttcatgaattctctgaatatgggagtaaaatgatattaatctccacagatccaactataaaactaaagaaagaaaattactttaaaatgtttgtgtaggtaatgctacaaacacaaaatagtgacgtgagagccaatatagtccattcttggttatccacacaagaggcaagccagacgatgatcatctaaagggcattttttgtcagaataaaagagtgtcttgtaaaaacagatattccctttggattccaacatagtttgattttcctgagtatggaaagtaaaaaagatagtccaacaaaagggattttttaggatgtctctttgattataaattccccatgtatagaaaataccatcctgattgagtaacaggatgtataggatacaaaatcatggtctatgaaaccagaattaggagaagtaaacacaaaaatgaggtagtatcaaaatctcaaaagaaagagaaaaaaaaaaaacacaaagaaatgctgcacagtactgtacctgaaagcatattggctaaggaatacaaataaggaacaaagataacgagcaataaacacttgtaagcttgataatttttgcagagaagatttgatataagacattctactccctaagaaatttgaattctgtcaactgtaaacttcccagttcccccaagcagagggccgacatattccacagatgcactttatgctactgaaaggctgagccaaggctcgcaaagattaatcaggttgctttcttggaaagctctcagcaggagcatgtacttcctgaatatccgaagaagtgttgcttgtttccactggacacagatcatagaggggaacaggatagtactatttactaaggctacccattctttcatagttttttatgcctttcaatagcaaaaaggagtcatgatttatcgacaagcgggaaattttcaaaagaaggaactacagctttattaagtgactttttatccacctagcacagagtgaaatagtaacattaaaaattttattagacccattaagctggaaaggctttgaaagttcttaggtctgaagtttgggattctaaaaaatgaatcagctccatattttgtcatgttcacgagtctcttaatctgtaattctacttaaaaagtattattcttttaaaaaatctaaaggctattcccagatctatcacattgagccttttgatcctgtttcaactattttatctgcataatgatagttatatatgtgcagtgtatgtatatatatatatatatatatatatatatatatcttatatatataagaatgacatgatgtaagctaaaatcaaatgctgagtataagcaggccatttcctaagctaaaataacagctctgtagatgagtggttagggtctgagaaaggctcatccttttgtgtccccagaatctaaaatcctctttgtaaggttctacctaatcaaattgaaagagttagcaagtgcaccttcccgtgttcttcaagcattcacctacactggtaatccaactagttctattcatctcttctgttgattagcaagtcaacaagatagtgcatcaaatagaaaaaaacctacaaatgattaccaagcaagtcattcctatagtaaacatctcgggccacatcatggctgctaagaaaagccacagacactaggccatacattgcatgtgtgcttactcaccttcaaaatggatgccataattgtccctaactcataggattgctacactggttacacatataaaagatacctaggtcagttcctggcccaaagcatctgtaattgttagccattgttatgaagggcttaacagggctataggcaagtgatgctgccctagtcttggattatagtgccatgatgcccatcctttcattgtgctaattttgattctactctatcagaatcagaacgtgttcccatgaaaagaggttggaaacacacagtaaatggaagaaatggctaatagacaatgggctcagacatgacatttctgtaagtgcagagagcctcagccccccccaaaaggaagccctgtttgggggatggctagactggtgatcaggaagtaaggcttgttttcttcctgttgtcctgacttcatagccaaccttccatctgttcctcatatgactaattgtaaatctattgattaaaaaataatattgttagaaaagcttggaacaaagcttttttgagggtttactcagtatatatttaatagaataatagagtagaaatggcattctcttcatttatatccaatagaaatgtttaaaggtaacttaacctgagcagataacttctttacaaagtactaaagtcactgacacgatccaaaatatacatatgcattccttcttaactaagctgtcacagctcagtgtgtgtgttttctgattttttatatttacttattcactttacatcactatcatggccccctgcccctcctcttctcccagtcccaaccttacaagtccctcctcccataaccctctacctttctcctcagagaaaggggatcccaccccccttgagtaccactccaccctaagacatccagttgctgcaggactaagtgcatcctctcccactgaagcccaaccaggcagtctaggaaggggaataggatcgaatagcaggcagcagagtcagaggcagcctccactccagttgttaaggggccagcatgaggaccaagctgcacatccgctatgaatgtgtaggggccctaggttcagcccctgcatgctcgttggtcgatagttcggtctctgtgagctcccatgggcccagactagttgactttgtaagtcttcttgtgttatccttgacccctctggcttgttcaattctatcccccactttttcataaaatgcaccacatgatgtttagctgtgggtctgtgcatctgtttccatcaatagctggatgaagcctctcaggagacaattatgctagactcttgtttgcaagcagagcaaaatatcattaatagttttggggattggttcccttacatgggctgtgtctcaaattgggccagtcattggttggccattccctcaatctctgctctatctttatctcagtatcttgtaggtaggacaaattttgggttgaagttttctgacatatttttaaatcttcctagactatagtacataataaaccctagaaattagaagcaaagctcagtttgcagtcttgcatttgtttggcttaagctgctgcatttaaattagaaagatagacaggtgtggtggtatttaatcccagcactcagcaccagaggcaagcatatttctgtgagtttgaggccagcctagattacagaaagagatccaagacatccagggctgttacacacagaaactctgtatccaaaaaaaaaaaaaaaaaaaaaaaatcaattaaaagaaaattaggaggaaataaattagaatgtagttccaagttcccttccggattctccctgtgactacagatcaaaccctgaagtcattgccaaacagctgcatggacacagtcatccggctgtattaacctgaggggggaatataatttgaaatcaaagaacagatattagagaacatgtaggatatcattttgtagaagataaaaagtggattattttgtggtttaaagtgaacagatacaaagatgtgttattgcataccttcattaataaccctcaaagatctgaagccagtgtcctccagactatagcttctctcacttgtttttattttattctgtttatctgagcctgggttcttgctctgcagaccagggtcattttctattcacaatctttctgcctcagcctcctgagtgctaggattacaagtgactaccattatgcctggactattcctaccaagcagattttctgaaatctacagtctactagccatcttttcttaatgccgagatgagacaatgggtctggtaatagcttctttttttctctaaggcaaatcttacaattcggttttcgtggtggcatacatcagctagctatatgatattgagctacaaacctctttgtgtatctgtaaaattgaaatgtttattagtatctacttcattgagctgctataaaaattaaataagatactatgaacatgattagcagagtatctgattaaaagaaatatgctcaataagtggtagctatattgcttatgataatgcttaaacttctttaaaggcaccaatattaaactactattactataatcaccaaccatattcataaataaaaagaaggaagacacacaaaattggggctgtcactgaacattctaggtgttttatcactatatctatatgtgcaacttcctctcagtttaacaaacgaagaaatggggaaaatataaaaataggaaacaaaggcaacattcttcaccctataattccccatagcctctaataaactacttgaagctttggggatctgatttctattcttagcatgtatatattttgctctctgtgtgttccaacacagaattagcaaaatatttccatacatatttactctcataacctcacccaatatgtaactttgataccaagaaatggtttaatgtgagtctactgaaagggaagaacattcagttattctaattaatactgttcaaaagaaaacctaccgttctaaatacttcaaggtactgtccccatgtattgttggtttggaaatgaaataaatctatgttcccaaagaagagaatggtttgcccaaggttatacagctaataaaaaagtaaaagcaagctggactagagcccaaactttcagacatcctttcgagaaatcgttcttctccatcagactgctacatacctttaaggcaagggcttattttcttaaggactatgaaagattccagctttaggggaaagtctgagtgctaatgaataactagttcctcagactagtatctaccctggatggaacactttttatgtgccaggctctgcagtaagcctccaaaatgtatcacctccttcgatcttcagagtagttttagcagagactgactgccatggtccttcttttacagatgagacagtagaggcacggaaaggttaagcgatttgctctcccatcactcttggaggaagtggtggagctagcggtgtgcattctgcctcctcttctgtttaaaatgttcttcctagcactccacactgacagccaccttcagctctcctattcacaaggaagaggtgttatttttaaagctgctttgaggcagaaagataagtggtactctctcagttcctcatactgatagaagagagaggtacacaaagaaagcacatcttgcctaatatgaaaggcagaaatttgcaactctgaaggagatgtggagtctagtagagaggacttggtaggggaacattctctctcctcactctccggtcggtcgctagtcacagctggttcttaaccaaattgaaatgtgaaatcacagttgccaatttttagctttttcccactcctaagattctagccacattcctacttaacccacatccatcacccaaactgccctgtttccttttatcaagaactctatcagacagctggagccacatccaatgcttatagctaaggagcacaatggcccccattttagtgttattgcctttctttttttttaattagatattttctttatttacgtttcaaatgttatcccctttcttaagaagtacctggctgctcttccagaaaattcaagtttggttcctatgatccctatggtggctaacaatccactgtaactcctgtgtgtggtactctgatataaatgcaggtaaaacacccacatacataaaatatcaaaaaaaattgtaaaagaagtcccttctaggctgttacctttaagcatctgaagaagaagcagggccagttagacgagaaccagccagggaagtgttgtcatagctaactcactaattattgaagtcgaccattttcattttcttgccttcatatatcttccccctgaggatacaaatcggtgcaaatcatcctaaagacaggaaaggtgaagctctaagtgaacacttagactgggaaagggaaaaatcagtccattattttaagatctcttgagatgctgtaaatacacaggcaactcagaacaaagatcccttttttcccccttacattatttatgggccatctaaaaattacattcccgttctctttccagcactgagagagaaacatgcatattcatgatctgataaatatttaagtgggatttatttaaatgagagagaccatttacaaacattccctggctctcagatcttatcctgggcacacagagggaggataaatcccactggtagattcaaaacctccgctggccacctgtccccccaaacttggagcttttccttgagaactggtgaatgccacccgcaatattttaagggagccttgtgcaccagctccctccagtcctgccttccttcctgttgtgagtcctgcttccatgtcttagcatccatcattagcaaaattctgtggctggaagtttatatgggggcagcaagtctggtcacagctttctttgcctgtacttttccttatacaatcctcaagtcctacagcaacacccaccactaatagtcactctgcctatggatgtatctcttcatactccaggaagatagttataagacatacctggtaacttagactagttgtctattaagcaagcattttgacattttggaagcatttcagaggtagactagcaaaatggatcagcaggtaaacacgcttgctgtcaaactcgatgacctgggatctatccctatcacccatggtggaggagagaactgacacctgagtgttgtcctctgccctccacacatgtgtcatggtatggaaacacctgaaattatacatacacatacacaataacacatgtgcacacaaataatacatttttaagaattatttatttaaaatttattaaatattaattatataacatttaaatatttttaaataaagcaaagaaaaatacatgttttgttattaccctgtttcccaaggattttatacataccatgctttcatgacctcctcacaactgagttaccaagcatgttgacatacctcacatatcattactaggcagggtctcaagtggagggattgaggcaccaacccagacacaaaacctttgatctacagagtgttctaggactggaatctgacagaattgtcatcagagggaccagagaggcttcatccaacaacagatgggagcagatgcagagtcctacagccaaacattaggcagagctcagggagtcctgcagagaggaaagttcagaggaaccagaggggtcagggacaccaggaaaacacaaaatcaactgactgggattcatggggtttcacagagatcaggggtccttagctgtctgacctaggttttccacatatatgttatggctaaatagcttagtgttcttatgggactcctaacactgggagcaggggccatctctgacttttttgcctgcttgtgggcccttttgctcctgctgccttgcctcatccactgtgaatgtgatagtatgtgcctggtcttactgtagctcattgtgccctgttgggctgatgtccctgggaggcatgctgttgttaaagaggaggcaaagaggattgtatatgggggacagaggaggtggagaagatagattggaaagaaaaggatgggaaactgcagtctggatgtaatacatgagaggtgaataaaatttttaaaaagtagtacatgaaacaataaaaaaatgagtcatttttccagtctgaaagattaaaacaaacaaaaaaaaatatcaggaagatgttgtttgcccaaaataaattttacagtttgtaagttgcagactagagacttgaacacgtgtctgactctaagatctgggatctcagactacctttgagagtgctgggagataaagcaatgataaccaaatggaaagccaatgctgatgtatggacagtttaaccacaggggtggagaagctattgtaaaagagatattctttgtatgagacaaggtctggattctccattccaatatccattcttaggtaccacctagatattgttgtagcacacagttccttctttcccaaaagaaaatttcatctattttgtgtctcatttccacagtttatccaataatcattgaactgacctactaaattagtctgggtagggaactgcttgcttgttaatatctcaagatgcaactcatcccaggtaatatatgtgttttgagagaagtttctaattgcctgatagagggacactgtacatagctaggactgcatgtaaggagccaggccagtgagagataaaactctgagtttctcaggttaactagtttgtactacctaagtgactatctaaactacctaatttagacttgccagattaaaatgtaggtgatccgtcaaaattttattttcagataaacaaaaaggcccattcttatgagtacaacctaaacagaaaggtcatacttaaactagaataccatcattttaagttcaaatttacttagctttgtctgttttgctactatatctggcaacccaaatttaattcaaagtcttattctaaggagaatcaccatccagaagtgactttgggtatctgtttgcttgggacacttgccagtgactaattccaaagcacagggctgagtgactgaaggctgtgagggaggaagagagaaaggacagaggaaaagatcacatggtaagagtggcccttatcgcctctataggacagaaaaggtaatgtcattaaagcattttacacaatagccttatctgcttcttaccaccaaccttcctgttggtgtgctgttttcctctaccatttgctgcccactgatagatgaaaaggcatgcagagtgccattgccaggctctgtgttctcagggagtgaactgggcctcagaagacacatcacaagcaagcagcaagacaggctgcaggctgcagccaaagcactgcacagacatcagagctgccaaaatgtaattaagcgccaagcacagaccccaagggtgatggtgggaagtgtttcatgaccaaaatacagagagagagagagggagagagggagagacagagacagagatagagaaagagaaagaagtacaagcatagatagatagatagatagatagatagatagatagatagatagatagatagaaagaaagaaatggagtgaagaatgcttataagcctaattaacaatttttacaacatcaaaatttaacatgttgccaatatcagattcatactacagaagccaagctgcacccaagggaagggagtattcaaaattcttcctacttgggctagtgcagtggatgaggcacctaccaagacgatgaaattgagaaaatgaccaaattagaatagcaaaagggggctggatcacatgcaagacaattaattacggaggctgaggagtttgaactccagaaatgaagccattgaatggtaatcataacggtgatgatcatgacggaaatagcagaccttactgagagctttgtatgtgcccggaactgcactctgtactttacacggcttgactcactttatcctgacaacaaccctgtgaggcttgtcaccaacattttatgaggtgcagaaagattacataacttgcctagagtcacgcatttattgaatgatgaatcagaaaattcaaatctaagcagtcaggcaccaaaggccatgtgcttaactactaggctctaccagtgctctaatctgatcttgtttgttcacttgcttctttgtcttttttgtctcagacagggttttgctaaactagcccctagctagctctgtagaccacgctaaccttgatctcaaggcagttctctgctttccaggtgctagaatctatctgttcttgaatagactttcccaaaatagttacaaagtcctttcaaacacttaagccttcttagcacaaggatacccacttgtcaaatgggcaaatgtacttttatgggcctagaacagaaggaggctttgggggccttctcagcctcaccatgctctcaatggattaacaaccactggtctcttgtcagtatagcagaattaagtttttattttcggctttgactttggtccttgtagagcaaactggagcatacatgtctggtggttctttgaatttcttgaagaatccttgagatcatgtgagtcttctgataccttagtctataacctctgagactcatagtaaatagcatcccatgtctatgaggctgttttcatttgtcctggtggaatcatttgttccttttagaccccaactctgcctttccaccattctatccaaaacatatctgtctcttccacaacaatataagaaagttggggctgaagataatttacatgtgtatgtatatgtatgtgtgtgtgtatgtatgtatgtatgtatgtatatatgtatacatacatacaaatacacacatatatggtggatagtttcataagatacacacaaatacttatcaaatgagtgaaggtattccaacttgtcatttttacacatgagaagacaaagtactcatcctaaagtcccacagtagttcattggctatggcttcacactcagcccggtgttccatctactctcagagaatgtatttctggagactctaaacgagtcttttccagtctttcatattccttttcttctaatacatatgcttttactccaagaacctcctggtcccatgcattcatggtttatttggaaaatgctgattcctcttcccacaatgtattcccttcccttgagatcacatgttttagaaattagacagcacaggaatggattattgctattcttgtagcaacttccattgggcaatgtttctgtagagacagaaatttcaacttctatgtctagtttgtcaagtccattgtgacatggtaactactagcttttcagcacaaagacaaaaaacagggaggaaaaaagtgtaactggagaaaggtgtgggagtctgaggatggaggccctgccatgctacagcaaaggagtctaaatcctattgtatacaatggattctgccccgaaatagagcctggtgcacattgataccaggcttaaacgtgcctttataagaaagcctgagagaaagattttaacatcacactagtgactgagtgctctccagaagtgacaagaaagattctggtgtgtacagaaaagacctgacctttgaaatggactcacagaatacatagtcacatccccactctgctaattatcagtcacaactttgctaattattagaaatgtaatgttcacactgctgcttagcgttattgagtttgcttgtctgtttgacaacaaagtcagtaatgctttttcttctgagttttgtgataagtatgataatgaggcaggtgagagaattgtctcagcataagcttgaacacacactcgaagtgattgcacagagcatatatagttcaaattctttgaaccgggtgacctctgaaggacctctaagctttgaagttcaagctttgacccacactaagtaaggtcagtggtcagtttcaaatacttaggaaggtccttacagcatgctgcaggtttcataactaagcagtgttttggtcatcatgaatagctctaatttctacaaaaagctgcctttgaaagatcccttcccaccaaacaatggatgctcccagaatcccatgcaacgatggatatttatttgtcttgtgaatatttattagtactccccctaaggtcccacaatagttcatgggctatggcttcacactcagctcggtgttccatctactatcagagaatgtatttctggagactctaaatgagtcttttccagtcttccatgttccttttcctctaatacatatgtaagtaatcatttaaaagaaccaaaggatttagggcttgggtattggctccaatgttgttcctctccacgtaattgctttacttcagggaaaaagaagatataaaacagctttcagattgaagttcagagatgtgggagatgaagaggacagagaggggctggtaaagggaaagagagatgggaggagaatattctgattcactcagatagcatcttgccaagccccggtagagtacagcaacctcttgtccttcccagtactttaatcctccaaagatttctctaagacccaggttttcttctacatcaacaatacatggagacctggcattccacctcatggctcaagaatttttcaaggccctgaagtatgtccttatattactgaaagggatacaattttgctcagcccggtgcaatattattatttatgttttgcttcatatttactccacggaaatcacaaagttctgtcaaaagcatactggtgtgctatttaatggatcaaggcactctatatcccactgggcccaaaactaaaactttgcaagactgcaggtgcatgtaactccatctttcaactgaaggaaaaacatcacccaggagatgaggagtttttcactttcacaaacaagtgtcataattccaaataataaagctccccgagcaaagcaatcatcgccagcttgattcccaaccagagtgcactcctgagttcatcttgaaaaaacaggccacggttgcggatgcccaaacccaagcaggtcttacagccctttcttctttgcactatgctttcactttatttcttgtgtaactgttgcccctacactgtacagaggatgctccatcctttctgtgaattttcagtcaagctgttgaatcaattccatggctaaaagccaaattaaaaacgcacacttctttttattaaaaagaaggcagctgaggattagtccatcaaaattctcaaggaatgaactgttctaattaagagtcttctaaaaaatgcttcagctgaaacaagaaggatgctgaaataattcagtaagttgggactaattttgacaattttttttctgttgtatcttgttctgtgatctgcacacaaaatactactgactcttgcatgggccttgagttactattttgaaaatgtgtatttccaaggttcaggattacaagtgaagggaggtatagctaaaacttgaactaaactcaggacacagcttggaaaaagtgtctaatttctgaagtttatagtttgttacttattttaataagccaatggcatggtgtgctagtcacttttctattactgtgataaaacaccatggcaagggcaatttcagaaggaagggtttatttggcttatgtttataggagcataagagtccatcatagcaggaaagggcagcaagcagcaagcatgagcaacatgaacagctgagagctcacatctctaaccaccagcaggaaactgaaaatagcctgggattgccatgatgcttgaaacctcaaaagtctacctcccttgacattatttctccagcaagatcacaactccacaacctacacaaacagcaccaacaactcagaaccaagtatttgacatctgagctatgggaaacaatctcattcaaaccaccacacatgaaaagggaacaatattgttaataaaggttctgattacataaaatgcaatacctctcacttcttcatacattttcatgactgatttcttgggagataaatttctgatttataaactgaggcagaaagatgccaaggaaattatccagtgatgatattagtcaagcttctgaaactccagtctactgattattctgtccaccacactgtgatatctatgtcacttcttcatttactagatttctattgacttcctctcaagcaggccatactggctaggctcagttaatctcaccacagtaggaattacatctgaatatgtactcagcgttagtagcactaagaatagcttaggtgaaagtcatgggtttgataataatggttgccataataatgtccttatgcaccccagttgagagccatttattttgcataatatgatctttgcatactaaatgctcgtttgcatcttttgaggacacttgtctatggcataattttttcagaaaggttctaatgtcttgcaacaatatactgatagacttctaaagaatattactttaaaaacagttgaatgtgtgttctgagattgtgtggcctttagataattaaaaagtagtaatcaccactgttttttatttgtttgtttatttatttattcactttacatcccattccttgaccccttcctcctgaccctccctcacacagtcctttcccccacatcttcctccccttctcctgtgagagggtggaggttccccctaggtatcacacacacacacacacacacacacacacacacacacacacacataccttggcacattaagtctctgcttggctaggcacatcttttcctactaagaccagacagggtagccttgtagaatgagctatacatctgctatatatgtgctgtggtattggtccagcccatctttggttgatggttcagactttgagagctaccaaaggtccattttagttgattctgttggtcttcttgtgaggttcctatccccaccagggcccttgatccttcccccaattcttccatgaggcttcacaaattcagtccaatgtatggattccactgtctttttgtttgtttgtttgtttgcttgcttgattgattgattgttttgggggggggtgataagctcctaaggtatttttattaggtatgtatttcatttacatttccaatgctatctcaaaagtctcccacatgctcctccacccactcctacttcttggccctggcgttcccctgtactgaggcatataaacttcgtcaggtgacagaagatgctggcgaggatgtggagaaagaggaacactcctccattgttggtgggattgcaagcttgtacaaccactctggaaatcagactggcagttcctcagtaaattgcacatagtactaccggaggatcccgcaatacctctcctgggcatatatccactattttttaaattactcttttaagttgataaagccaggaccctctttcagaaaaatgggtcctaaagttcccttatatcaccagggcaccttagcaggggccacacagtcctgttccctatggtatttaagaaagctcactcattgccagtatgccctagaagctctttacaaacctgctttcccaaattgatctttaacatactgaaaattgcccaccctgtcaaatttaaatgatcactataaagatcaactcgtacaattttatttctgggactgagggcattaagatctcagagactggaagctgcttcaatcaacaatttcatattcacctgctctgtagatagcagcatatccttggttagaagttgagttggcatagagacataaaaggtgcagaagacttcaattttggtaattttataaggtaatcacttatatagataagtatgtcttaaactctaacatacattagaaacatctggacaattggcttaaactcaaactctgcttcaataggtctagaggaagttccccaacaatctatattttcacaagtttccaggtagtgccaatgataattgtccaagtagtgtactttgaggcacagatattactgagaatctgtgactatctaaagatttaaaagaaagattgcagactgtgtacgggaggaaatcaaacaaaaggagctggatagtgttatctgtcctcctccccttctcctcccccccttccccttcattgcccacacagggtcatatgtccatgcttcgcagtcacagaagaaatctccctgatgcacggaaaacactcacattttcttaccacaattgcatatgctggagccatttcaaatggaaacatctgcttccttcctttctctagaactaaaaggggttctgttttggagtcagccagggacatcaaaaggggcccctctcttaccactttaaaaaatagtgtttctcagagtcacattcccagtggaacagtggttgaatcacttggtatattatgaggagtggacatgaaacggtcacacacacacacacacacacacacacacacacacacacacacacaatcagtttcctgaagtgacacctaagaatttaatttgaggtatgcccaattagataactcctcatataaggaaaaacaccttgagcaaggactctaaagatgatctcacttctctcatctgacctgtagttgccctttcctgcatttacatatcattaagcctcctgagactaggatagggaagcaggtttttccatccttcagtttcccacaggattcctcacctcaaccccaccccacgggaatctctgcctgggatatatctcaggtggttaaatcacatgattctaagtgcttaacaagttttacccaatagggaaaagatttgtatttaaaggatgcttttaatctagtttctctcggtgggttttgtttttgttttctggttggttggttggttggttggtttggtttggtttggtctttggtttgtttggggtttttttgttctgtttgtttcttgtttctttgttttatgactaatgcttctttacggcacagtggaggtacttcaaagccttcgaagctgttgatattctctagttctccatatcgatttttttatttaattttatttgtaattcattttttacactccatattccattccatgcccctccccatcctccctccgactgctccacatcccacacctcctccccaccccaccctgtctccacgtggatgcctccataccctatgccacctgacctctaaactccctggggcctccagtctcttgaggattaggtgcatcatctctgaatgaacacagacccaggagtcttgttctgtactgtatgtgtgttgggggcttcatatcagctggtgtatgctgtctgtttggtggtccggtgtttgtaagaccccaaagtttttatctttttaatattctaagagttccatggtgtgtgtgtgtgtgtgtgtgtgtgtgtgtgtgtgtgtgtgtgtgtattgaggcagagtattgctctgtagcccaattcactataaaaataactaaatagcccagattagctaagatatcatggcaacccatcagtcttaatcttgtaattgtggtgatattataatttatattgaaataatgagagagaattcaaaaatatggtgaggaaagtaattgaaagtgacattaattagaaagatggctagataccaagtttggaactccccccgcccccgcccatagcactaaacactgtctgttccattctcttcctgtatttctagagttggggaaagacttccagcttggagatgaaatgcagccttttcatgggttgacagctatgtctgcctgtattttcactttttcttttgttgtcaacttatggcaaatacatatattgtgtcccctgagatagtgactgcatatcatgtatgttctcattatgggcttctcagaataattctgcatatattgagtgcacaaagtaaacagaatttattgtgacacttctatatatgtagatcatatactccaatcatatcatcctcctctcttttcttcttccaaatctgttagcagccttccttttataacttgcatcagttagtgtaaatcatttctgtttttgtttgtctgtacctcatatgaaacccaatctggcactgcaataggtaagagtcattggactctgtagctggaaagagtgataagagatcacagtgcgcatggaaggtacggagggagagtaggaaaacaaactagttgagggttaaaggtaataggcagagaaacgagaagaagcaaaagaaaaacctacaaagaagacattggatattaaagtaattaaaactaacactaacaataaataacatttatataacatcacatgccttataaactgtgctggaagcacttcccacacataaattcatttaaatctttgcaataactttatgaattagatgcatcatcattattattgtactttatacacttcagacagtgaaggcccaggattgtttatattaacatacagagtaataggtttcctgatgacatacagcattcttactgatcttccccttccacttccctctctcatcctcttgtccctcccttgatccctaaagaaacacatagatttaagtcaaaattttgtatttgtaaagcagagccaatggaagaagaaagtgtgatcaccagacgtttactttacgtaagtcaataatccttttttttttccaagtcagtttaagccgggtttctgtctcctataaccaaaggagttctaagttaagtgaaatgttcaagttcacgtaatcttgacaactcaatgcattaggcactgctattattattcctggtttgaaaatgaagaaactggggcacggagaggttaagtaacttaccctgagtcatgcagctgataagtagcaaaattgtgagctgaactcctgcagcctgacttgagactctgtatatgtacagcaagtgtactaagtgtatttagtgaaaaaaaaatagagcatgccaccagtgaatagtggaaagcaaaggtaacttcattctaagaccatgctttaatgagtaacctggcaagcatatagctaccctttcatattttaaaggaatcaggaactacacaggttgagcgtttacttagaggttcctcttcaatgggaaaccagaatttctggttgtatgcagcttagactttccagcaaggaaccctctactgaaaccaaagctcgtgccaggacctcctgtatcctatggcactctcttccaggatggtggtgtaacacagtggtggatagtttgcctagattatacaaagcctgaagcttaatgttcatcacacacacacaatttttaaaggaagaaagtccctttgagacaggaaaaagaaattaagatgaagacgtctctgtcactagaactggaaatatttcttagaacagcaaaacagcagcatgagaccctgggaagtaccttactaagatgcacaaagccagcatcaattgagcaaagcctacttttgatccttacatgtctgcagcctctccccacagaggcccatagcatccttggaggctttcagacaatccctgtgagctctgtttcttccacaagtgtcctaccgttctaactgcagtagattcactgcagaaaaatgtgagaatgtttgtaatgtttttgttgttgttgttttaatgtgcagaaagcctgtctgctggggataaatgttggccaaagagtgatcatttatccatcagaaatcaagtggttaaagattacaaataagctttcattgattttaaaactattaagtggctcccctgataattctcagctgatttatattagtcagtcacaatttgtggatagataacattaaaaaatgttatgttaagtaattttatattaaaacaaaatcaggatgtacttcacttaagaagcaaagagtaatttttgtcagtctttgtgaatggctcttgtttcccattcattaaatgcttaacaattcttagagcttaaataattaaaagtataggagagatgtggagatttttaaaaaatcaatctttgcttgtagtgccattccaaaatatgtcctgcatggcatagtagatcttctctatacgactacttaataacaagcattctgcattttttataattatgtgtgctgccaacagtgtgtagttggatttattgtgcactgaagcccccagattgagagttatgtcttacacactctattataatgaatggcatggaagggttctttgtgtcacgggatgctgagttggatatttaaatagcatgccccagaaacgttctacattatggtgatgctgagagagggacattgtctaaagtacactgtgatttaagttgtgtggcccatagttgtaactgcagctcattgacaggggattaggatctataaaataggaagaaagaattgttccaataaaaccccagttgattagaaggacatttgggagaaatattaactggttctgattttttttttacatgcaggaagcaaatcatagtaaaacataattctcatagtattattttgttgtttttttagatgaaaagatctttatttcttagatgaagtcttatttaaacagcattataggatattaaatatgaactatgattaaagcacaatacatttaaagcatctatatccaatcatttctattttttcttttgttgtattcaaagttagtcatgacatatgccttgtgacaaaatctaaataaagaaataaagtgtatgtgtgcctgcatgtgtgtgtggtgtgtatatgtgtgtggtgtgtttgtgtgtagtgtattgagatgtgggggtgtgtatgtgatgtgtagggtatgtggtgtgtgtgaaaaaacaatacattcatttcctccaattcatttttaaagaaaactagtaaccaagaaaaaataatgcacactctggaattcatcttgttttaaaaaacctacacaaagaatatgactgacagaatttgaagaaaacgatctaatttcctgtgcctctattttgtctccatcctttatgatgttggaatgtatcactaagataagccatatgtgagtagaataaaacgtgtcctttctgtgacacacacaaaaaatattcaacaagcggagcaacatattgtattaaataaattatgatctcaacaaaaatcctaaaaatgtcaagataggattaattattattgggcacacatttaaatactttttccaactccctatatgtatgctggaaaacaaatgtcttctccctccattccaaggtgagagggaaatactaaaggtgtttaccaacatgcctagctcagatctttaattgttgagattataattgcaatatttctccctacccttttcaaaacaaccctggcctcttttttcactgttattgtatgcctatctctctctgtctctctgtctctgtctctgtctctgtctctgtctctctgtctctctgtctctctgtctctctgtctctctgtctctctctctctctctctctctctctgtgtgtgtgtgtgtgcgtgtgtgtgtgtggtgtgagtgtgtacctaaatataacctgttgagttcatataaatgtagttgtctatatgtctctaggggtgatgatttaatgctgtgtatgtgttctccctgggaaagcgcgcctcccctgctaccttagacaaagtctttggatctgaactttaacaactggtatgagtactttgtcaggcatagtggggtgagacaactctcccataatctcccaaccagatgaatgtaccagatgtatgtagaggacaatgtaagttgtatgttatctgatttctggcccaatgtccttgttactcaattgtgctatctatttcttgtgctcctctggttaatttactttgagaaaagcatatatttcttggatattgttctcttatagtatatgcattaatcttttttctttttctctctcctattcccgctactgccttatccaccccctacacacagatttgtatatatgttctggtctctggacactatgcaacacattcaaactctcagattatctaaacaggaggagaaacgtcatggtgtataccctctgaaattactttggcacaattatgccaatagtatgcaatagaaaagacagtgttaactacaaccagcaaaactaaataggcataattggcattactaatttgtgtacacaaataataattacaccactttccatccaaagttcaattaggacatgcaaagttctcatagtttactggatcagaaagtggaaaacttcaccaaagctaacaataaccacagtaatgtacagcctgcacctcagacatatctttacatcgttcgcagagactgtaagcacacagccatgcacgggatagtgtgcttaaggatagcttgctaaattagtgattgttttccagtagtccctcatttacatattattcctcacacaaataaaatgctggatttcactccacgcagcaatacataatcactgcttatcaaatgtagtcagtcacacgtctccaaaccataccagctataaagaagattctgatgttactagaatatatagcctggctactatggagtccataagacagaagcattgccaccatctggatacttttcagatgtagaactctaggccaacagaagtagagtccacatatacaaaattctcatgtgattcatgtataccctacaggagtatctgttcatcccatcgcacaatagcagcagtcacactgtatgctccagttcaaaaacatctcctatgcccctctgactctatagaaaatataagggaagaggcataatgatcgcctaggataatctataatctaatcccaaattgtgttatttctattgcaaataatgtaatcatagagaagatttgtaacttactgtgttattgatagaagactattgggacaagggatcattaataagctactagtcagtatttttggaatataggaaaaccagtaataataactaatatttatcaagtacttattgtttgccagtgcttgttacttggctttttttttttttttgcacataatccagtttagtttttcatgccaagtcaatgtgctaggtattatatagttgctaaatatggcagatggtctggctttaaatcttgtatttaatatttgctggctctgtgatcatagacaagatgttttagttgcatgtgccttagtttcttcacttataaaatagcatctcacaagcagtcacgagaactaaaggaattaatatgcataaaacagttatatgtagaattaatacacataaaacaggaacagtatatagtaagcatccaataaatgtctgaggttactatctacatgctattaatgaatacatttatacacagaagttgaaaaacttttccaaagtcacatagccagtgagtgggtagagacagaacacaaaatcttcttggtaagatacagaactcatgctattcaactctgaatttcatgatagaaaatctttctcctcactcatgccttatgtgatagaaatttgaactagacatatccttagagttttgtccttgtctatagcaccatacctctctatgggtttcaatttcctcctacatacaataatatcctcacccacaatcctcagactatagaaatgtggaagttagatgtaattgaaggcatttgacttactggtgtagatcactccttactttctgaggaccattacatgtctctgttactctagctgctctgagacactcttgtatgtctcaagagatgctaaggtcaacacaggcccatgccctctcttaacactgatatcattccttataaaccagaaagttccactgaaggtctttaatctcttgacaaggttaagaaaaaagctgtgaaaatagcttctgcaaaggtcatggctttcccttggctgttccaccctctgtctaaaccttaaaggaccagtgttcaatattagacacctacaataggatttcttttctatggcctaggtttctaaggattatttcatatccaggtttggaaccaaaaaaatttccctagtaacccttttacaatttttcactttcaagagtagcctattacttccaaggagtcatgaaaaattttatagataaaattaattttaatgcattcatattttattgtgctgtatcttataagactcttttgaaaaaaagaggcaggctgaaggaccaagaaagggtgttttctaagttcctgggcaagcacattaaatgtaagaattatttagattcacttttgatcaaccaaattataaaatcattcacttgtgttctgagcagtgttttggtccaggtaagatagctttttttctctaccaaggatcattcaaataaataaaagaccatgtccaggaaatatggtacctaggtttgaatgacagcatagtgtgcataggaaattatattaagaatgtataatttattcacaggacatctactgttagcaataaattctcagccattgatataaatcacattatttgtcacttaaacatccaaggaaacatgtacctagagaaatactatgatttcaaaactttcatcccttccctgaaatctccttgatgattcaagctttatattggcactcattgtaaataggttcaccctgcaacaaaatagcatttattggctgcaaggtcactactgtaatttctgacttccatacaccaagaatatactttaatttctttccctggcagggcttgctcactagtcccaaagacctagttttagcacaaaacccacggaaatgttactgaacttctgtgatgtgtcttcctagttttaagttcccaaataatgcttgtctgtttttatccattaatgtttttcatataatatattttgatcaagttcttacccatttcccaacatcttaccccaactatatttcatgttctctctctctctctctctctctctctctctctctctctctctctctctctcctccccctcctcctcctcctcctcctcctcctccttccctccctccttccctccctccctccctccctccctccctctcttcctccctctctgaaacaaaagtactgggcaggccccatgcctaatagtagttggccaacacaaaacaggcaccttgactttctggctttcgtttgttcttaagtttaaataaaccagaatctaatgagtcaaatgaccagaatgtctgttcatagtccaaaaagaaaaaaaaaagcatttactatgatccagcaacatcacagatttagtagaagtgagagtttccttggattgttccagggtcagtgtacacttggctgattgcctccaattttgacttctccagacctgatatattaatatctatgttgaaatgataatcctaagacactcaaagcttctcaggcaacaaaacaattatgtgctatttatctgatcatacttacgatgaaagaaaattggaggtatatgatttagagacacagtagcatttcaagaacaataaaataactacaaagagatttccatttagtaccgaagtgctcagcaaatggtctagatgttaccgtaagatctgtttctctgcctccctactcacatgcaatttcctgggtatgtcatatatcccatgcaaaataaaaatattagactaaactagatgatatctaaagtcttttataattctgatgtccaataattgtattgtctttgtaattccttgattgacatctgaatctataacactaaaactaatttgaacatagaatgcctcaaaggaaccataattcagtcactgtccttctatcatcgaaggatagggagcagttttagggttatctcaaaggctagggagcagtctcgggactattagcagaagttgactaagatgtttttcttaacctacctatgaaaggctacagaaaggcagtgaagtacatctttgagatgatgaggacttctcccatagaagatcaggatgcatttgacaagcatggggaagtggcttagagaatttaataaaggagtttggcagttgcttccaaagactacattgctctcaagatactttgaaattaaatttgtattaattgaaaagcaagaagagaactttagaatatatcagagagaaattacacagatgagtttacttgctgagaggtacaccacaggcagccctggcacttggcagcagtcttgacaagtaccttcatatttcctttgccagtaggttcaaatgtatttctataccctctctctccaaaatgtatctataactaaaatgccaaaaacaatctctaaaagctctataagtgttaaatatctctaaagactcaatttgttccccaagtagaggtagcccctggatgcttcctcccacaataaaagaaattttccagcatcttacctgaacctcatctattaaatgtaggacttagtgtggaaaaaaattactttcaaatcaattggatatcacctgacctgatttttgaacccacaccaacccaaacgcaaaggaaaactctgttactgattctgcctagtgaacagtgacatatctgttctggttacagaaaagaataatgtcaaaactagcaaaacaatagcagtgaacaaagcagccaagatatttttaaaaatctatagccaccttacagtgtctatatcacttctctatcccaacatatgaatctctacagatctaaaaaatacttcatattccaaaaataaataccaagatgttgtaagccttgtcttctgtatcatacttgcctggttatgtgcagtttcttcaatgtagtaccaatatgactgtgatgcatcgcctatttttcatgtccttatttttaaattaaggcctatttcgcatggcttgcttatatttaagcataatataaatacaggcggcagtataaaacaaatgcttaagtaaatgaattataaaatatccctaaaactactatcagtgaaaaagaatcttgctagttacctcagaagtcctttgtacattgtcaagcacagtttctttgtttattttggtgaagatatgtataacttaaaagcttcatcggttgtttgtgagcatggtatgtgagagagagagagagagagagagagagagagagagagagatttccaatttgtatgaaataagatctctcttgttcactgtaactgcacataccagcccaactggccagtgtggatatgaagattgtactgtctctgtccaccatctctccattggagtgcaggaatttaaggtgtatgcaatactatattggatttttatatgggttctggagatttgaatttaggtcatcaggcttgtgagacaaatgagccatctcccccacacatcaaatgctattatgaggccacaacatttctgtttatttcttacttctaaaatttgcattcacagttttggttgattgattgcttcatttttgtggtattaggggttgaactgacagccctgtggatgctaaacaagcactttgacactgacttataccccagcccttcccaatcagtgctaaagctgacaacaatcctgtctgccccagagaggattggaaggaagcaattgcacatgggcaagtattttgtataagcttaagagatggagatgaagagtgttgagagtcaaaggcaaaacatgcatgaaagttaagtgtaagaagctgggatcatctccgacttcctctagaaccttttcagctaaattaacatccccacatcatgtagatacattcaaatacaaaatataaaaagcttgtaaaatgaaatataagagaatttaaatgtatgcattattcagtactgtccataccctgaatttcctatccttcctgcaaataatcaaaagtaaatctcaagactgaatagataaaatggatagagaaggaaaggcaggaggaagcagggtttgatagtctgtctagtgaaacttcaactttctccagctttctgccaagaggcattgatgttaatgttcttggactattctgtatgaattaggcaaactgtcatagacccacagattaatcactcaacaatctaaggtctattttgaaagatggattttaagttctttccttattcatcccatggtatgtggataatttaaaagcataactgtctgactaattggccaatttgatcttcaatactgaaaaatcagtactttatcattacctaagactttatgtttccctatatcaccagaacacaaattgaacagatagcatgtataaaaatatcagccaggaagcagaacatgttattcttttgtcttgatcacattcttatccagtaggaagggagggggtaaatcagcatgagcaagcacctactgtatgacagagatatctcatctaaaacatgttttaaaaagagagctgggttgatctattctaggaataaatgtctcattggagaccacaaaggtgttgcctctgtggatcaagaaatgcagcaacaaaatattgagccagaaaatcccagtattccctatcaggaggagcatgctttgtaaaaaatataccatcacagccttagcaacctgaattaaaaaaaaatgtcgagaaactgtgagaatgctacacattttttgaaatgctcacaacagtagtagttccccaagctatgttgagccttcttggcatccaaaacaaaataggaaggtttggggttggaccaacccagttatcctgattgagctatgccccctgcctgctacttccagataaccctctgtctggctctggggtacagactgatcatacaccgtttcctgaaaaagaattcccctctgtcatgctccagggactttggcagaggactggagaggatgctttgtgattcctctggcattcaagtaactctctaatgcccaaagtgcagagcagagggaggtttgtccaaatgtctgacctaaaaggaccatggttttacttcttttctaattaggataattaacctcctctgtgcattcattttattccaatccaaatggctcaaattaaagtggcacaggggactttcaagctctggggacaggaaatactttataaatacctttaatattcatttcagccacaattatggcaaagccagaacaaagttggcatagcaacttcatccttgacacaatctggagcagtttgaaggccgctttcagaatattattgatgcaaatgtctcatcagctataaaactgtgtccttaccccataccattccctgactaaactggagtggaggttcggcagggaggatgcttgtaaaagatattatttctctttgtattttcatatgagtttttgtactttgtctaagaaagccaaaaaagttatatggcttataagtcggtagaaattgatataagattgacagaattttttctttcaaaataaccatggaagcccaaactttggaaggattctaaaaattggagtccagcagtatttcacataggacagaggtatgttgctggagttttttccctaggtggctttagttactcattctccacctctgagcaagtttgaaggatccctagcaggtatctacctccttcatgccacctatgaagagacaaataaatgaatacactccctctagattgtttgcctgttctacaagatgcaatctgcagatttgtctgcatacagcccttctacttgtacaggaagctgctatagtcaccagtctaactacagaccttgtgagtctccataaatgataaagacaacagaatagacaaaattaggatgtctgcttaaagtgcatacagaagtatctattttattctagcgatgctggaatttcctctgatatgccttggttgtagccttggactatccccagaagatgtgctacttggtatgctacaagttcaactgcatacatttctcaacatgctgttaaaaggctttttgtggacatattcaacaagctggccattctcaaaactttgccaatatatgacctggtttcctcttaacccatccttctgtaaacctttcatgcacctgaattacccatctatgttaactagctaacctgttgatttgagtaattatacagtagtgacaagaccattactactcaagttatggtgtgctaatgtaccacacgggaagattattttaaaatgtattctagttcattaagtgcagagaggaactaaagggtctgcatttctaacaaatggccttgataatgccaatgttgcttatccatatggcacttataaagttgcaaatggacagcatatatcttatttatgaatgagttaagcctaactagtgtatctagaataagagactggcacaccaaccttttaactaacaatagctgcctttcctattaaggctaaaagaaacatagccagatctgccagaggtatggcaaagtaaaccctggcatagactacccttctttggatttgggtcattagcataagccatcctaagtaccttctctgctttctgaagccaactctgcaaaccaaattcattctgcatgcagacactccattcatcgcatccactttcacagtggctcagaatggctgctgtcaccatatcactcatgctgtgatctgcatcagtggttaagacagaagaagcagcgagatcatccaagtcacaagccatttatttcatactaagaaataagtcttctatccaagtggggccagctaagctgggcagttgtcatggttctaaggttgcaggaaatgttcggtttacactattgagttcctcagtagagagcaaagtaatccttgacaatggcccaggtgtcattaatcctaccaataaaatactagacaaggaaaatctatttctcttctaaggtgtgaattgcaaaaacgtgtgcttaattttttcaataggaatcaactgccttgtttctctcctaaaccaaacccccaaatcactgtctcatgcattgttcttcagtcaaaatagctcttaaggaacatttcaataacattatatggttcagcttattcaaacattggtacaatatgtatatacattgagaagtagttaaagttaaataataaatacatagtcattgtgtggtgagaatatttaatattcattctatagttttcaagaatgtattgttattagctgtagttgcttttatatagatttcttgaaactaattccttctaattgtactacatgtcctgtcaccaatagtaccttatacccatcttagctcctagtcacaactattccactctctacttccatgggatgaacatttttagaatccatatgtgaatgagatggtacgatatattttttttctataccttgctcatttcaattaagataataccctccagattcatccaagttgtttcaagtaacaagatgctcccttgttgatatttggagagttaaacactacagattggaaggtttccctaagaagattccagagcagtatgattatccggcttcaatccaaaatataaacatgttttatggcctaagggagttgtcaaacagttttaaaacacactggcaaattgaacacagatttaaaagtaggccagcttgaagaaacagaacagctccacactttcatatcccagtggcttggtgggaacaagtgtttgcctgcagatccattactgctcctggtggggtctccacactaaggaaatgaacatttcccattaactgattcaccgtgttctttagctcttttgtctctgggtaaatactgaactcttcatcagatcaacacttccatgtacctatgatattacaactctatctctcactcaaaatcatacagaagagctaaaatagtggctagcaaagtcaaacttctagctaagaattcagcctgagtgagcacaaacctttgaagtcatggctgactagtctctcaactaatcctccactgtgatgactaacgttatcatttctaagtgcatttcattcaagtaaatctctagcccgtaagctttctcaacaatccaataacagatatggaaccttaattgctagtggccatggattccccctctgtaaagcccctatatagtctagttgactggagcacttctaaattcagtcacagccatgtgcttgttgatcctttgcaagaaatgttagcccagctggatatatcctctgactaagtgaagtcaaagccagatctggtattgtcagttagcttctccctgtcaagtctatgagtctagacactttcctccagatcggctggccaaattataaactggcttaaactttcactgatttaaatcctaatagctctagtcaatggaccaatttccaagtgagacagtaagcaggaagtgaaagggaaaatgaacagaaatatttaaagaggtaatagattagcaatcttccttattttcccctcctgcatctctaacttatggcctccatttatctcttagtacagttgcattctcttcatctaccctagaaatagattatcattttacacttaagaagaaactgctttctataataggaaggtaacacacatttttaatacctgcaaagaaatacttgtgtgttttttttttaagaatgaacttggctgtaacataatcagaagaacaagaatcttggatgggagggggaggattattgcaatgaccgaagcatatactaataatagcttcaagggagctagctgtactggggatttaaagtaaaacgcagacaaacgaaacatgaattaactttccttcacatatgcttagggcaaagaagtccaaggtaacactcagaatttctaactaggaaattaacaaaaaataaggaagtcagaagaaatagctggattggaagcagggaaggctctgacataccaaaaagatgtcaaaactcacctagtctaaaaaagaaaatgacagcctaatggcttcaagtcagttctgtaagtgatgagaaagatatcactatgcaaagaaatgtatgttagggatatgtacaaagtcattttaaattgattgcatcatatgtgttctattaggcccaaatacccaaaggggttttcaggtagtcacaaaactctgcattctagaactcttcctgagtaagagaaatgtacagtgtaaatacataatttcctgtgctacatctactaaaagcacactgaaatattccaaggtcaccctattttaactcttcattttatttcaattaggtttgtctagaaggggggaagtgcatttagaactgtgaatgaagataacaaactaatgtttcatcttcttcacatcttggcctccagacaaaattattgaattgtacctaagttgcaagaagtcaggctctcagaggtagacaaaagtcttccacgtctgttacaattttcaaatataagaaccagaataaatgataacctgttctcttcattgtacatatgagaaactgtaaagcagaggaaaattctagtcaacaatagatcctatactcatgtattttgcctgttatttttaactttccatattgatataaaatgacatttctgctattttctggatagtgataaatttcgataaacagtaaaaaaaaaaaagcttacattcaacagaagtgttctgacagatacattccttttagctttgcctgtaagtctttcatgacatccttgaagaatcacttcccctttcatttaatacccttatatggagaagccatagagtccacagcaagcctgaacattaaaaactatcttccttctcttacacactgggactcttaatcagtaccaaggcccactgtaatctacacacgtggtagagtttatgacttgcttcatcattcttagttgcacaaattcttgagcactacctatagtctgcacatatctatccaccaatttttttttccctgctgtcctcttagtagggctttacctttcatccaatcgtcttctgttcattaagactcaggtcataatatttatcaacgaaaatatctgcttgagatagtttttctgggctctcacatctgtcctgtagacaatgttagtttgaccatcatctctaaagggctgtggtcaaatgccatgtttaaattattgcttgtatgaaatattttctttacatattgtgataaataaagttttagctttactccttaggtatttttaattttctatttttaagatttgtttttgcatatgtgtgttttcgtgcaagtattatgtatatgcaccatatatatatatatatatatatggcatttcctctgctatcatccaacttcaactgtcaagaacatttcctgattgagttctatggcattcctcctctgcaggtacccatgaaatgttagtccacttaccagttttttgtaaaagagactacttgatcacagactcaaagttggaaattactacttccaaccgggctaagaaactaagtgagaaagtataagtgaacaaagtgatatattgaatgctatctacattttctcattactataggcaaatccctgttcaaaagcaacataagggaagaaggggattgtgttgtctttggcttatgggtacagtccagcataatgaagaaaacagagcacagaagtgtgagtctgcttgctctcatctgagcagacaatgaaacaggaacaggaacaagatttcctccaggcactctgtctctagctagtctccctctcctaaaggttagagaacctctcaaaacagcaccaccagctggagaccaaagtgttccaaacacaagaatctgtggggaacattgcacattcaagccatgacaacatctattaagtgttcaacagtccacagtacagcttgtagttgactcttgctcttggtgaatttgcattgcaagtgatcccagaacaattatctaagtagcatacataaatataaaagaattatacatagcactgtaggagctccttttaacccaaagcccagttgcttttatatttttattttagacctagagtggctggctgacaatcagaggcttgcctattctgattttcccagacgttgaacacatctactccagatggtcttctaaattcccttgcagctgataatgcgaagcaagtgtacattcactcagtgaaactgacatatctctttgggcatattttctcagcatagggtgaggaaagtgaactacataattcaccagcagggagacaaggttcataatgaagaacagaatgaatgagaaaaatggaaaatgtaggattatatgcactgccagcttcagagccaccctcaaacctgacaagtagcagttgcctcccttggtgagatattagggtaattgcaatacctgaagttgacaaacagtaccccaccaattattgttgtctacaaattctcaattaaaacttaattctttaagacattttattcccagtttgtaaaatataaattctccatggacgtgggggcggggatatatttgtaaaatataaattctccatgctctagcacaagagcatgctctgagttgaaggaaatatatttaaggaaaaggtaaaggacacagagccagtgagcccctcacatttattggttccacaaattagccaagggccatcctaataatgcagctttaaggaagagaagatttgaaaaaggtcagttcttaattaaagaatgacttaaacaaacacagttatgaagaacagaggctccagagaaatcttaatttgctatgggtaaattggattgggtgtgaatgagtgtttgtttttatcatgttccataaaattcgcagattgtcattcatatgaaaatagagaggggttttcaatcaaagcttccaatcgaaagcttttcacatactgaacattttctgtattaacatcttaagtttatacattcactctattgctttttatgagaccaaactttaaatgaagctaaagcaaatactagcaacagcagaccaaccaagcatgggtccaaatgtgctatgggttatttttaagggagtacattgtgtgaaatgaataatcatactcttgagttattggctctgaggtcagatttttatacatatggcccccgagacatggcaagttgcaacacaaaatgagtgggcttgccatcatctcctgcctctgcttctatgttttcccttttcacctctgtctctgaaaccacctttgtattctatcttaagcttgtctgtgtccttattttgcttcagcatttaagataaatgtatttcaaaaatccatgctgatgaaagatggttaagaaaaagagagtatgaggttgtataaggttggagtttgcagcccgggcaaccacaaacataagaatagaagagcaactttcatttggctagtttcatctgagtgaacaagaataccaatttcataaaaatgctagacacatgctcatcaaaatgtaatagaaacaacactaaaagtacaataagctgttaaactagacattgcatatgttatagatgcaataaagacattaacattattagaaatattaaaaaagaaaaagccatactcaaggaataagcttgaatcttaaaattaaaagacaggggtgctggagagatggctcagcggttaagagctctgactgttcttccagaggtcctcagttcaattcccagcaaccacatggtggctcacaaccttctgtaatgggacccgatgccctcttctcgtgtacccatatatatatatatatatatatatatacacacacacacatatatatatataataaatctttaaaaataaatttaaaaagacagaaaggaaagaaggaaggaacagaataagagcaatattgccagataagatcttctatgcctgtacttctagtatttgttgatttctgttcagcatgaagtagttttacattttgttggaagagtggggagaaaagaagaaacctggccttgttttcctgggaacatgatttcgacagtataggtctgagagctttttgtatctgttgtcataccttttgtggggtcaaactaatagtcatggattgagtactcctaagaacagatgttgaaatgtcaattcatatgccaaaaggctcttggtgagtcttcattggcagcacttgtgcagagaaatgggaagttggctaagtaaagttgtggtacacccatgccaaggtattaaagctctgaagctgaggttgcccattagttatcccactggaagtttggaatgatcatgtttttatacttggctgctaccagacgttggatacaggatgccctggagaggaggcccacccaaccttaagtcaggtatctctcttctaccaacaactctcccatcagcagaagtaagctctttggtaccaaagaatgatctagctgcacaaagcagcatccctgcacagcctctaaccaagatggttggcttgtttgccaagtgatgctcaataaacagtgcactagaatttaactggtcctgactacgatccagttccttatacctaactgccatgtccctcctttattgctatcctcccatgttactttggtcagatgcagagggtaagctcccaatcagccagttatctatatggtaactcccaccatttaaaatgaggagcagtgagggcaagaacagcattggtggtttggaatccagttgacataatttgctactcaaatcaaagtagctttgagacttacaaagctgggcatgtgaaaactcacacagggcagatgacaatcctgaagctgctaaaacagcaggctttatttttacaaacccaggactttgttgcaaacctcacctcctacaaacactagcacctggttttgctctgccaagtcaaacatttctttctttctccctcaagcttctatttatgctttggtcagctggaactgagtcagtgaaacgatgataaatcgggtatgaaaacaaataaaaagctcgacttggatcgctcactgacatctactgaactgagttgaccattcccctcaagttctagattgcagcagtcccatgctcaagcagacactgggaaactgaacggaaaagaaatgtaaagctaagccacagttgtgacttgctcagaccaaaaaaaaaaaaaaaaaaaaaaaaaaaactgtaagaaagactcataaccaacacactcatcaaaaatcagtgtgctgcttctgctgagtttttgattaggtaacacatccccatggttcaaagaacagaagtataaaaatatctaggaaaatcattgcttattaagaggaagcacatagcagagtgttgatctgtcatctgaatattccagcaccttacactctgagaggacaccatgaaccggacttttaaggtcttaacagttttatccttgcagaaaataatacctgcctctttttaaagaactaaacattatataaccaagtgggatgtgggatgtcttcataattctgtgtctctgagaaaacactaatagttcttggagattttccccccagcatatacaagcatgggctttttagcaaaagtaaataaaatatgatataataataatgccatattatacatgttaatttgttagttctgtagtggaaatctttccttgttagtgtatgcacattgttgacaactaaactttagcatagcatcctgtgtgatatacttaatacactgtattttgcatttttataatatatgtgatacagttattcaaaatgccttttcgttgcttttgattgatttatcttgaatacaaaataaggcatatctgggaaaattaatgagaagacattaaaggaacctttatgggaagaacagaaacacccagaaatgtctacaagtagcagggtatgcttggtaaagggggagatgtgcagttacactaaataggtaacaaagtactaagtgagtagatgataccatttttcgggtttgaaagaacatgaaaacaaatgataagtaaggaccagtccaggaagagggattaaagaaagaaagacaaaagcagggtagaaggcaatggccattaacacgtacacagagagctgttaaagctttatcagaactaaaaagtttctgcagaatccaacctaaatacaaattaatagaatttgactatttaaatatataatcaatccagactagggatacatctcagtgatatggtgttagtttaacatttatatggccctggatttcccccacccccaccccagaaactctatgatgctaaaataacttacatcaaaataaacagtaaccctatagccatttacacttactgttcagataatatctcaaatattaagaccaataaaatattgacaagtcaacaccctgttacgaatagagaaagtccatgaagatccacccctccccaagggcttataggcatataatagtatccagcatggagagacttgtgaagctacatccttccctgaatatctacagtcaattaatcattactgaatgtgagagagacatttttttcagtagcatagccactggtaagagtgttatgctcttataaataatcccttacccatgtccctgtaagcaactgtaataaagctcacagatcatttttaaaaaatcctgaaaatagaaggaagactacttaagaagaaagagatagtaggaataggaggggcacaaaacaggataatggaagatgaatataataaaaatgctttgtattcatgtacaaacgtgtcatcatgaaacctgttattatgcaaaattaacatatacttagaaacattgaaaattatccatttaaaaaaagatagaactgaaaggaaaatagttatcatcacataaaaggaattgttgaggattgggacatctttaacctggagaagaaaaggttaaagagagccatgttaacagcccttaaaaatgtggaagattgtcccatggaaaagagattaatcttcctccctgtcatcttaaattgtggacaaggtccattaggcagagatgacaagaatttggattttctactaaaggtgtgaacacttgtgttttgttaaaaagcccttttaaaaagaaagtttactttaaatatatcaaagaatccctatgtaatttctttactgttattattaagccaatattttcttcataaatagcccaaaaataaaattcaacacagtccttactgaattttcataaattcttaattagtggcattcaaaataatgaggccttattatacactgcttaagaaagctttccacatgctttaatctctttcttcctatgtttatttcttaatcccatgccttggcccactatgtgccctcaactcccactgaagcagagagtacatctaaaacccacatgaaaatgtaaatctgagaaataaatatgcacggttggttttataagagtaagaattaacatttaaagcaatggtaatttgctctgatctgtaattttgagctcctgtgctgaaattgctcatttggaaattaccaagtgcttgggtctcgtttgtgatcttcttcctgcacacacccagcacacaaaggagttataatgaccggctgagtcactactgccatctccctgaagcatgttctccaaatgccaataccattttctatggtacagtggaggacgacactgagccacagcctgcttacaccacagcagacagagaacccaggagtgtgttcaaaaggcatcgccacctcctccatcctctgcttctgtggccattgaactattacatcacagataattgggatttgcaaatcatatctatcactcctatagggagaagggagattgttttgataatatcccaataaagttgtctattcttgatgagattatactcattgtaaattcatacaggaaacacaagtggagatatgatatattattagaaatgtgactactctaaaagaagtgatgcataaaaagtttgtgccattgtactttgtactttgtatttgggaggttgcttgcttgcttatttgtctgtttggtttggtttgggggttttggtggtggtgatggtttggttgggttgggttggttttgttctattttgtttttgttttttgagacaaggcttctcattttaacactggttgtcctcgaactcactccttagagcaggctggccttgaactcacagagatccacattattctgcttcccaagtgctggaattaatggcctgtgccacctctggctggttgatttgggattttcaaaatagaatctctttgtctacctcagggtggtcttggacttttggaatcctcctgcatcagtctctcaaattctgacattagaattatgagctgcctataactccaagtagctctttcttttctttgaacagagctccaggaggttagttgctaatgtttgtcggatctaaattacctaatgcaggaccaggaactcctggtaaatttggttaggaaaaggaaatacttcaccaaaaaaaaaattctattgaatatttcgtagagtctctatataaccaaaaaaataacagtctatattgaaggctgtcattcacaaaatcatagtgactttatctgtgagacacaatttatcttgttcaatagtcacatccacatgtggttcagcttgttttaataaggctctagcatgagtagttgtttataatgttttgctgtgggtttcttttaacctgtaattctgaagaattaagtgatagatgaaagaaaggaacttcaaatgcaacagagaaaattacagccagacctaagaggttcttggcattcgttccaaagatattttgataatgcatgtcaagacaaaagggactcgacaaacacctctccccatggtgctcacaaatgagagaatctccttccctttaaaacaaacaccaagatggaggtgccaaccatctggagagttgaggttggagctgtgagggtcacttggtctctccagtgaatacagtatgaagagacccaatgggctgttaatagaaactcagtggaatcttcaacacctacagaaataattttccaagaaaaaaaaattagtatagctgtttttccttccttcagggttttccatcctgcaagcaattatggaagcagcagtgcaaaacaactggcaagtgacagcaaggtctgtgggaaacataaaggacatccaggaattcagacgcatcattgaagaaatggacagaaggcaggaaaaacgatacttgattgactgtgaagtcgaaaggattaacacaattttggaacaggtatgtctgagacttagcgctctcccagtctgcatgttaaatcattatcccgaggcagttcccgtatctgctaataaattaagtagccaacagaataagcatgccaacagttttcatagtctctctaatccctttttcctcctgagtggctgcaggggggaaaaaaaggaatgaaaagaaaagaaaattctaagcttataaaaaaaattgcatcgcatgattaatttgaatgtctctgcaatttgatgctacatatcagataaatctatggctccactcctgtttaatagatagctggttatttcaaagtaatccctgtcctttcctatatcttctggcccaacagggaacagacaatagattaggcagggctgacaggtaggatttttgtttctcattactggaatatgtactgccctggacccttctaggaaacaccagctatagttgatgaatgtggggagatactacttgccaaggtcaaattgtctatatcattctaaattatccttttgggttagtaggggtaagagaatacattaagatatttttaatttcataaactttattataaaacaaccctgggaataaaaatattacacaccaaaattcaccagacccaaaggctatacagatcaatgaacttctatactagaactggcatttggaacagaaactgtgaagctttacattaaaatttacactttggtatcaaacattttatacatttacacaccaccaaaattaaaaagattcaatggcagatttagaattagaaaaacgattagctttaggttctgtcctactcatgtccattacctgcatcccgtccttcctcgtccccttaaatttagcctttcttgttctaatttttggatgttatactaaactttttatactatatatttaaaaacataaggtgatatattaaaatattttggttttaaaagtgtgaacaatttttaaaaagcaggccaaaattacgtaagacatgcacaaacaaaccagacaaaaccccagtgctcagaaggggaagtgaacacaaaatcccacccttaaccaaggagctatttgctatagatacctgctgggagaggaagtaagttttcttccatggagagacactgggtgtatcagcctccctaaggggcaggccctatacccaggaatagttggtcaatactaattggattccatgtgtatttgtggttgtttatttccctttggttgattgttttgttttctttgaggtggatagggaggtgggagagcatctgggaggaggtgaagaagggaaaagggtgggagcagaaaacattgtatgtaattctcaaagaataaaaacgtttttaaaagtggaaacaaaccctccaacaaaagaaacaagataaagaagaaaacataatccaatgtgccaccatgttttcattatcaagcatcaatatgtaaactttagaacaaaattaccaggaatattgatcctaagctagatggacactgtgtatgggatagaaggccaaattgaaccttgaaagtttactgtttccttacaagtctcattttgccacttaataacaaagttcctgtctctaccattgaaggaaactataagggaaatcttctaatttaaccccaatgtgcctagataagccaaaagagcagaaaataaaatcatggtgagcagccactgcttatgggaggctttatataggaaatgaaatattaaaaatttgttagatctatccctataaaaagaaaagacaaaaaaaagagagaagaatgagagggttggggagacagggactgcaggtgctacaggttagaaatacaaagctactcccttgttaagctcagcattgcttttaatggatgatgattcatagaaaatctagagcgaaagcctggttagttcctcaactaacattcacccgagcaacacaaatggtccatgctctccctcactgaaaaactttcctttgattttttcagatcttaaaaatgaagaatcaggtcagtgatgcggctctatgtactacatgccctccaaaatgtttagactgaaatagccttttagtgggtgacctacttagtagccccaaacagaagaacatctctcttgtcacacttttttggttttcttctgtttcattagggactttggcttctcaaataaccaatattcttttaaaggtctggggatttgcaggaacttagacttggactgagaggtttttcagttctgggtaatggaaaaagtggtgggtaacgctttgacttctatatagttctgaaaccgcgggcacttaactttctttaccccagtttcctcatctacatgatggaaaaaatattttgctctacaacccctcaaaaagccataaaattttggagagaaaaatcaatatcacaggaggaaaatcaagctgtttaccaaaatccacatttctggtttattttatgtcttacttttctgtcttcctttctcctagatgtactttgaaaatatccctcagaagtagcttttatgcaattttattcatttatcatctttcagaaaatcataaaaaaaaactctcaacacatatttgctttctctgccattgagtagctcctgtaagacatatgttctacaaagtaggggctagaatgagctacaaactttatggtacatactaatctaggtcagatgggcattgataaagtacactttagtaagttgaactgagctttggctacagctccatccaaaacagtgcttctcaacctccctgctactgtaaccctttaataaagttcctaatggaatgataaccccccaaccataaaattattttcggtgctactttataactggaatttttgcttatgttagggaattataatgtaaatatctgatgtgtagggtatgtgatatgcaattgctaagaagttggaacctacaggttaagaactactgacccaaagatgaaaaagtacttctagcaacataatgtgattgctaaaatatacatttttaaatttttaaaaatgattctgtttatttctattctaacaataataaaattgctcttatttatcatttcgttttttaaattttttaaattaggtatttatttcatttacatttccaatgctatcccaaaagttccccacaccctcccccacccactcccccactcccccactcccacttcttggccctggcgttcccctatattgaggcatataaagttttcacgaccagtgggcctctctttccactgatggcctactaggccatcgtctgatacatatgcagctagcgacacgagctccagggggtactggttagttcatattgttgttccacctatagggttgcagatcctctcagctccttgggtactttctctagctcctccattgggggccctgtgatccatccaatagctgactgtgagcatccacttctgtgtttgctaggccctggcatagtctcacaagcaacagctatatcagggtcctttcagcaaaatcttgctagtgtatgcaatggtgtcagcgtttggtggctgattatgggatggattcccgggtatggcagtctctagatagtccatcctttcgtctctgctccaaactttgtcactgtaactccttccatgggtgttttgtcatttcttatataaaataaatgtcttattaaacaaattgcttaagtaaccaattttaacatgatatttttttaaaaaaatactttctaaaagaaagtgaatgctttttatcagagtttattcttctgaaaaacatcctgatatactatacagattttagttccatgataacattcataattcaaggagtattaagttcttctaaaagacagcctcattgtttgttttcaatattatttagggattttttttcctagtaaatcttctataatcttacaaaatcatgttccattcgactgcctgagataaaagagcctgtgatagcattataacactatcattaacaccattgtcaatagatcagatttaagcataaagttcatactgtagtctatatccaccaggtattaatgaaaataggtagtgtagtacaattgcccaaatataatcagattttcagtagagtattatataacataatgtccacactatgttatatacagtcttttttgctgtgaatattcaaatagttatataattaataaaaattcttctactattccttccaaagatcttttttaatttatttttatttttatgtgcattggtgttttgcctgcatggatgtctgtgtgtgagggtgttggattcactgaaactgatacagatagctgtgagctgccatgtgagtgctgtgtattaaacccagatcctctggaagaacagtcagtgctcttaactgctaaaccatctctctggctccccaaagttcttttttaactcttgaggccttcatatgttactggagaagaaaatcagttagaagttgaccttcctttagtatccctgtataccaatcaatttacaagaaatgtatgatagatgtatttacaagtgtgagaactaccatagaaattaacagagggtcaaatgagaccatgataacttcttagggctcagagacgatttacaaactgtagatcctaagcccaagatttagagcactacctgtttcatttcttccaatttcaatagttatttctttttctcttatctgggaattacaatataatagaacatgtctcccttccctttcctactttcagcctttcccatatatccttcccacttttcaaattcatggccttcttttttcattatttgctattgcatctgttatgcatatgcatgtacatgtgtgtgagctcgtgtgtgtgtgcacatgtgtgtgcatgtacattgtgtgaatgtatgtagagacccaaagttgatatcttgtttcatcctccatcattctccactttatttatcatggtaggttctgtccttgaacctaaagctcactcactctcgaggcaatctagctagttcctttgtccaggaatccagtctgaatggattttgtcacttactagctttctgacaaggggtaatatatgtgtttgcctgtatttccatttttctcaaaagaaaccacaaatgaaacctttacgtagatgagttaatatgtacaaatcatttggaaaggtccctgatctatagtgttggtataccactttgatgtccaaaaaagcactgtcatacaaatgatctcatgtgaacttcacaataagatgcctgcaggaaagatatgtttataccgaatttatacatgaacattgaagattgaagacttctagatgacttgtcaaaattttacttccagttcaattatcagtacgtaacagaggaagtgtgaaacagaagcgggtctgctgacccctagtctagtgttcttgctttaaacagcaccatttgctttaatttctacactactcattaaataactcatcaaacccaaatgtggtctactcatcagactctatcttaaaatgatggccaagcaattagagatgatccaaagaagaatggcaagaaaatgattaaagcattaggaaacagtaccttcgaggaaaggctataaatgagttaaggttgtttatcctagggaaagagagccaagaggcagtttaatcaccatgctcaagtataaagagttgtcataaagagggcactgaccaactgttctgcgtgcctaaggacagcactggagcaaatgagcttaactggaccagagagacagtcagcactaggaaggactcattataaaggaaagaggaaagtagaagaaagggcaatcactccagttcacactgtacgaaggcaagactctgttgaattaggaaaaggttatgattaacacatttttcaatatttgtttttcaaaaatgcacaaaattgcaagtttacactatgtgctagcaagtaaaaatctttaatgaatagaaaaataaagtatactattcctgggaatctgtggttctaggactcactacaggtagaaaactccacaaatggtccttttataaagtgatatcgcatatgtatgtatggtctccttgtggatttttcaaggtgcctttcatttgaggtcatattgctttttgatctcactgaattcttcatgttcaaacacctccgcttttctcgttactgtaaccttaggtagtacatgtggatcaatcaactccctttgaggagcaactagattttcagcatcatgtaaaataattacatagaaattcataacctattcataaccacctatatagtataattcatatctaaactattgataatagtggatagaatataagtgctacacgtgggattatccgtgggataatggcaagcagaggctctgtatgcatttagtaaagatgtgggtttttgaaagtatttttgatcccatgttgggtgaatttgtaggtacaaaaccagaagttacagaaggctaactgcaattcttaacgtccctgtctatcatctatccagaaagttatccccttaaatagatttacatgatctccacttgttcttcaccatattttctctttttctaaacattattattagtatattctctgcctgagttataacatgaactaaatgggatgaagcaatatgtttaagttttctacccagcaaaatgctaaaatgtatggatttctcccagtactctctcatgccaacttatctcttcatgggtgatctaatagagtcccttgggaaaacagtctaggagcagatcaacccctagcctttcctctcaatgctcccagcagaacagcacattgacttactaccacataagacaatctgagttagcctctactcttagaatagctttgtgcatggttcagttgaataaacataagtttgagaagcataaacacgtgagttcaaatcctagctctctcacttctctattggatgatattgaggaaaatggctgtttatttaaggcttaatttcacaagtatcttactagcttttctttgctcaggaaaagaagctatttaagaattgttactcaaaaatggtctccatgtggatttttcaaggtgcctttcatttgaggtcatattgcatttggatctcactgaattcttcatgttcaaacacctctgcttttctctttaatgtaaccttaggtaatacatgtggatcaatcaactcacatactctttgaggagcaactagattttcaacatcatgtaaaataattaaaggcaaaaatcttgagccatatatagcaattagtacttttaataacagatatgtactaagtgcttatagccatctcgtgtgtgtgtgtgtgtgtgtgtgtgtgagagagagagagagagagagagagagagagagagagagagagagagaaggtaacctagaagtcatacagctaatagttgatgaagctagaatttgaacccagggaatatagatgcagatgctattaatcacagcattaattggccctgcatctgactgaatttttcagttggagtttattcaaccaaaatttataagataagcatcctgatgaggcctgaagtggctttgtttacacaacaggcatttcacagatattttctccacttgatgaggagtcatatcccattaacacagagaattgaaaatacaccctcaaatcgacgctttcgtgaagtgctcctttgtaacaaacaggttcatttacttacagtaccaaaataacccagctttgaaatgagatccacaaaggcatatgtcgtgaaaagaacttccccaaagtgatctgtatataaatctagcatagctaacgaatacctaaagaagtgtggcctccattgtcttaccatagtcttctggtgatatccgatcagcaatgccccactcccaccctacctcacccccaccttaatatctagaaaaccaagcatgaacgagaaatgtaaatatttatagcagatggatttcagatgggtgcttagacttgagagtattgcaagggccatagttatcctttctcccactattaccaccagactctaatgggaggaaatgttgcctttaagcatcaaccttcagcggactccttatagtacaaactctgaaacacaaggatcttttctttccttgtggccttaagagcatttgaaagattagtactgagcttcaggaacaaggtaagggggaaacagacacaaaaaccaaactgggcaagccaaatcaaagcacacactatgattcttaggtaacaaagggagtccttgaaaacaaatcagaatgcaattagaaataaacttgttccctaacatgtaaagatgtttgtcctgggaattggtaacaggcagcactattctacattgagggactttagctttggttataaaaaagaaaagaaagaaaagaaaggaagagaggaagagaggaagagaggaagaaggaagaaagaaagaaagaaagaaagaagaaagaaagaaagaaagaaagaaagaaagaaagaaagaaagaaaggaaggaaggaaggaaggaaggaaggaaggaagaaaggaagaaacaaagaaagaaacaaagaaacaaagaaagaaaagatggcttgattatctggtcatacctcccagtagacaggcctggtaaatatttagaagcaaatcctctctgggaaaatataaaaagaaaaactcattcaagatcattactttgaaacagaaagactcttttatgtttcaggtagtaaaaatgttgatctcaaaaaggaaatgttcctattagaccaacagtttcctcttcttattttttaaaaatccattcacttgattatttcctaggaggcttggaaggatatttttaaaaatcaacaaaaattcaaattacttttcattaactaactttagagttccttctgaaaattctcaaggattgagacacttggagatgaaggaaaatatccaagagttttataaagcagaatacagaagcttgaggcagaagatctggattttagccccaagccataggacttcacaatgtatcaacatttcctaatccctaaagcaaccgtgttatatgttccaagagacttctagttccaagagacgatgatacctggtgctttaaaaaacaagatagagcgtttgattcaggagatactggttgagaggataggggtagtgtgcctcagtggtaaacgtgcatgatacaacaggttaatctccagcactgcgatgaatggaacagaagaaagagggtgaactgtggcagggcagattgggagaagggaggaagggagggagggagggagggagggagggagggaggaaggaaggaaggaaggaaggaaggaaggaaggaaggaaggaaggaaggaaggaaggaaggaaggaaggaaggaaggagaaaggggaagggaaaaatagagaaaaggttcattttgtcttacctagttctatacaaggtaagtggaaaatagtaaagcgtccttactgaagaaatgtacagtctagcaggctgataagaaaacacaataattctggaaggcagaatatgacaactatctccgatgtgtgccgaccttcttgctttctctgactgccagctagtgaccatcattaaatgttttttgctgactgaggtgcttgaaagcctgaacatcggggagcttttctgagacctgggaagatgggggataaagagaatgagataatatgcccttaaggccacaacaccactaggaaattcatttacctctatccttagagcacagaacaacaaacattcctggtaataggagtttatgtttgatcaaagctagtaccacatatgtatatacataaatataacatcagcccttccagaaaatgcctagggaattattctattaattaaaggtttctgatagttggattctgattaaatgagatttgtttgttcattacaaacctatgctaagtccctcgctgtatccacatcagctactctcctccttcctgcttgcatgccctttgcatatacaaacatcaaggagaaaacaggaaaaaaaaaacagttttactgaatcaagacagactcactccttgtcttaacatcagaatcttaggactaagcctggtactttatacccagatcttcaatatgtgaagcaatacaagtgcaacaataaaactgatgtaaatatcacctttgtttttagttaaccctgttacaaatcaaaaggaaattcagaataactacatttaaaaacaaaaatagaataaaaccgtaaacaattatagctttgttatccctctgcaggaaatgcatgtattttctgctggcacagaaagaaagccccccagacacgccaagcatgagtttgtgcggcttccttggtgaacatcttacttaagtctttgcaggcactgagggcttgaccgagtcctgtggattttgattactggcttgtaaacactaagtcttttttaaatcaccattgggctttattaggaaattgtctcagattaagaacaacaaacatgtagtaattagaaagtttgtcatgcagctgcatgattacaggagcccgtctctagattctaacagatgttaccaaaacctctttcaagaaagctgggagaaccacagttcgtgagagcaacacaaaagctacttattgttcaaacccacaatgccacagatcccttatatttaaaatgacaaggctcccctacagagaggtaccaagcaaatacaaaaaaagaacagtaacaaaaaattaaaataaaacatgtagattcaacttcttcaccatgctaacaacgaaaggcaaatgcaaacaatagtgccatgcaaatatcttgactttttttttttaaaatttttattagatattttcttcatttacatttcaaatgctattccctttcctagtttcctctcggaaagtcccctataccctccccccaccctgctccccaacccacccactcctgcttcccggccctagcactcccctgtactgggtcttcacaagactggctcctttcattgatggccagctaggccatcctctgctatatatgcaagtagagacacgagctctggaaggggaatactggttagtttagctccttgggtactttctctagctccctcattgggagccctgtgttctatccaatagatgactgtgagcatccactcctgtatttgtcaggcactggcatagcctcacaagagacagctatatcagggtcctgtcagcataatcttgctggcatatgcaatagtgtctaagtttggtggttgtttatggcatggatgctgactttgatgccactgaacatggcaaatagcctgaacacacatgatacgattatcgtgaaatgttcacttggcccttccagttgaaggaatcttctttgtgggaacagtttcgcctcagtccagataaaagtaaccatgtaatggtctatagcaagggattaagtagattggtgacaactcttatcacatcactaggagcagagctaaaatagaagatagtaagtagccaagcaccactagtttattatcaatcttttttttttttttttttttgaggtagggtcttactgtgtacctctggctggcctgcaactagctttgtaaaccaggcttgcctcagactcatagatatctgcctgcctctggctcacaaggataccgctatgcccagcttacctacttataataaacttatagctaccaaatagcctccccagtacacaaatacaaccccctacaacccctatttcactctgaaaatgaatatcaatctgattaagtgtcttttcaaggagcacagcttgaggttaaaggttaagactctacctaagttctttttcaaaaatcatgtctgcccttgcacagcaaaccccgccccatctttttttgttactttagtgacagtcagccataaaatgtaaaaagaaaaccatcctaccagtacaactttaggatgaatcagacagattctctaaggcattccaagatgctcagaggacaagtctacaatccaaggcattataattagaattgtgcaccttactttatgatgaggaattaatgagtgggggaaggaacttgagatcatgcagcctgaaaattcaaacaggaagtatgcacctaaaggagcccagccaggctgcagtagaagcacatgtgtgagaactgcaaggcatgttcccagcccatgactttactgtttgccttagccagagttgtgtacatcaccatggtcatcgttaagtattagatttgtgagtggcaccggaagagcagcaattatttcactgttttttattggactgtggttcagtaggcaaaacccaccttgcctactatagtgagatgaactgatcatacatagtaaggggcatgaactgaaattgttttcatgtcttcagttgaatctcttgtagaaggcttagctgtaactatacctaaactgtgttttgtaagaactggagaaggctaaacatagtggtggatgcctttcatcctagcactaggaaggcagagtcacttggaactctgagtcccaggcccgtctgttctacatggcaagtcgcaggctagccagggatacataatgagacactgtctttagaaggttggaccaagaatgtgagacctctaacaaaattcactattagtagtgatatgcttgccaattttaagaccatgaacactaggaagggggaaagtgagtaagtgatttccacgttggaacctgcataagagcttaaaggacacctacccctttagaggcaaataacagaaaatagtcacaatatggtgtgacctcagcactaccgtatctttgaccaagagatgaaatccagacacattgaaggaatggactagacagtcaaagaggatactcacagcaagcttcttaatgggccctcctaagtgacttgcctttgactgatatcacttcaacacttctgagagtcctttgcacttctcttgacctatttcagactactgcttgtgcttaacttgagaacctgtgacacaataaattgctcctcctccctctttcttagccaatataaaattaattgttgcttaatagactgctttgctgcagttttctcaaatgtgcaaagcaaacacatccattttttccacatacattaacttaatttctgtctcacccactcaagcacaacgcaatccttccaatgctgaactaaacaccttacccacttggtatccatggcaaccaccaccaagctgctcagagagagctgcaagtagtggcaggaaagtacacctcccagtggagctattagctcttctgctttagccacatcgataagaggtggcgctaggtcagcccctgaatcctcgggaattttctttcttcagaaaggagtgttgttcacacccttgtctcaaggagggagagttgggatcagctttcagttttccattctcaacctgttgaaaataaagcagtcagtgtccatgttggaagaacaagacactttgcataaagaggagcagctcaggctcattaattgatggtaaggaatcatcacgtaagcatcctcttcctaaattctctacaaataaggatacgttaagaagtgggaggaactaatacatagctttagcttcttaactgcatcaaaggaaggaaacgggaggccactattctcgatgctttccagtcgatctgctgaaacataaggagatgcttcaacaaggcaacattccttttcatattgcttctctctgaagttcttaggaaaggactagccatacatttacagaaagggtggggaaaaaaaccaagtatctctcatccttcaaaagtagagatgtaacccagtgaacagatcattgcaatccatcctgataagtgcattgataaaggaacacacagcttgtaacaggaaggcaaaaagaaacataattaactcagcctgactcagccaatcaagaatcctgacacctcatgattgtgctaagtggggaaacaagaacccagtgaaattcatatggtgttgtggaaggggacatatacttctatttacctatgtatgacgatgttcacttaattgtcagaatgagtgccaataaggagcaaatgaaaacctaaggctggttaggatgtcataaagtagagtagtagaaaaatactactaatatcatgtactgtggaggctggagagataacacagcagttaagagcatgtaccgctctttcagaatataccagttcagctcccagaacccacatatttgcaaccccagctctaaagcatctgagaccattctctggtcttcataggcataggcataggcatgtgcacgtgtacacacacacacacacacacacacacctcaaaaaataataacatgggcccaattggtcagaacacaacttgcccctttaccaggacctttgaatcctctagaaacaaagttttttttccacctgccaatagtgtagcatgctatcagaaaggacaaaattctacttaggcattcaactaccctttaattttaattgaggtgttgaggggtgggggactagcatgtgtaatggtatcacgactagagaataaaagaaccaggatttaagaatttggttccagggcccatatttttatagctaccaaacacaccagtacaaggaccctatgcatgggttcccttgactaggccatatgtcttctccattccattctgcccactttccacccaaacacaagaaaccagtgctaagtttaagataggactagtcacatgaaagcataccacactagaaaacaacatgtcaagagagtcccagaacccatccttctcctcctttctgtatcctcttcattttttttttttttgtccataaacattcattgaatacctacgtatagagcactacactgaaaaacactcacaatccgaagtagaaaaaacgggcttctcccctcaaggcaaagtagaatggcaggacccctatctgtactgggtaaacatttagtagactggaaaagatgagaatatgagaccatataggaaccgacaaaacacaacaagaagtgatccttagaaaactgaagcagaagataggattaatggagacatgtttttgtgctttgtttaagccgaggaacaacttggtgaatactaggtattgataaacttctggggttggtaggttaattggttggttggccttttctctttatgtagccctgactgtcctagaattagggatgtagaccaggctggcctcaaactcaccgaaagcttcttccaccaaaatgcagggattaagtataggtaaccccattttcagcagtcaacagttgttgaattaaataaactcgcatcctgatatttgttctaaggatggaaggagcatcatttgaggaacatccaggcttataagcattgcatgcacagtgtatgtagcttttggttttggtgcacaacaggagccttctagatgtgtagaaattgtgatcactgtacttatgacttaaacctttgcaaatttccaccaacgcgttaatatggatacaggcatgatccttagaaatgtctttcaaaaaacaagtcttgctactagctttgctcatctgatgaggctggacttgaatgataatattaaaaataagacttttaagtatattttagttagaactgaaggagaaatagttatgatttctgtcagtaggcataggttgtaactctctgttttaggtgcttatggtctactaggagtagagggagctcagcttgtatatgcttcagaaaatcaatttatttgatgaaaacgtaagatcaggaaagaaagatatttccaaataaccattttgtacctccctaagtagtccaattactgttcttctaaaactttctactacagtacaatttcttttttcacttatttcactgtgagcattccactaattctctagtgaattttggcttccaaggcttttgaagataaagacaatttgatgacattgggcttgtttaggatagtatggccatagacataagacatgcaataagaatctatgggaacactcaagggagacctaagcattcatacacaaaaagtgagaaccactgtaactgtgacctggtaacctcaggaaccagactgctgtgccagcatgcagcaccaagtacaatatatttcaaatatatacttaatatactagttaatatttgatgaagttaacgtgtacattattttaattagtatgttagttaatgtgcaatatattcaatactctctatattaaatgaattgggtctgacttcacaatgttagggtaaaaagcttaaacatgtgtgcactctgctttgacttcttccaaagcctccaaagtcattttcagctctacggatatacggtctaagcattagaaaagtccaactcaccacactaaatggtactgaatatattgtccactgtggcctggttaccatcttccaggtgtagttccgaaggcaccttcttctttgtggcagagtctaaggaaatggtttgaaagctcatgcctagggtagccttatatcctaaagcccagaatctttgattgagtaacttttctgtaataccttcctgagttttccatgtttaaaagatttccacaagatgattttgaccctccaacgtaggtaagactcgtagtgagtttattttctccattgcaacaagaaagtggcacacagaagttaaataacttgccaaagatcacacatttcagattgcttcattcttctccttatttcctcaaaagctcatttttttggtaccacatcataagaatgtatttgggaaagcagcaatgggactcttgctatacaacattaactgtgtcctgccagagtcagttcccttgctttccaaagctatgggtaagaacgtttactttgggcttagtcatttctctccccaccccttcctctgtttcctgaaagaacaattaagatccatctgggactaattataatgattcttgaatttgaacttgcaaccattacccaattgaggtcacttattttaaattaacttgcctggtcagaacacaggtttggttatcttcagaacacagtgcagagaggccctggctcactcagacttttaattaactagctaaataacatgcactgtgacaagctgcctaagatttgatggagttgtacatttgcattcagacaaggatcaaaatacactgttcagcgcttcggggactaagtcccagaaactttcgcactgtatcttgttcaaggctgtgtgcttcttccctttggttacctctaattattttcctgtgcttttgttctgattatccaacattcatcacaagtgcagcttgtgattcaacaatgacaattcatgtcctatgctgatagggaattgaaaattggaggcatgtgcatatgagccaagcacaaagcttcgtgaaataattagggaaaccaaaaggagattcccgggatgccccggggtgaaaaacacagactttctaaagagtcagacctcaactgctccccacttaggtaatcagacataataacactaggtaatctttgttgcatagaatttgtgatgggagctaatcacagtgtaataataatgacagcaatgccagttcttatcaacagtgattactagtagtaatatggctgctaacagtgactaggctttggagttagtaaaacctaattttgacctctttctccaaccccatattctttttttttttaattttctcatacatttaatttgaatgaacgagcacagcaatcctcaaagtggacatgggatcatttcccatgtatgtgagaaaaacaaggctccaaggaacaggcaggggcaattcagaacaaagccagaacctaatctcaaataatgagagctggtagcagacaatttgagttggattttgactctagcacttaaagatatgtgactttgaatatatactatctcaaagcccaaatattctcacttgatgtgaggctaagggtaatacctaattagcagaatagctctttagttagaaagaacttgaattaaaaactactaatcagaaaattatattacagagatgtagtaaacagtacagtaaggacaaaagcagacttaaagcagtaggctagagcccagaatttagccccgacatacatatttgtttgatgtgcagtaagagccccaggaagacataacatgcaaagaatatttttccatatgcaaaacaagcatgtgttcctttaccttaggccacactaacatctattcaaactgatctttatgagttttaagtgcaggatgataaaatgaaaagggagatcgtcttcaacaaatagcgcttgtctaattggatgtcccacaaagccatcctctgttacatatgcagttggagccatgagtcccaccatgtgtgctcttttccaaccctatattcttacaacttcaaaccaagttgctaaacctttctgagctacagtttcttagcctgaaaggattcacaatagggcctaccttaaaggattgtgctgtggattcagagaaataaagccaatgacacagtaaagtgcccactgagttcagatcccccaaagtcttgtttaaataaagtcatgctctacaatatgtacctttaatcccagtactaggaagatggagacaggaggatctctgagacttgatggccaatcaatttagctgagtcagtgcattcccagggttcactaagaaaccatatctcacaagaataaaatggaatagtaattgaggaagattcttacctgtagcctacggacacacacacacacacacacacacacacacacacacacacacaccatggaaagagagggagggaaggaggagggaaggaagagagagagagagagagagagagagagagagagagagattttaactggtagaggtggtatactcctttaagcccaccatttgagtgtctgaaataggagaattgctgtgagtgcagggccagcatgaactactgggagatttttaagccaacctatactacatagtgccattctacttcaaatgaataaatatatgatagatggggaggcatttagacagatggatgggtagagatagatagatagatagatagatagatagatagatagatagatagatagatagatagatgatagatggatagagatagatgatacatagatacatagatagattcatagatagatacataaatacacagccagacagagaaatgatacataaatttaagacagtacttggttgtattagtcacttttttgttgtggatagaacaccatgaccaaagcagtgtataaaaggaagagcttttgtgattgggttacctcactcaggatgatgccctccaggtccatccatttggctaggaatttcataaattcattctttttaatagctgagtagtactccattgtgtaaatgtaccacagggaatgcaagggccaaaaagggagagtgggtgggtaggggattgggggggtgggtatgggggacttttgggatagcattggacatgtaaacgaggaaaatacctaattaaaaaaaaagaaaaaatttttaaaaaaaagaaaatcttaaaaaaaaaaaaaaaggaagagcttatttgtgtttccagttttagggaggtaagactccatcatggtggggagacatggcaactatagcaggatgctgagagtttatatcctttaccaggaggatgatacagaggaagcactgagactagtatgaggctttgaagcttcctagcctgcttccaatgatgtacttccgaacccagcaagaccccacctcctaaaactctccaaacactgccacatacctggatcccaagtgttaaaatgctagaacctaagggggatattttcattcaaactacaacacttctgtacaagtcatcttttatataccaccgaaatgccttttgtccaacttttccctatctgggatttttttttttttgcccttttccctgaggaaggggaaactagaagggtcattattttgtggttgatttactaccgtcttctcatcattttgcatctgcatctctaacacccaacttccatttgaaaacctcagctggttctctcatcttcccagtgctatcctaataatcagcaccagcattcctctgtatccaagcactaagttatcttcccattattctcacccaatagctgcaggttgtttgtttttaagttggggacatgaaatcaaggaaggctttatgcaggaggctgcctcaacttggtctttaagaatagataggagttttccagggaaagatgaagacatagccaatacaaggcaagcactagacaatgtcttaagaattgaagacacatggtttcacacatttctttcttcagttttgtgaaatagctattagtgatagatgtcttttccatgtaggctactcagacctagaaagcctaagttaattgaccaaagttatgatgaaaagtagtctctaatctatcaatctagccttcattgttaagtacactactttatttttcccatgattatatcccctatatttattattttacaaatgaaaaactaaggctggtatgtaatgtaacttgtctgggattataaagctaataaatatcatgggaggtaggtttgagggtagaaagggagaaggaaacaaaataattgtaatttaattttgaaaactacaaaaacatagatttatgtgttgatacatgcctataagcctagcactagggaggctgagatatgatcatgagttcgaggctattctagactatagagaccttgcttcaaaataaataaataaatatttttaattaaaaaaaaacctctcctttagcatttaagcactataaaacagcaagactcttgaaatcaggagaaatagccttctagaatatgtctctcttcattttcaaaatagcattctatttaagttacctgtttgtcaggttcccatttataaaagccaaaggaaaaaattttttaaatttctggttggagacaaagtactttctatctatagcaggttgagttaatcattctctccttggttgtactttgttcatatttctgttctcgcacttctcccactgggctataatcatctgttaacttggctgtctttcccattcaagtgtgacatcctccagactagggcccagattcttgtgacctctgtctccccatgctctatccccatgattggcaccgattgagcactcaacaaacattcattaagagaaggaaaaataaaaggtggttggtagaggcagctttccatatttaaagggccttcaatccacattcttcctgattccggtggtgtgccagaaagtgggctattgttaaaaggcaaaagtgttgatttgtagtaccttgatttctgggttaataattctaacattgctggtttgaagcgacccaggattttattaactggctcagaagattctgaatagttaacacgtggctttcagaagctctctgtgcttggctggaaatcagcagttcttcctggggtacttgaaccatttgctcgccagtgtgatcatgaaggtggatgagctggccaggagggcaagatgatgccagatccaaatagcaagagtgaagggccaaaggaaacatttctgagtttagagaattgtatgctttgccccccatgaactaagcctcagtcatttgtcatccatttgcaaattgagatccacttaaatgacatggctcccagaagaggaacaaagctgccaactaagcaattatcctgaaaatcacatagagttcctgagagacagttatttttatttgaaaatataaacatggtcattcactccaactatcaaatatttttactgattagggtgtcagatactgaaaacactgcacaaatggaaaattattaagaaaggcacaactaagaacttgaaaaagagaccattctattctctgtagccataccagctgctttctttccactctccgcctgaaagcttcatcagctcgagctacacgagggtctctaatattatgccctactatttacatttcaattttgcatataataatgaagctaataactaaatggcaaaatttgaattgaaaaataccacacatcagggttcatgtttcttggttttttttttctaatacatcaaatttaatgcttatcaggcaattccttataaaatgacgctatttattgtcaagcactgaaccttttcttgaagttcctagtttagaagacatgttatagtatctgatttatggggagatatcttacacttatttcatcaaaggaccggtggatattcctccttttttattcaaatgacaaggccactcccattgaaatgcctgctactcatcacctatacagtctcttcagaatgtcaatgagcatgaaaatatataaacagaaagcaaagccttggttgaacttttagaatacattatgcatattaaaacaaaactctctgtgaatgtagctatgaggattgccacaagctaaggccagcctaaactacatagtcaattcctaggccatcgatgattacatagtgaaacacagtattttaaaagtaaaaacagggaaactaattaattatttaggtctattttaaaatgtgtgtgtgtgtacatgtacatataaatatgaagatcagaggacaacttaaaagagtcagttctctccttccacaatgtcggttccagggattgaattcaagtcttcaggcctattttcctaacctactaagccatcttgatgaccctctcttgtgatttgttattaaatcttccacatattgcattaagctacaataaattgaatatgaaagtcttggaagtaaagctaccttcaaaggataatctctggtaaaattcttaccctctaatcctctcatcttagaattgtatttcttgccttattcatttcctttctttccacgtaagcttccctacagtcagcataagcattgacaagattcctttattgtatgaccgtttgtcttgctgacaaaaagcttcagtcactctccgtgtccgcaacaccccaccccccatcccaacacacacactgccataggactgactttggtatatgtcattgttctttcttaccacactattccagcacactcctttgggtaagatgactgcaatttaaagccctgccattcagacatatgagaacaaatatgtgcaccttgaatttactaggaaattatgccagtggaattggcttgtgttatgtttactaagactcagacaaattcattggggtcttcactaaggaaggcaaacacctacaattggattgaaaatctcttctggaaggtatggcacgataacaggctggtttctgcagcacaccatgcattcggctccccacactgctgaaattacatacagtgccataagaaaacaatgtcttttttttttttttactaagagaaaggggaaggcagatgtgagcctaaaaaatcttttctttgaacagaaaaatgtgatctaataggtttttttttccttacaaaattcaaccaaaaatcctccccacaaattcaacctttttttccccagactcccttgcccaaaattttacatgatacttaaatcaaagagaaacaaattagggtgaacatcaaggcctgttctgtactcaaagcaagatcaatctttctccatagatccttttctggcgctgatgtagaaaatccaaacatggagatacttaggtctgcaaataacctaatctgcataccagatggatctaaggggggaaaacatacacacttcttcacacacatttttttttctaaaatgtgagcatagaaaagcagatgcttttgcctcccaaaggatacgtgggcctctctcaagtagtcttgtggaacaatttcatttcaaatttctaaaatgatgaaaatatctagattaaacatgaaattgggaaaggacgggtctccttgagagacaatgaactgaatgtcttataaatcctttttaactgcttggagatattcggcctgcagtttcatagaaagatgcgatgaggggctgtttagaaagggaaaatgacccccaaatgagtaaacttttattccatgacttctttgacggaaagtttgacactgtctacatgtccaagtgttagtatatatgagatctttcttatgcaaaaaaaaaaccctctgctcagtgaatgagatttgtagctagttttttttcactttgagatgctatatgtgaagataaaaataattttccctaaaaaaatgaatttcatctatacttgatacattttccccttattacatttatcgtgtctgccatcatagcaggccatttatcatccctagcaaatcttacaaaggcaaaatgactgcagaacatggatgtgggaacttggtatttcttccttaaatgtcacatctgagtgtaaaaacagctttttatctgtgaagttctaaaactaattcagaaagatctattataattactataaaagcaaagttgaatattctcttggataccagagttattaagtaagtgagggtagaatttatgtctctttcatctgtaacagattgaaagaatggaggttgagtattaactgaacaagaactttcctattaactatccagttctctggtgctccatattatattcagtatccccagcccttccctgttttcacaagcttttcctagggaaaaaaaaagttaaagggaaggcgaagagaaaaaaatatagcacatttctcactgaagcctcagttagctcccatcagtaggatgatagcagccccacagcagatctcaagacaacagatactttctctctaacaacctggagatcatttctgatggaagccttccttgaaacatattacatggccctgatattttcatcagaagtttctgatcaaagtaaactattgtctgatgactcaggcactcacagcaaacatccctgattatactgtgcagtagtgcattgttgcctgcttttctgttgtttcttccttctcctttaagccagactgtcacttcctctagtactaatgcacctctcccaaatatcactcccagcctccccacacaccccttctagcttgaagtgtttaatttactgggaactggaaaaaccaagattggtaagaactgtatgctaaatcagagttaagaaggcactgaaagcaagcatgaggaattaattatgggcttcaaggcagcagctctgtgacacctaaatgctcctatctttagataactttcccatctcctccaacttaaggctaactctagaaagggtgatgagagaactaccttccagtatgtctatttgttctgagcacaccatctgggcatggaccaaaacagttattctaacagcttcatcttttcctgaagctgaagatgcaatgtcttaatgaacaccccatccctggaaggaagtaatgtggcatacttcatcattctgatctcaaccatgtttggagatgttctctcgtttaatcaacgcaaccttgttaggagacctagggccaaatggtggatacgtgaatggaaactcagaaagttgagtgatttgtccacagccaagcagtgagtgcatgaccaaatcctacctctggattgtcattcaggactcagctaatggcactaccattgtgtattgttccttctggactttcttatgtgaaaaaagcacaataaatatggtctccactgaaacagccttccttatttttctccgagtttgtcatgtgttcatttttcatgaagtattcaaaaccctctagttttattatgtgagggttgtccgtgaattaaaaattcaacaaatgtatggtcccaacttgccaccaaaagttaacaaatgtcaccagcaaagatgtttctcatgagcagacactgaagaatacatcccagaagacacctaacagcttattttgtgtcatggcaacatgagaaatcacctcctcaagatattcattaacctttcttttccttcatacacaatcagtctgaaatgtggctcatattttaaattaattgaaaacatctctctgtactctctcttatacacacaaatacacacacacacacacacacacacacacacacatacactggcttgagtctctataaaagcaagaaagtaaacatgatactcaaaggtacaattccatttctatgggccaacctaacatgtaccctctatggcgccttccctttctgcttcatgcctttaatcatctcgccttgctcctctgcaaaaattgagaacaatcatcatcacttagcataaataaaatgattggaaattgaaaatgtattaagtcatattactcttaacctacctcaaatcctagcttagcctaatctactttaaacatgctcagagcacgtgcattagcctttagtcaagtgaaatcatctaacacaacgcccattttataaggaaccactgaatgggtcctgtcatctattgagttctttgttgaaaggagaaaagaactaacatggtaaaagacctgaggatgggagtgtgcagtaaagtacttccctgcaatgcatacatccctggcttccatcactatcacttcacagaaataaagttcaatctctcctgcatgtccataatttagataccaccataaagttgaaaactcaggaggcaaattgaaacatgtcatacagtcataccaaggggactggttctaaagcagtactccaactcggatatttgccaatatagaggtgtgtgtcctttatacaaaacagcacactattcatgtctttctatataccttgaataatatgtacattatttatattaactaatactacataaatattaaacaaatagttcttgtactgcactgcttggagaaacagagacaagaaaatagtctgcacacactctatttgaaatgatttttcaggtgttttcgatgtgagcttgtttaaacatatggatgcagaaaccacagatatggaggatctaattgtacctccagtccttccccaggaagaaagacccagcttctaatcccagctatgtgaccttggagaaattatttaaactacctttgggctgtgattcttcatctgtaaaattagacttaaaattttatagaaattacttacacatacaacattgagtacaaggcctgcatattttagacataaaaataagggcagttgtaataactataacaattaacagactttcatatatgcctccagtttactatgtataaaatcctgagaccttgccagttgttttcaaacctctgacatctgcactcagctgtatccagaaggaattcctcatgaagcttaaccttccagcctctggctggcattgcttcctcctaaggcctgttccaatcattctactcaaagtttgcctttgctttacttaaagaaagatcatattagcttcacattgacataaaacttaaatacacatcaggctgttcctttcttctctatagtgttcacttccttgttcccatcacctgtacctagaacagtgtcagcaccttggtgtttgacaaaatgcttaaccagaaagtttggcgtacttagttacaataaaataaactttatgtatttagaaaaaaaaaacccagccagtacatttgggtggaaaatatttagcccactgacataagagacaataaaaggcactttgtaaactcaaggccaagtacttaacacagcattactgatgaaaataatgataattatgatgactccgaggaaatgtttcttaccctcactatcgctgacatttgggaccagatgattatggttgtagggactgtcctaagcattggaagatatcttgtggcatccctgacctttactcactggatgctaatagccaaatacgttgtctgacattgccaaatgtccctggaaggaaaactcctctgaatgccctagggcattgccttcagcatcaaaagacattcagatggccacacatctttcacattaagacattaaggcaagaaagagaaggcaagcgtgtagaaaagttttcaataagcaaatgtaacctcagttaacctgaaaattccattaaccccattctttgagtgctctattccctaagctttctagataacaaaaaaaaatgtacagtacattctattttctaatttgtatgctaagttcagctcattttccatctcaacagctaagcatagaaatccagttcatgagtgagggatcatcagcctctcttttgccatctattttaagtgacctggaagttccaatgttttttttaatccccttgttttgatattttaactttgatattgacaatgattcctgttttatctgactacaagtgaaatgtgacaaaaaatgaacccggtctaattagcagcaattctaccatatactaaaatcccaccatattgctgatgatttaaaagcattcgttccagccatcccactgattgtataagtgaaaaaaatgcccttaaataaacaatatttctcatttcttctttctgcaggttgtgatcctggggaaacattcaagaggttatcactacatgcttgctaacctggtaagaacaaaaatgtagttcaagcatccctgagcaatatagtccatttagttcatgtcatctctaatcagctgtaaaggaaatccaggaagcacctaatgtgttctctagatgcttggagaaacaaattcagtaactacccaaactggcctttcgtagctctggatactataatgttgtctttttcagctacaaagctatctccttttcttatttaaaagataatttgagtcaggtcttctggaactagcctgcaatcccagctacttgggaggttgaggcatggtcagaattcaaaattttcctgtgctgccaagcaacttcaaggtcgtcctggtaaacacagtaagatcctgtctcaaaataaaaataataaaataaaacccttccaaaactgactgaagaaacagctctgtggtagagttcttgcctgggaaaaagcagatattagcttcaacctccaacagcaaataataacaatgatagcaatagtaatcaggcatagttccccattattcttagattcagtttggatgttggctatttcaattaggtttgaaatgtaaaccaagagacagaggacacagggagatgactcccaatatatccaaggacacttgcatgccaatatttgatttgtgctctcagaggctaacaaatctcttccaatcaggcacaacaggatataccttcctacctacacaaaacccaacctggctttttacattcaaatgcctcatacctttaaagtccataacatctgagaagacagtgtgccaccaaggtcaccccatacctctttttattctgaaaaaacaacttgcttagtgattaacaaaatggcttataaattagaaatgccctttagataaaggttctgcagagcattgtctctatggaatgaaaaagggatgtgaaattatcactatactactaagaatctattaagttatcacaggagttcaagccaaaattttgtttcattagcacaacaaaatcacaatcgttataaagctcttaaaccaaaagaataatagtgatggtagatgattaatgtaattgtgctcttagatttctagaattaagggaaatatcttgttttgcttacaaatgtttctaaatgataaaagaagtgctattcaagtatctttctcagaaagcatccaaacactactgacttctgatgtagtatgcatcttgaatatgctgcacaaagtggatgaggccttccatccaatttaagcataaatgattgattcttctaggagaaaaaaacagtcctcaattcacatataaaaatactcagcttaggttttggacaacagatgagtaaggaatattttgagtcaatggaggttagactagggtgtagtagaaaataatagatgtttcaccaagatacctgaaacagttttgttgagtttttcagtttctttcttaccaataatctgctttccttctttcattttcctacttccatccctctcattttatcttcccctcagccttatatgttctagaaggcagtaagatatacaacacagtgtttaaaatatggggcattatgtatttactggcaatgtatgaggtgacttttggtagtgctcatacaagtatttacttactaaaaactcttgtccttaataaacattaagaaaatatatgactaggacatcaaaaacaaagtttttcagatcttaactcacatggagcaaaaacagatctaacaaaagtgaaataatgtttgatcttcaagtaaacaatatattatgctttctttatacatctgcaaacaactgtgctcatgcatgttgactgcagattgaaaaataatattgagttggagtttagaatgttttggtcttgcttgagtaaccatagatacctcagttgccttgtggtggatgtggaggtgggaatagaggaattcttccatatgttgggacccttggaattagatgttaaaacataattagaaaggcaagacatttcttgagagggataactgtgaaaaacaaggaagagagacagaagtaggaagggaaggtttcagaccacaatatacatctgataccactgaagaagggcaagaaggaagatagacagtcaagaagagcacagactgtggtgtatttctgaggaagtcttagtcagaacaactaagaattcctttgcaaagtctgtgaataacaaaccttttcagtctcactttgatcaaccattatctgataaatgccaaggaagaaacgttcttctcttgaaagctaaagtagattctgatggcacctgaagtgggagcctggtccgctcactggacaccttgagtcaagttctgcctgagaaaatttgagctcattcacatcagtaattgtctcagctggcataagatgatctaaggagaccctctctatcctagatttccagctaggccagattatgcctaataacaatctttcaaatatattttcctttcaacgttgagatctagatctgtttccatcaccaccacaccccccaaaaaagcctgcagagtgatggaacagcaaaaaagaattgccacctatggtggtggtgcgcttcagtaaacacaacaattgaaagatacaaggccatcctaggctacatagcaagaccatgttgggggaacagtgagtaaggatgtagctcagtttcatggtgtttagctaacatccacaaggacaagagtgcttgaacttgatcaaaagagaaagaaagataaacagacagacaaagaccgacacagagacaaagtgagaaagaacaaactaagagcaagagaaagctagagcaagggacacagagagacagtgaggaaagagatcactacagtgttctggaaatgaatggtgaactgaatccagagcacacaattcaggataatgagaccttagagagatgcctcctacaagaacaagcaaaatctgttccttctaaaagaaagtaatgtgtagtatcatgtcagtgtgagtcatgaaaacatgaactcattcattgtgctttgagctgccactttttcctctagtgaccttctttcctttgaactcagccacacagtttccataagtccctgaactctatattattaaagcagtggatagaaaaactactactcagttgataataataatgaaacatcatctctatcctccacaaaatttaaagcacaaaaaaaaaatactccaaacacctctagcaatgacatacacatacagagtaaagcaaaactatttagaagtcatttggatggtcaaaaaaggaagtggagctaagaagatgcttccttccaagatgagccatctggcctttcaagatgagccagctgggtaaaaactgaggatgtgtatatactcgggggaacaaactctagtcagccttggtgttacaacagcacagaagaactcctttcttctacaaatgcaaattcaagaacactcaccctgactgagcttcctatactctaagtgtcttctttgattctcagctccacatatctgtcaaagacacctgtatgcttttacataaacctccttaaatgcagttctaaaacgaggaggaagcaatcccataaatgcttcaatagaggccgtcaacaggtcagtgtgtacactattagtgaaaaataagctttggaaaagttcatcttgctaaaaatctcagatataaaaaaaaaaaagcaaagattctaccaagaacacaaaccagagatgtgacatgatcaagctagaagtggacattcctgttaagcaagtaagtctccaacaaattccatatccatatccatatgcatatccattggtgatatcttttcttgctagaggttgttccataattgtttcctcttctagaagaatgctgttacttggtctgcttgagtccccagcagtaactagtatgtgcatgcaacctgtcagttacgcagcacctttttcccatatggctgggtcctataacagtacctcttatattgcattgcaaagcatatcctgtatcatgatttaattttttcatatatgttgacaatagtagtagattgatgtgaagcatggaggtggtatgacatgatacaaaccaaggcactagcatatgagctaagagtcaagcttaaatgcttggaattccttcaactagacatatctctgtaactgtttattcatttgcaagctggggaagaaagacccgatcactatttcccagaataggttatttgcatgagctagtcttaaggagtacatggcagaacctttttaaagcgtattggttttgaatttatattaaatacatattagaaaaaataactactgcatcaattctatgatttcacaaacattctttagaacaaggcagaattgctgtttaagtctcataagtaccatcaatataaaaaaataagtaaattttggttcagatacagatttaaaaagaaaactataaaaggtggcatatttaagactaaaatgttaaaacactccaaggtcacttgcagttctgtacttcttcctccttagatatcacccaggtcgactgtgaaggaaagtgtcaacatagcaactgggtgaatgctaagcacacaggtaggggagcaaaaaccagaggcctactgtttttaaggcagactgaagcattaaaatcagtccagatgggcaaatgctgagagaactgtgagtgtccttagccaagttccaaacagagataaggatccaaagaactattcaacgtagccaagcagttgatacaaggcaaattacatccgcgttgagatggtccaatagcagatgttcaggataccttaaaaatcagaccaaataatccaaacacttgaggtgcccaggggaagacaggagccatagcagaccatattcagtgctatagtgtttaaccactaccttggaagacctgacagttccccagtgttcgaggcagctacagatgctgaaagtggaggtggggtaatgtcagctgtcagtggtaaagaatgtggaggacaggcaatcaagctgagcattgtaccagggagaaaggggataagagttaatggacctctgcctgccccctgctgtgctcgctattttcttgggacttctttaagcatcttaaaacatctaggagtagagacttctcaccaccacctcctcaaatcttttttaaaaatcaggaaatggactcagaaaagagacccaacttgcccaaagtagacaatcagcttataaagtgacttgtttttcctgctcagcccacccatgtgtctcagcaagacaggtcagctctgaaaaggtcacagaagagtttgtgcaaagagggactggtgggatggctcaataggtggaggcaattgccagcaaacctgacaacctaagtaccatccccaggacccacatggtagagaaaacagactcctaagaattgccctttgaccttcatgcatatgcagagatataaggatatgaagcacacacagtagtattatgagaattaagtgatcaaagacaattttaaaaacagggacagcatactgagcatggtatggtaggcatgtaatgtgagctcttgagagatggatgggataggattagggattcaaggtcatcctcagcttcacacagaattccttgaagggcctagaaggaaaggttgattcaaagaataacaaacaaaactttgtgattctgtactttaaagctgtccaaaaaaaatgcatctaaagacacatattgcatcccactatgtccactccctaattcattcttgctctctccctcttggtttttcattcttctgtagctcccccgccccctcccatttccctcttgctgtctcttttccctatatctccctcattcatagcatattacaagaaatggggagagacacctctttttattttactaagacagaaatgatcactcataaagtagtatgcaaaatcacatccagcagtaaactaggtttgaagaactgacctctgtgcttaccagatcttggaatgaaccaaaaacaaaaaagaacctgctttgtttcaagggaaagcagataagattgagtcatgctgttggcatatcaataccaactagtcccttatgctcccttccccttccagggcttcctgttctgttctctgcttccccttcctttgttcttccaattgtaatgttctatataaaaattcaaatgctcaaagccacgtgttgtgatgccctcagcagatggcatgtaaacacagaggtcattgggttggagcctagttttataggcaagggaagtgggcttgaggcaaaaagctgccactggtcccaagtgccaggaaacacagtccacttcccctggatatacaacctctctaatggctcaggattcagtttcttcttaaaacagagatataatagagcagaataccaagagacagaagactggggattggtctgaagtctaaacccctatcatgttattgagggtcacaagcattagtcagcttaaagtagacaacttcagatactcattcctttttctccaaaatgcttccctgtgtgtctctccttccttttccctccttcccctccttcctgactgaaatttacaaggaaagatcactacctagccaatgttttaacgaggtgacttcatagaaatatatcttctctttcaggcttctcaatgctgcctctaaaacagggctacttagtagatttatgtactagtgtttcatgattttatgggattatttcttagattgaaaatatcaaaacttgataatgtgcttagtagcctaaactactggatatcatagctgaacaacacaggacactgcagagatacatcattctggcagctacatggctaagaaggagcaactcactgcctctgtccaggatcaccatacaagatcttagcactaagtaccatatatatcaaaacttaaagtattgcctttaatgatgcatagtagttttcacataattcaaaagcaaataaaaatattaattcagaccatcataagctgagaactgtctgtacttggactgtggtccctcggtcatccacaagcaacctctcttatagttgtcaagtgaaaaatgctagtaactgaaagcaacttatcagctcctccaccacttttcattttattctggccacagtaccatccattatatatcttcccaatattttaatgttagctcttttttccccttctcttcccttcttcccttgttcacaaatcccaggcctcacctctattgtgtggaacattcagatctttaggtcttacccatggtctcttcaaagttcactttatagtatccagaagaaccaaaagtctatttacttaacacagtctaccttttcctgaagaattatagattgaaaatggcactacattatgtatattaaacattacgtagagtttctactcaaccagtgtttatttctgcttgtttcacttctgttttatacatgttcttcttaggtcaaacatgaaatgcttcggcaagtctggttttttgttttgttttgttttgttttaaaaaaaaaaaaaagagcttcttaactacttacagaggtgaacccatttattcccaaacctttatagaccaataaaagtgcaacaaaaataaattaaatgaaatagtcaaaggcagacacatcaaatataagtctaatatttaatattttacatttagcatttaatatattagttcagtagccataagccaagtgtaacagctacagatattgatagcaattattctgattcctctctcctatcatctgactggtgacactcaacagtcaatgaaccagcactaagccacacacaactagggtattagaaccctaaaagtatacaccgtccctttttatttttatttcctttttgctgtgtaggagtagggtacacacatagtactctccatagtacacacatggaggtcaaatgacaatgtggaagaattggtcctttcctactatcatgacggttccagggtttgaattcagatcatcaggctgggtggcaagtgcttttatctactgaggcaaagcaccagtcccaggaaaggttttttcctatatcatttgaatgccccaaattgcattcacttcactacaaagaagacaggacatcatgttctggagaaacttataatcatagtgatgagaacagtcttgcctaacttatagtaactggcctgaagacagacaaagaatgaagaaagccacaatgtacaaaatcagtactgtactgcacgtactgcagacagagaaaaactttgtaaaagggcgacttcaaaggatgctctaaacagtaagaaggatccatttacatgataaatcaggaaaagttcacctaaacagaacatcacatgtcaaagttccgggcaccatgctttttctacattgtcaaaatgtaattttatctagaccagagcaaggctttactaggccagttaaaagaacaatagaaagtaattgatatggttcaagtaagagaaggacatgatatgatttatgcctcagatgaattcactacagacaaattttacaaaaactaaatcatacctcagaaaagctgttagtctaaaacaaaaggctatcagaggctagttcctcaccagtggcaattataatgtcacagttgctttttttaatccttacaaatagctccaaatagactgaagtgtcattagggtggtggccaggtacgatatatggctcacaattctatccacttaggtttcagagaatatttggtgattggattagagaatagaccatttagtaagcaaggcaagtaacctgtaaccaagtgctaattcatatggtgtaatctttccctctgcccatttcctccgcccccaccacatctggaggaaggatctgctttccaggggggggggaagacttgtgtctttcattaggacacaattactttgcatttctaggttgaagcatcactccgatgaacaattcaaatagcactaaagacagaggaggcttcatgcaaatgctaagataaattgttgtccttggcagtcttccaaatccacagtctactgcttttatctcccctctagcaggccacttgcccatttctcacccgtgatctattatcaacgcaggaaaagtcacccaacttactttgtacttgctctcctctatggacaaaatgtgccgtaagaacaattctatgtgcaagaaatctctgtgtagtatcctgaaaataaatgctctaaaagtaaaccttgaatgcatttatttccagcttctaagttatccacactatctgaaggaaaatgatctgcttaaatgtcaatcaatggagagcgcataataccaaagccattcgaaacttttgaagttagaattttatcagaggcagtttgtgtttgaatgccaattgttcaaaccccagttttataaatgatggacttcgagaattcaccaaggactgtttacagtactttgcataaacttcttaggcacaaagttatggttcatcttatatagccgactgcagatatgagcaacagtgttagaaaggtgaaatacaactgataaaatctagcctagcttacaaatctaaatgagtatcttcagtgctcatgttcccagtgaatactgccattgtcacagaggtaaataagccagatgcacagatatttaatacctagaaaaggagaaaacattttaacttaccctgtatgtcagcagtaggattccttccaatctatctctctctgctttccctcatatcttctaatcgcttccctgtgcaaagttcaccgacacaaccaaaggaaaagataccactgtggcaattaggcaagtagcactgatttggatgtttagtgtaaacccacacaagtaattgagtatctaatcatgagctgtaattgttaaaatccccatgaaataataaaatgggcttaacagaaattccacttagtacaacagggaacttgggaccttgaagtaacttagcaatgacattgcagagtgactatacaaatgctcttattctacagaagggaatgggataataaagaagacaaaggtccataagcagtcatcaaatgtacaacagcccttgtaatcattagagaaagaggaaaagaaaagaaaaaaaagcacacattttagtacaaaatacagccaaaattgatgtagcactttcttagtcattgtgttgctaatcaaaaacattggtaaagatgtagagaaagtataattcttaaatatgatggatggaggtggaaattagctcagccattttggtaagtgatagggaatttcctcaaaaacttctaaaagtaaaactactatgtaacccagaattgccatttctgggtatacaggtgctcctagatctggtggatttcataattcaaaagtacagtaaatcaaaactacacctcgatcaagccagggcagtggcaaggactctataatcataggtaccaaggagacagagccaggttgattgtgagttcaaagtcatcacagtcaacaaagaaagcatttcagagcaagtgatgcatttaacatatttaactcacccaacactatagcttggctccatagcccatcaaaagttatggttgtttactcttaatgtagtcgctgactggagtcacagctcactgcagctgctcagcatcctagcactatctgcatactgatagcccattcactcgtataatttcacatgaactgaatttttgttggtcagcccagttgaatctgcgttttgttgaggctttgaaggaagtcaggccacagtgagcaaaatgcaatgaggtttgtgactatagttatatctaggactttttgaaagaacttaaacttaatctcaaatgatagagatgagtggagagctaagaatcaggcacattctactctcagccaactactttcactggcatccttctttatcacatttctcttccccattttatttatttacctatttcagctgttacctttttatcatataagaagttttacggacggttttagaggtatttgacatttattgtgctttgagtaagagtagtggcccagataggctcatatatttggaagcctagtcatcagggagtggcactatttcaaaaggattaagaggtgtggccttggagaacatgtgtcactggttgggttttgaggtttcaaaagcccatatcaagcccagtaattcccattggcctgcatattaagatgtaactcttagttaattctctagcaccatgtctgcctactacccatgatccctgacatgacaataatggactaaatctctgaaactgtaaaccagttcccaattaaatgctttcctttaaatgagttgccatggtctcgtctcagcaatagcaacccaaggtaagacaacaacgtttatatccaaactttgagattggtttgttaacaactccaaaagaaaaatccaacaacacgctggaataaacaaattgccttaaacacagtgaagctcagaacctgcagccaaacaaactcttcctcagagacatgagccctaacttctatcgccaatctttcctttatatactttaggtgctcagtggacatttccacagtgtcatcattttacagaggtttaagtgagacttgaacaatacacccacacaatgtttttaagtggccagcttacataatgaaatgttttgaaaagttatgatagaacggatagcaggaccaaggacctgtaagtgtcttctcctattaagtagtcacccagttgtcccctttgaacatactctacactactgaatgcagcaacgtgtaacagaaatgccagcatgatttggatggtgttagaaggcaagctggagtctgccgagtgctgtctcacagcaggcaccactctctcaccttcttcactctacccatgaccttcacataacagtgcttcatgatttgcttctcactagtgttgtcctttctgctacatggttttatttgtagagatttcagtggaactggggaaacagtcccacctctttagataatgaggagacatcaaacccagggaatatttgtgagcaagtaatttaggagctccaactgatttgataaaaagaaaagtgcagtgagatccggtcagctgcagtgtattataaaaattgatcccacttcgattattctacaccttagaacaaaccttgccctttaaaaaaaatccctattatattttgaatgtacattggtgacctctttgctaaagttgcctgtataatctcagctttctgtatctgtgggttgtatttgtacatgcataaagtctagctactgatggtaaagtaactcacaatataagatagctttaggacatgttagaagagaaacagagagcccagcagtaattgtcccagtcctattgttacctatgaagcagttacagcatgacactctgtctctaccaataaccttcacacaactattttcatatttcaccttccaggtgtcctatggatgtttctcttgtataatttgatttatggtcttttcagtcaactcagcacatagtccctcccagttctgggtctacaggtggtcatctcaagaactgaaaattagccagagtttgtggaaaagttaaatgatctgaggtgatatataatgagtatgactttttaaaggctttgaaccatgtccagtgagaagaggtgaacctcgaatcaggcagtatccgtctcgtacccactgctgttctctgacctccatgctctattcaagagcttcccatcttcattttcatttctacctccatggaaccagtgaatgtttctgatatagttttcttttagagagaatgcactggtctcagtaagttttagccaaatattcttgtcagcacaagaaatgaaccttagttaaatctatagatactcaaaatacctcaccatgttgtgacaagatgcaaaggaaaactgaagcctttttatacctcccattaataaaaatattaatctctgatattctccccttgccacaagtacaacttccttctcttctaatagctccttatattaatgcctatgtataaattatccaaataatctagtctgttttctgtatctgtagactgtatacacacacacacacacacacacacaatatgatcagaagcacagtagtttaaatcatggcagaaagaaaacctgtcttatcgttccattgttctgttgtttcagtctcttccggtgcagataattttgggtcacctctttaataatgcttactttgttaaatttcttcagacaatgaagtctctttgttacgtgggattttaattgcaaatgtcagcagttcaatctagcagtatgtaatataaaaacaacatatttgagtacgtgttagaatgtaaacaggtaagccataaaaccagaccactttgcctttcagatatcagttataagttccgttttttttacaatgatatataccatttttatttacttcttttctcacatgggaattgttatcatctctatgaaattaatatctctccagagatttagaagcgactccctttttatttactcaccttttgctatgaggtcagacagacaaactcaagcagtaaactttagtaagcattctcggcaagtgaaattcctttaaatgatgaaataacgggaaattttaaattattaccattcagttcctgtctctacatcagacttcctcctaacttccctcatcctgccactttgtcctcccattaaaactcttccattgtcctactcacttactgtgggtgctgtctggattccagtctgacataactgtctttatattgcttttaaagattagcaccatttttttaaagatttatttattagtttttgtgaatacactgtaactgtcttcagacccaccagaagagggcatcagatcacattacagatggttgtgagccaccatgtggtttctgggattgaactcaggacctctggaagagcagtctgtgctcttaactgctgagtcatctctccagccccaaattcacaccttatacccagtagcagtgagcattttatagaatgaaaattatcaaatagtacaaaaatggatatttttcctgaatgttttgaatgttattcaaagagtttcaggagccagacatcaattgcctttagctgagatcctaaaccctaagaaaactggggtcctccttttcctccatcttgtcttcccatcattggtaagtgattcttagtcatctctcctctgtcaacattataggtaaacatgtggcaaagtcgggcttggttcaattctcaaagatgacaatgtctcataatataagacagcagtttgaaaagaaaaacagtgaccacattgccaagttgaatctgaatgatgttagtccaagatctagctgagtcctgcacctctctctgagctccccatgttccactactgatgttactctcttgattttcctctaagtaagcaatgttgatttttgcatttgtgaaaattttagatatatagggcctcgtttttctcaaattagtaccattttatggcaatgcttagaggtaaatttggtaagaactgtggttcattaaactccttacaagagtgagaaaatagatgaatacagaccaggactcagtcatccccttgacctattgggaatatgtaccccaaaacttagtattttaagtgtctttcatcatttgtctttattggtcaaagtattgaaggtctcttctattgtgctatgcttatacacagtctttagatagacttggtgtcaaaatcaacttcaaggtctctgtgtagtgaagcaaggagtgaattttgaagagttatataaataattacaatgcccaatgtcttaatcaaatgggtggataaagtgagctagttgccagccaaattcctttctccaacttaattatcttatcacaaccctccctgccaccatcatttgattctcctttttttgtacgttctatgtgtctatggttatccatcctgttctgtttagtgtctttacaatgaattttaagactataaaacactaggaagggttgtgtgtgttcgacccagtgacgtgcacaataatctaactacaaatgatgacagaacgtagtgcctgaaaatatgaggtaggagtctagcagtgcttgccttttagtctgtattcattacttctagtgttaccattctgtgtttatagactactgtgtttatgtctgctagtcagctttcttgtaatagttatttcactaactctgggtagtttgaggcctcctcaatttacaactttgtcaattctagctgtacacaacaataaactgtagtgactcattttagaaacagaacagttcttctaaagtgcaacaaattgagaaggcagagcaggagtcacccaaacatttcttggctgtcttctgccactgaccatctaccattttattgaaccattttgtcacccatgtgtttaatgatcatttgcttgattcatcttttgagagatttttaaagccttaccccaatttgactactgtgaacactcgttcacccacctaaggaagatatctaaaaccctaccctttacccatggcagcttttttgtgcagtatctgttactgcccagtgttttcacttggtaaaatggaagctattaattaaacccatattctctgtttaatatttttctttcttttggaagtggagagtgagttaataaactttcatagcaatgatagcctctgctatctgctagatttatacacaagcttgcttctctggtgattttagtgcgggggttagcaaattgtagaaaatattgtcttagtatctctcataaagggatcctttaggagaaaactcatcacaacaagttaatattaactttaaaatgccttgtggttattagaaaggaggaatgattctcagtatgcaaaccaaactaattggctccttgtccaatctccttaaattcatatctcacaatgaaaggaagatgataggggttctaactaattactgaaaaagtgtctcactaaaatcttttctaagaccattttctgattaattttaaagagctccaaaattaagaatgtaaagttggagttggtggttggagaagaacacatggggcacttctgaagactggatatatttgtggctcagtttatgaatattaatgaatattaataatattcacttaaaatatacgcatgcttttttgtgattatctcccatcaaggaagatgttctgaaagtgcaaaaaagaaaataaaagaacttataagaatatggataagataggcatgtgcatttatcaaaacacatcaagtatacttttaaaatttgtccatttcatcaaatataaattttccctcaaaaaagaaaagaaaaaagcctggaaagataacatgcacacatgtatgtacatttacttgtatgtacacatgtacatgcccacatgaatacatacttataccacaaatacaaaaaggatgggagaaaatactatataaacaggaaattatagctattgacattggggttaaacctttggggttaaagtatactaatatctgcacctacttaacacttttttttgaaatatattccaaaaattgaatgaactattggaccagagagcacaatagtaaaatatgaatatcaactataagggttttcactgcatgtttgctttcaaagtttccatatatttgaaattttcttacactaaagtgttagaggtgatagtaggccagaaaacggctcagttaaaaatgttctagacatggtcctgaatttgggtccctaaaactcatggagaaaaggtaggcatggtggtgagtgcctacaatccaagtgtgggggaagggaagcgggaagagacaggagaaccctggaactcactggctagccaacattgtcaagtcaatgagctccagttttatcgagagatttttgcctcaagagaaaaattgagaataatttaggaaagcattcaacacagaacactggtgtgcatacatatgcttcatgaattcatacacacaaacacaaacgtgaacccacacacacacacacaatcctgacaataatttaaacaagagagaagctctatccagtttccttttgattttcaatttaaatctgaaatgcctgttcccagaagagtttgatacataactactgcgtgtacactacttctaccccttccctcgcccccctttgctctttcaccttcctcttaaattcatgacctatccttttatatctcagaaaaatcaatatcttttccaatttttgtctcttgattttttttataactagtaaaattgccacagatacattgtgcaagttttttctccttgcaattttcccaagtggtaaataaatctattttcttttctaatgtctgtctcttgttttctttttatacacaagaacaataaggtacacagactattcatctgaattttggtagcagctatgttggaggaaaactcagaactagccaactcctaaatttgaaaaataaaggaaattcccagatgctagtgtcttcttccttcttgctgccacaaaagtttgatgtctctaagcatgttttttttttttcgtttactgaaaataggggtatttttcatacgatatattctgattatggtttcctctcccccaactcctctgagatttcccccaccttgcctcccattgatatagaaagctgccatccattcattaaggattctgacacatgcgcaacaaagcacatgagaccaatatccaacagaagtagaagcaattcctgggcaggggatcccagaagacagtaatactcaagggagttggcagtgcccatgtagaaaaggcttaggtgtgaaccctggggagagcacttggaaatacttgggtgacagagacaccagatggtaaccagagcaagtgaaggagcaaatggcggatgctatacagatgtcaagactcatttatggattcatgtgagacgcaccctggggtttatgccatcatatccaggcaagctgtcagcttcactcactggtatttctgtgaatcacaaatgtctaaatactcatcacaagaatctgaaacactttgctctgctcagcatgttaaggtgaagaaaagattttctatcgcacttcttaaggccaaacatcctcaacattctctagtcacatagtgttatatttgaagtctctgtaggaagactgaagaaaatacaggtaagtgaaatcaaatatttgcttaaaagcaaaacatgcattggtcacagacagaaaaatgaaagcatgtaccatttctccattttgtttgtactttcaaacacatggtggcctaagaattggtttcatatccaaggccttcttcattgcgaataaataatcctagggaaggaatctttcatttcatccttactctccaacagataaatgtaccagaaacgtatgtctctcacagtcatgatctttttcactgtctttccagggttttactgacattgtactggaaagagtcatgcatgggggagccaacattacaggtttccagattgtcaacaatgaaaacccaatggtccagcaattcatacagcgctgggtgagactggatgaaagggaattccctgaagccaagaatgcaccactaaaggtaatgctccaatatacacagacaatgaaggccagctttccaacgcttttcaatatggcctttatatacttacaaccatcctgtgatcaagtgctcttccctcaaatgtgattcaataactcttttaaaaagatcagctgtaactgactctatagtataacctaacccccaaacgaactatagagaatagatcttgtaaaaaaaaatctagtgtttgaaaataaattagtttaatgtttaaatgaatctcatttctaatattctcatagtaatttacactattacatgaacctgaatcaggcaaagggtagaggcagtaggaataggtaaagattgatagtctaaaacagtaaattggattttacattatttatgtgattgccccatgataataagttccatgaatctcagaacacccaaatgaattagtctctaatatagaatatgtattacctatatgtacagaaatattgaacagaaatagttacctgcctacaaaagtgtctttaaaaataattagatttcctaagttgctcattttcccaaaatcaagataagaatattaaaaacagaaagtcatatttagagtgcatattttcatatgtgttccctatggttagaaaactatttactcatgattttaaaaaagataaaataggtggaaattatttgtgctatacaaaggtttcctaatatattatatatattatcctaatatgtatatatgtgtgtatgtatatatatatatatatatatatatatatatatatatatatatatatatatatatcccattacctcagcacaccaatttttgctgctatagtaaaaattcatacaaagactgtgatgtaagaagagtcaaatatgttaaaaccttcccccttaaaaaaggaaactgaggaaggtcttctttctcatacttcccagctctcctttctttctaacaataatagagtagagaatactagggaagatagatgaaaaagatgtattctctactaccctgaacaggtcacatcagaacctgtaaagatctgatacaactagatacaagtaaagtttttaaacaattgaaatgctctaggaaaacttgtgaactaaacataacttcatagttcaataaagccacttactagttagaagctaaccatatgactataatgcagattatatgtgccagagctttctagggcatttccatcttaaatcatcctgccccttggtcagaccaagtgtcctaatttgtcttggtgaatattgtcacattcccaattaggaatcctttataatcaaatattatttaatgtactaaactggcatgatttctcatgctatagttaggcgagcttacaaaagtttatatttccatgaaactgcctaaccacactgctttgtggtgttttgatttagcaactttagaagacaaagatacatttattcattattttaagtgttctcaacaattttataaacacaatgttagccacaagaaaatgaacaaagataaaaggtataaagagaaatattgcagtaaagattatccttgctctgaagatatatagcttctaaaaaagataatgaaaaccatctcaggtactcattaatactgagtgtgtgcatgcaacatgctagtacttaccattaaaaaatgcttagtcttataagtaaaaccctacaaatggtttaagaaagtattgaaccttgcattaaatcaatcaaagatcctactttaatacttgacataggatatatagagttagaaagatcatttagaaattaaaatctagatgttgtttaatacatatttcataaataattcttttcattatttattttagattgactggacaatctcatgcatgggtacagaaactgaataaagtacaaaattaaacatttcttttaatatagctttagaagaattgcattaagactagtgacaatgcatgcagttggttgggaggaaaatcaccactctgttggctttaggtagtgctaggatgggcaaacacaaagatttttcttcatgaaagaaaatatgctctccttatagtcatacttgatgagctgcttctgaaaggaaagtaacaagagaaaagtaaattgatagttgtaaagacaacaatgtattcactctcaattgtatttggacagacttttatatagtgagaactccccttaggacattttgctacactttaaaaagtcaataagattccatattctacaagtattcatcacccttgcaaaacagaggccagcttattttaatcatgctttgttgattcatttaatggaaaagcctccaccatttccaactgcagataatcaaatcccttgtgttaagtgactagcagcatccctagtagaacatgtcactgtatacaaggaacagaaagtaaagtgttctcgcctgaaagaggtagcatcaggaagcattgcctacaaattgtcaacgttatcagatttaaaactcaataacaattgtaattttcgacacttgaaaagaatctttggtttttgctaccccctgggaaacaaaaactgatttattgctggccagaggtcctagcttgcttcaaacatggtccagacagaaatgattaatgtttccttccaaattaatttcaagctgtctaacttagctatttccattttcccctaagtaaacagcagatctgaattttctattacaaacagcaataactcagtcttgctttaggatatgctatttcctctctaatctatacatgccatcctttaacatcacatgcatttcttctcataaaatatccagccttttatactcactcactcaatatgaaacagtattgagagcaagaaagagactcccttgagccatttgatcttaataaccctaacatgtgcacacatggggtaaaaggcatcattgttgaatgcatcaaagtcagtcttgcccacagagaattttgaacttgaataattaggatgatatcattgtagggcaaaaggtggaagtgaatgaaaaacacaaggaacaaggcaagtttctaggatgtcatttgtcatgctatcttgtttttcatgtgtttattttagtatacatctgcactgacacacgacgcaatactggtcatagcagaagccttccgatacctgaggaggcagcgagtggatgtatcccgcagaggcagtgctggagactgcttagcaaatcctgctgtgccctggagtcaaggaattgatattgagagagctctgaaaatggtaaggacaatttcttgctggggaggacaggccttagaaagacacaaaaaggaagtcctcagtcccaaaggaggatggactaagaaacagcatctcaggctgtgcagaaaagatttgtgtggataatcacccaagtctataattccaccaatagaaaggtctgctgtgaagttagaaaaaaataaatttagcgcaaatacatctttggttctatgctgcactgtacctggtaaatgaaacttggtaccctgcaaaattatacactgaattaataagtagcttcaaaataacatatcttctgcaaatatgacatttcctaggaagatttgggattttttttttaatgaaatgatcctaaatccaagatgggcattaaaaaggacagcagcatcgttgggctcatcagacaaattaggagcctgaatggactgtggaaccgagccagtgtgatagtatttctgttgtcaaagagaacacttattctattcttcatggtagaatgcaggaacatggtgcatttctagacctacttaagaggctttgtccagtgccacaaagaaaaagcctaaagaaaagtacaaggaatcaatggatagatgatcaaataggtcacttgtttttagtatttactgggtaagagatcatttaaggcttcaagcagtgtcctttgaacagattccattatttacactaggagcaatatcacccattcattgcagctttccaagcaaagctctttcctgaatatttaactttatgcctgccacatgttcctgtatgcattaaaatgagcctccaagagtacaagaatctcttctttccaactaattatcttgatgtttgggacatccagatgagcaaaagagataggccatcctaagataattctgtgcacaactcagcaatgaagaatcaggaacaacctcataacgtacaccattttgtgtatttggctctcttactgctgccttaatttgccaagttggatgcattcagtccagagaggttagtggcccctgtgtctctctccaagaaagagatatgaaccattctcaaattgtgtagacttttatgtcattgtgtcaattccctaacagatgccccgagtgtagttttatggaagcagcggtgcatgattttgaagagcagctaattaaattccaccttcctagcagttacaagatttgtattgtcaggtggaacataatgatgagtgaaatataaaactgcctcagagtgaatcaaaatgagttttcatcaacaaaacctcatgggcaggagccagcatttctaattgattggccattcataacatcaaccaccactttccccaagtagaaacgtggccaccagaatagaaaataagaaaccaacttggatataaatcaataggaccaaccatcctgtcacaaagaaaaatttctggacgtttaactcactggtaagttcaaagggcaggccaaataagccatcctccttcctaggccttaatggccaatcacctaatctcagggatgcttcacattttgtttctattctagaaagcaatggactttccaaaagaatatggtccttcaaaatgactgaaaataagcctggttttattacattttttaaaaatccctttttactgacgttcattaaaaatgagattgcacgatgtacaggcacccttccttatgactaaggatcactgtttcttaataaatcattttcttcccctaaagaaatctagaaaccaaaccattgtttttagatagacgcgtgcgtggggtggggcctatttaaatgaatatatagacatgccatccattctgcacttagtaagcccctatgagtatgtactaggctccatattagtatgcaaatatgagacaagctaaggagagctcgtatttgaattacattaatgttaaaaacacagaaaatgaatgtcttttaccttgagatgctcccaatccagaagatatagattattaaaattataggtaaataatattaaaactatttagatcaaagagggattctggatgaggtagtgggaagctgtcactgacattcaatactagtctatatccctaaaaatagacttcactaagagtggtggtccagtcctatacctactccctgaagactttatatcatgagggctggcatctctaggacacctgttgacttcccagctcataaatcaagttcagataacctgggtcttttgaaatgtgtaattcttaatgagacttgaaggcctgagtatgcacagcaatgaaggatttctatgcaattgtctcagctctatcaaacatcacaacatgcatcaatttcatcctactgaataatgcatcaataaagggcccatttctttacctagagctgtcatctcacatggtctacaagcttagtgcttacgtttgcttggtcagatagaattgccatatcaaagcagtctcatggtctcttaccggcactcagaaatctacttcttttaaaaactattcccaaagccttgatatcaattttccccttggcagtatagacccattactgtccctgacttgtttgctagcttgttgtttttataaatgaagagaaagatattttgtcagcttatcctcaaacaaaacaacaacaacaaaaccagattatttttctttaaaatctctgacccttactcaggaagtgaaacatccagatagactgacagtctttatttgatatttctaaactttagggcagatgagaaaatctgtcagtagatgtggccttttgttttcctatgactaggaacccttagggcatatatagactctgaatttggcatcccaaaacaggaatggagctctaacacttctgtctctgttgtggagcactcaatgttcctgattccttgaggtccacaaattttcatcagtctttgaactatctctgcatggcagccctgatctctgccacctgtctgtaccttggcatatagttttaatagggaggaaatgctgcttctctcacagtagaagtccataaatgcacaaccctctcaaataaatagctaaagtcactttgcttggtaatgaattcagattggagatggaaagacttcctgggttaagatgcttgatgaccagaggtcaatcccaagatcccacaggggaaggaatgaatcaactcctgaaaattgccctctgacctccatatactctgtagcacacacatgcctgtgtttacatatactcatatcagagacacagaataataaacaaataattgtgaatgttaacctagtcagactgcactgtgacgcttactgcataccaggcataacttgcaactcatttaatcatctaaatagttctgagagattggtgcttctgggatttcccatgtcacagattaggattactgagtcatgctgtggaaaccaaatttttttcaaatattggaactatgaggattagaaacaatgctactccacaagaaacacataatgcagaataatgcattaacctatttcagcctaaagtacattcataagaagggactattataaatattcaagtctttgaaatactggttaaagtcatctcactacattatacaggtgaccacttctaatactcacctaaagtttcataacttaaaagcctactaagaacacattgttaagaaaataaggctctgtgaatacttgatcagcctcatagaattcaatgacctgaaatgaaaaccctcaaagatttcatcctagggacctagagtcaacaatgtaaaaactagtttaacttttttcacctcttgcctttttaccaggtgcaagtacaaggaatgactggaaacatccaatttgacacttatggacgtaggacaaattataccattgatgtatatgaaatgaaagtctcaggctctcgaaaagtaagtagccaaaacagtcaataagagaattgtctctccaaaggtgagagcatgctcacacaagatgtgtgagaaatatacaaagaaagccccacttggtgtttgtctttccatctgctaaggaacagagataagatacataaagttttgtaatcagaatgatccaaccatatcttattaaagaggatgacgctctaatgcttataaaagtaatagactcacaagttattaataatttttctaaacaaaggggaagaatgacaaactctatagcatgctattaaacagaatcttcctaggcacatgtggtttttcacaaacaaaaatgaaagtaggtcattgccaacccaccacccaaagtacttgagacaaaatgtctttcttcagagctgaattgtatatgcccagttagcgtctaactcactaacaattgagttagacataagggggattttgtagccgtgtgataaacctttagaatataaactatcttgcatcatatctaccagctattaacaggcttttgacttcaatgtatcagctttctgcaatcccaacattttctgctgtagaaagttaatagaaaaagtggtcattacacagcaggcacaagtatttggcagaattgtcggtaaaggtgaagtgaggaaaggaatcctcaagatcaaggaatagcaagcacgcctctggatgtatcctttttgtcctgagggcagtaaaaacatagatgggaccagggtatcaatccttataaatgtcaagcttcctaaaatccacttagtatttcttgagagaaaaatgggcatccagatgaaatgtctgttctttctaggctggttactggaatgagtatgaaaggtttgtgcccttctcagatcaacaaatcagcaatgacagctcatcctccgagaacaggaccatcgtagtgactaccattctggtaagtgtggacagacagcagggaggctttctgaatagttgcaggtattattcagttctaagtattccggacagttctaaaaatattagtcagctagtcttgagtttaagcatgcagaagttctaacacaacggctgctcaggaaccctcaagcacctcttcgtaatgaacaaaatgccactatacacaatggaattttattcatccataaagaaatattaaattatataatttccaggaaagttttcagaacttgaaaatattatactaagtagaataaccaaggctcagaaaagcaaatactacatgctctctctctctctcatattcagatgttaatttccagttgttaaatataggagtaagtatgagtaaagaccaagaaacttgatagcagacctatgagagcaaagagatattaatgggaggggttaatgaggtgggggatgttgatcatatgtgatatcaacatgaaagggaaaatactgtggacaaaatcatctagaggggttggggtaagtgtggagggaaaggaagaggtggataatcacccagaatgaagtatgtgtgaagattctacaaaacactcaaaaggaagaaaaggaaagaggagtagagggaatggctcagtgggtaaaggtgcttgccaccaagcctaatgatctgagtgaaggagagaactgacccctgcaagttgtccctttgccctctacccaagtaacatggtatggactcagctgcaatatactcagaaaggaaagacagagaacaagagagggaagagagtggatgaatgaatgaggaacaattttacatattactgtcctcttctacttccctcctaaaagaatggtgcttcaccagaatatagagtctaattcttcattgtgtagggttgtcgtgtgaaaaaaagaaaatcagttaatgttctaatattggatctaatattcctttgtataactgtgcaagtctctaatccttaggtttttatttttgcaatttgtaaaatggacataaataataataacctcttacctacgtcttaggaccatttcaaagttacagttagctatatagaagtattccacaaaatacaatacactatagacatatgatggggtagtgttgtttccaaatggttttccaaaagttgtctatttttttttaaatgaagtgtgtacctcaggtaaaaacaagtatggcatttaaaaagcactatcaaattctcttcttcactttatcctaagaactgtatggtggacctcagatggaaaaaagagccagccaaacacctcagcttcacaaggactgcagtatttccctatgccctgcctgagctggctggagcccctacctaatacatcctgagaaatcaaaggcaaatcctctttatgtaccaaaggagatagtactttccaattcaactacatcaaaagacttcactggtgaaaactagtcctgctttcaaattctaggggaaaaaaatcttaaatgtttctctacttcattaaatcatcagtttggggctccaaggaatacatggtcccatgaatagttgattgaggctcccttccttattaagtcaaaatttaaaaaaaaaaatcatttccatacaccgagcctcaataggaacagaaaggaaagtgtctccctattacatttactgcatcttagggaaaaaaaaatggataagagtaatcctttgttcttttgttctgttctctaaggaatcaccatatgtaatgtataaaaagaatcatgagcaactggaaggaaatgagcgctatgaaggctattgtgtcgatttagcctatgaaatagccaaacacgtaaggatcaaatacaaattgtccattgtcggtgatgggaaatatggcgcaagggatccagagactaaaatatggaatggcatggttggggaacttgtctatggagtaagtattttcaattccattgttatctatttctattcttttcagttaacaagaaaatgaggggctctaatgttcagtcttaagatttatcagatttcagggttttcatgagtctgtaaagacctagtttctcatgctgttgaggtcaggaaagcatcctttgagcaacaaggttattttacaaaaaggaaaataaaattgaggaaatgtatttggccacattaagcacagtcttccctctactgagagtcttttccttattccttctgtgtttcactgaattaggtaccagaaccacctacccatgcagtttcttagcagtatctccatctctcctcattggtcccctcatgtctaatgaaccagtctgcagtatgagtcctactaggtctttcaaatctaaaagcactctttctcccaaccatggacattatcttagttaaggtttttgccatctgtctatcatttagctggatccctacctctagttttacactagcaaatcagctctacattattgcaatcccccactttaaaaaacaggataaaacttgaagaagactatagtggtattgccacaggtccttggtgttttaaatggttttggtctcagggaagattaggtcttaagcagagcaatgaagtatatgaggataggtacaattggccaccagaactacccatttcataaaccaatctctaataaccaaagttcagatctaaatatcagaagatatttagttctactagacaataatcacttgctataattggtacctatttagacatcagatactgagaagataaatgaattggaggtatgtgtgctgagaaagtcacagttggtaagaagcaaacacctatgtatctattgggtggaggatcagaaaaattactccagtggtagccagcacaactagggcgtcactcaatcataaaacactactggggtcactcaatatgttttttagaataggcctttggaaaccagcataagagatggagctcatttctaaaaatgaggacacagaatgggaactaaggcttaaaatgaggctgggccccaggtatcaaaactgggacactgtcctcttgccagacaaacagcacagtaacttgaaacccctcctccatctgtggggcctgagccaatcaccacctgtcttaggtcaaggttggccttgggaactggggcaggactgagttgcagatgagacacaagtgaactaagaaatgaaaaagaggtttttcagttccagagagggacagacaacaactcagttgattttggaggaccctaagcagctctcaaccattttgacatagtactagcctctcactttccaggtgacaatgttttctctttcttgtcacttatctccccaacactcaaaacgtattgtcttgcctatagctcttcctgcactttagtaaattgcatagggaaaacccactctttgccctaatgaatcaatacctgtatacaataatggttgacaaagattcattaaagttagctcatggagggaaaaataaggcaatgtttttgttattattagctagcacttatagagtgttcactggctgctacctactgtgctaagtactttacacacattctgtaccttaatcttcacaacatgtgtttgaagaagttccattagtaacctcattgtatatgtaagactatttaagataagaatgaaaactacattccaaagaccaaacatcctgcagggccggtcttggttgttcaggctgctataagaaagtatattagacttgtggtttacaaacaacagatattgatttctcactattctggaggatgagaagttcatgatcaaagatttaattgtctagtaatgatgagctttctagctcacaaattgtacctacttgttgcatcctcacattagggaaagggtaattagtctctgaagcctcttatataaataacctatttatgagggttctgcttcatagagtaaccacttcctaataccccatttcctaataacattactttacagattacaatttgaccatataaagagaggcacaaacattctgaccgtaacaacaacacagtgccttggatctatgaggttcatgtgcttttaataagttcaccacactatcccatagtaaaagttgtttggggcccatttcatctggaataatatttgaaatttattataaaaatattttggtgccttggccattcttgagagaagttgtcgaggctttagtagcgtggaattctattgaggtataaattaatactgctccagttatctgttctagtccatcagttcaccagcccatccaaacagaatggtcagagccctgtagtgtctccaaagaaacctagcacagtctggaaatagatcagtgccctcctagcattgagcaagatgtcaggcatggtgatgtaggataagagattgcctgacattgttcagatgaagtgcagcactctcatggtgtttacgtttctcctctgggatgtgctctctgctacatgatttaatctctacacatccctttctctctctacttcatctatttgtaagtgggggaatttgagaaatacagagcgctttgtttagtaattcaagcggtttgtttagtaattcagacttcatctcctcaattttgaaaaggtgagatttctgaagtgacctttctctcattctcctgctgctctgggaagagctttcctttctgccggggaaggctcttaaaggcacatcctctcccctttcctgacctagaagaagtctctgatgttttctaagctgaataatacaaagtgattctggacaactgacagcaaaccaatccactgaagtagactgtcaaactacactttcctctaaaacctaggaataggaaaactagactttcctgtcatgctaggaggaagagcttgctgtcagagaggaggatagcagaagctaaatgtgttttaatcttttggcatcagaaacttttcaacatctctgtacatgatagaaatggtgggggcatgaaagcacaggcttgcatttctggcagtcctaacctcttatggtttgcaagttgcttcaaaaaaagagagaggaaaaaaactgatgatttttccagagtgcttaatggacaaaatatggagaacaggaaaattatgacttgcatttagcaggaaaactatacagaaaggcatgggttcgtcttcccagtactgcctcctataccttttgtatgtactgtggatcagagcaggaaaggaaggcagagcgggagaaagctttgccaaagacatttctgtatctgcgatgaagtctcaagaaaaagtcaaaaggaattgagtttggtaaagaataaagaagtcaattagtctcttttcagatgcttcttgaatttttttcctttaaagaaattcaaatcaaagttgatgttggggcaccttgtatctctaagaaggttatttttgaaacaaacgtcagcagcatacaatgttccccattacgtaagcccttcagaacattgtggtcttgaaactgtccacctgcttttagcaattttgattttgagctggatttctgtaacactgccacatagtaatcattccagctcaaatggctcacacaccaccagtttttactgctcccaaatagcaagtgttttaagagggcattttaaaagaacattttgtggctatcagaattcttaaatattctttagccaaacatctaattcattttcacagatgactaggagacccaccagggcccaaacattagcattgcccattgagtaaaccaagaaattgaagcctgctggagcacaagagtgacagcaatttctcagggaggaggggaggtggcaaattttgacaatagcacaaaaatcacagttcggcaacttgaataccagtatgcctggtctagtgctctgtccactggtttacattggctcagctcactaagcttctcaatgtatgagaatcttgatattactgcagtcagatatgtcacttcttcatggcttcagggtaaaccggcttgcattctagctggattatgagtgattccatctaagatactcattacatttctatgtaccctctagggcaatgcaatactaatctctagttatctcttgaaatatttaaaaatacaacataaatagctggaaggttctgtcctcaagagaagatatatgacctaacaaggttttttttttttaaggaaaaaaaaaggcaagaaataggctaggaggaaattggagccccagttatgaagaggacacctcccagtgggtcactgccacattgtttaggttcttagtacctagaactgagaataaagatgatgtgggattgcttttggaaaggctaggaacaatatcatacacattggttcttctgacttggaaaatagcagaaagctcaggaatgaagatgagattggcatgaagattccaagtcatggaccttgggtgtcccagactatttctccctcccaggagaaatggcaactcagcagatactacttacaatgacattgcattgcttgtaagaaattatcttagattgccactatcctaaaacagatttattttccattaacaaaggcagagagtcaatctgtcctcccagttaaagggggagaagcaaggacccagtatcagatactatgaattcactgctaatcttcaggtgattacactgggcgctggcagaaaggactgatggtttgataaaagtgctcttctactgaacggacacatagactccagggaagagcattaatgatacatgaaagtctgctattctgagcagagaggtgaggaaatattcccaaccatatttagcatcacacggccttcatccagctccccagatgcccgtttatcttcagtgggtctttaaatccctcagctccccaaggacaaggagtccaaatcaatagacccatactgggacatctgttctggataaagaaatgagaagatcctgttgtgaccctgcttgttgttgccctgatttaaatagtccccatccctttctccagatcttaaccgtagcagacaacaaacatctcagagagtaaagccaatagagcagtttaatccctgttccccaacacacagcaattgtattcctattgtccaccttacttctgccccactctttttttctaccgcatttcaggaggaaattcctgctgaaggccactagagtcttaggcttgacgcaaggagcagggagcagatcacgtctgcttcttatacggtctgcatggtacatctcttcctttttcttccttccccccttgctatcagaaaatgctttgaaacagtggctgacaagttcctgctcaaacataatcttcaaatgggttacaaattttagatgagctgatcagatgaaaatactttaaaatgtaacaagcctcccatctcaaacaatttgtaaaattacagttaaactaaatgtcatctctacttaaaatttgtcagcttcttaagttcatgatccccgtgcataggagtctgttgggagtttaggttttatatttacaactttggctgcccatctataaaaacgattataaatcccctcaagctaaatccccttcaacaacgcagttgcttgggtttgccactggttaagtgggaaaaaaaaatcaaacttaatttagtgtgtttgctgagcccacacagccattcttaagttgcttgattaaaatcctttaagtagtcaaaatgcaagttaaaaacactagtagagtctcaccctgagctcttaccatttgctggtttctgtctgtcacctggagcacactcataccaagcatttacccacctagtattctaaaagtgacttttctgctgctattagcagcacaggcttgatgacaaaaggctgctggagtggtttaggacaccaaaagagaaacacttgattattaagttagaagctcacctgctccatagttctagccataatccttcatgcttggctccagttacagctgacttgcatcaaatatcaagggaggactttcggagggtgggtggatttgatgcaaacgtgttatatgcgtatatgaatattaatttatttgggtggttgcttttttttttttttacattttcatcactcttaaatctttaattttcttttaaagtaaccctgttgtctgtatgccatggcagtcccaggaaaactaaggattcttggacacttattagtaatctgcttctccattttctcattggtaatcaagctgattatttcacaggcattgtagcaggcaggtcatacataagctctgaaataacctacaatcacacggataaatttcattttttattaaatttattatttattcactttacaacccagtgtcatcccttcctctgctcccaggacgcccccatgtaagtcttctccccattcccctgagaaaaggaagctcccttctggtcgtcaaatcccaccagaccacacatcaagttactgcagaagtaggcacatcttctcccactgaggacagacaaggctatccatttaggggtgcaggatccatatgcaggcaggcagtcaacaggctcatgggcagcccctgccccagttgttggggaacccacatgaagacaaagctgctcatctgctacatatgagcaggaggcccaggtccagaccatgtatgctcttcagttggtgattcagtctctaggagttcccaagggtccaggccagttgattctattgttcttcctttgaagtccctatcctctttgggaccctcaatctttcttccaactcttccataagactccccaagctccatctactgtttgggtgtctctgcacctcttcccattgactgttgggtggagcatctcagaggacagttatgttacgttcttccctgcaagcataacagagtgttattaatagtgccgaggattgtttcttgcccacaggatggatctcaatttggggcagtcattggttggccattccctcagactctgctctgtctttgtccctgcacatcttgtaggcaggactcagtttgggtcataggctttgtgggtgggttgctgtccttatccttccacagggagtcctgcctggctacaggaagtggccacttcaggatccatatcctccactgctaggaatcagctagagtctcccacttagaccctctgggatctctccccatcccaggtctctggcaaatcctagagattgcccccaaccccagcctatctcccttctctttcccctgctctccctacatatgatcttcccccctgcctctctcccctcctcatcgcctcttgcacccagtttcctcctttgatcgacctccaatgtctattttgtttcctcttcctcatacataggaagggatagtagcaggagagggcaagggctgcctctgagctgatgctccacttctgtgacttgtctctcacaaaggataaaagagatagaaaatgcaagctccagtctcccacacatcttactgtcctgagggctcaatcagcagctttcttagcttctattggttgagtcttcttctagttacttgactctatatttttgtccttttcaatctgcaggtctttattaagggcccttaagggtgcatggtaaattcttgttttggatccaggccacatcattgagctcaggtttaacatcacccttcatccacccctggggcagtacaaaaaaaaaagtatactttctttgaaaaagctcctgagatcccagcacttgcaagacagaggcagaaggatcaccaccaatttgaagccagcctgagccatgcagtaaattcaaggttaacctgggctgcatagtaacatgctgtctcataagatgaaaaatggcaggaaaagacttcccagaaagaaaaaattcagaaaattagaaatgctaggctaagggaaagaggcaagaacctgaggggaacagattagccctgttgttttttgtgattcaaaagtactttaaactcagtactttaaactcctttgggaatctgttctttagctaaatgttccttaaaactaaacaataagccattattccttctctgttagccacctcttgttagtgtttagtggtgcttaccatgtgatgggtatggcagttacagagttttcttttgtgggcttttttggtaagggtatttttgttttggttttgttttgctttgttttgcttttctatttcagccattgtctctttctttctttttgaaattatgatgtaattttaccattaccccctctctttccctccaccaaaccttgccatatatcaagtggcctatggttgtacatttaaaggggatcgggtgtctcgatcttccattctgtacccacttgaaaagagctcagttcccttaaattcagtccaaataaagtgaatttctcatgccaaatactcacttacttctaccttcaaagacagaaaagaattttttagtaatttctcctagaaagattaagacttacatgattaaagaaagaagaaaatgttaaattaagtaattaaattcaaatgagatcaaatggggactaatactagatgcatatttgtgtcctctgagcaggaggcagagacatgttggcactgagtggaggcccctttgtgtatgaagtctcttggcatgaaaatactctagctgattcaagctatctttgccaaaaacccccgctagctttctggccaagtccattcttatcaggagcctttgttcttatgaccaggtgtaggcctcaggcaaaggataaaacaggtaaaaatttgtcatagcctctcatcttatcatcagtgtggaactgaagattaaggagttcactggaatatgaagggagttgaagccatagatgatgatgttgaataaagaaaaaataaataaataaaggacaggaccttgaatgatctgtcttgttctacaaaccttcagtgattacctcctaaaaggtgcttctagaattacaaaatataccttggtggagaatggaagctatgaagaaaaaagcaggtaaagaataatattcataaaagtaataagagaacctgacatctttagtgtccaaaagccaaaggaaagagtatatactatggaaaagcccagtgatgtcacatgagcagttgatgtctgacaggaggtgtttgagtctggcagccaagtttacagttcaagaaataattttaacaaatcagagggactacagaattagatcttgaaggggaagttctgctttcattcagagacaatgaagttcgagtttcaagaacattgatatgatgtgtagaggcgcaatacgggtaggatgatggaagaattaaaaatgaaaggagtggtgtttggtaaacagaactgcctatgattttaactgaatatgtgttgtatgatttttcctttggaagacatgaacaaatggctactcacttccgcatagagccaatgacaggccagaacaacaattccaccaacactcatcttggcaaagcaatacgtttattggggttatttacagtagtatgagtaagcaggtatttacagatgcgtgaataactcatctgcattgcagatcaaagtattatagtatgtagtacatatatgcaagtgtcagctgaaagcaggttgctagataagccaatggatctgaatctcattaccagagctctaatctcggcctctttcccttataaatggtgagtataagtcatggttaatgccctgtctgttaccgcatacatcatttgaagaaagaatggtcattgtatcaacctcaaggttgctaggagagtgaattaaaacaatatatagaaagtgcttgacacagtgcctcgcacagagtaagcagtcaataaacgtgaggaagtcttcatcatctacatttccccttaaataaggaacacttattcatgtgaaaagcacagtaaaattagggaaatagactatggatggtaaaataagaaaacaagagttaggttaactatgtcataaggaagtacaagttgaggtaagaaagagatagcaaatggtttgagttgccctattaaatttaccaaaataaatttcttccttccttccttccttccttccttccttcctttctttctttctttctttctttctttctggtcaatatacgttctttctttctttctttctttctttctttctttctttctttttggtcaatatactttagttgaaacttcctccattttcctccacctgttcccacaggtagatactgaagcatagctatgcacatcagacacacacacacacaaacccctgagtgttcttggtaacttactacagatctgatataccatacttatttccctaggtacattttaaagactatttccacacaaaaacctactagcattgaattggaacaattgtagaaaaaaaaaataagtgcagaaattcctaatgccacattcctctaaaattaatataaaaaggtgacatgcctttacatgagttaattattcagtgtactgctaacatttatttatcagtctgacatgtgttgatgttgtgcttatatttatcaccagaaaagatagctgacttgagaaaataatataaattctaatagttgttttatccttgtatctctcttgcagaaatattgcattttttcatatactatgttcaacaattggcaactaattaaggcatatacatttttagaatgtactacaataatatatacaaaaccaaatactgtgtctctgtcttcaaatgatgcatattttaacagacaaggcagcagcctagacttacactgaatactacaagggaaaggcaggtcgttgtgcacagtatacaaaaattccagtaaaataagggagagagacataagagtatgaatattaaaataagaaaacaagagttagattagatatgtcataaggaaatacaagttgaggtatatgacatatcaaaagaaaatctggggaaaatagaatcagttcccctaagccaagatgtttcagaggacaaaagaccagggcatttcctttcttgaccaacaaaataaaacaatttagaacccactgaatgaccctgcttctctaatcatagcactgacaaatcagctggttacagtgatcgaatatactatatttccaccaaagacatttattaagtgaaaatgataaaggaaatgctgtctgttaaagtgttctgtgtctttgtttttcagagagctgatatagctgttgctccactcactataacattggtccgtgaagaagtcatagatttttcaaagccatttatgagcctggggatctccatcatgataaagaagcctcagaaatcaaagccaggcgtattttcattcctggatcctttagcttatgaaatctggatgtgcattgtcttcgcttacattggagtcagtgtagttctcttcctagtcagcagatttagcccttatgagtggcacttggaagacaacaatgaagaacctcgtgacccacaaagccctcctgatcctcccaatgaatttggaatatttaacagtctttggttttccttgggtgcttttatgcagcaaggatgtgatatttctccaaggtttgtttgtgtgtaatacagaatacctgcttgtattttgtggtcttactgccctcatgtccatctggtattcacctgcatcaacttcagagttctttcatttaacattccatccaatgacaaattgtcatcacagcattttgtgtgcttatgtctacgaggtgagtgtgtcactggcgatgcttgaatgcctaaggtttgctacaatgctcatagatacccagattctggatacagttaactgctgcataatattcctatgaaagtttcctcattaattgaactgaaatatcttcgcatttgccaaggggctaaatctgggcaaaatgtgaaagaagatagagcatttctttaaaccttcccaccttcccctattagtattgcccttctcattgtgctctcagtctgcctacgactatgcaagcgtctactcaagtttcttagctaaaactagaaaacttctcagaacataagtacaaaccttaatggtgttgtcatatttgaaaataatctggccatttgttataaagttaggccgagagtgaaaatgtgacaaaagaattttactgtcatttatacccccaaagcaaaatgtatgaatgtccatagtatctttagttgtaatagacaaaatatagaaacaaagcagttgttcagctagtaaattgataaagaacttgtagcatatccattcaatggaatactatttacttaagagaagagattactcatgcatcctaacagtacagatgaaccttgaaaacataatgtcaaagtgaaataattcaaacacaaaatgccaaaccccactccactctacttgttgaatataccattatagagcatcccatttgtccccagtagacaaatctatagagataaaaaggacaattactatggacatagtttgaaaggagaagaataaaaacacagataacaatagtgggattaaagtctggcaagtttgcttttgcagaacaagtccaagagtcagaaacaactctgatttaagttttttatgtcttgttcattacagaactttttctgcttgcatttttaaaaagaaatacaccaccaaagtgtcatttgttccaatgaatgagatgttgatacccacttatattagcatgtggggcaaatgccttacttgtctcatccttgccctaaacctgctggaattcattacaaatcctgatattttgatgaagggtgatataaaaccatttcaaaaaatggattgtgatgatggttacagagctctaaccttactatgcaagtatgagaacctgaggtcagttagccaaaaccacataaaaagccaggcatgactgtatttgcctgtaatgccagcattgtggggtagagagaagcaaatcatgagagctcactggccagtcagcatagactatgcttccagttcagcaagagagtccatgtcaagtcaataacatgcagagagacaaaggaagacaccaatgttgtgctttagcctttgcttatgaactcccatacatgcgccagacatatacaccatacacacacagaccaccacagcacccacaaaacaaacatgtacactaaaaatatgtttaaaacactgtaactgtggtcaaagtaagcattaatccaaatgctgactagggtcaatactataaatatacagggattttcactttgaaattaaatgacttggggctgggaagatataccaaccaatatagtggttccttttcaagcatgaggacttgatccaattcctagaatgcatatcaaagctaagcatgctggtgcttgcttataaaaccagtgctggacaggtagacataggtgacccatggtgctcattgggcagtcaagactaatttgtaaactgtacgtgaataatagaccctgtctcaaagcagagggtgggcagtatccctgaggatgatacccaaggtcttcctgtcttctctacatatactactacaaagacaaggtttcagaaagataataccagcatatctttgtgaggttagccattgggtgcacaaaacattcacaataaagctttgcagcataacttttgtagtatagcagactttgaagcatagctatcttcaccagcattttagaattgtgtgtatcaagcgtcatgcatccaaactactccttcccccaacttctgttaaaaagaattgccaccttcagtctgcttggttgggttcttcaaattatttcacgtcctgttccttttgtgttcagagtgtatcattttgtgatatcagggagttcacttgatttcctagtttctttggagggttgagaaatactcactttgagagtctatggcctctgaatgcatctatagctggaagatttctaacatgactagtaatctgtgctgaggccatgttgaagagccattaaggccagagattttcctggtttctgtaagtcaactttcaaaactacatttgtgatattccctactgtgatacatacttaaacaggtttcttcaaaggtcatttgtttttacaaatatttactcatgttacttaattaaataataactaaagctgatactaaaaacgacaagttagaccagctttgttttgttttgctttgctttgcttcaatttctggtggcagaatttaagctatgacttttctgtgatcctgaaatatagcaaatgccttttctttccaaggtatagattttattatgttgctcaagatgtcatcatatagttcaatggcttccaagtttttcaccatgacccacagtaagaaatcctttttccatcttgattcactatacataaatttaaaaaaaaacaaacttataccagacattattgttacagtattctgtgcacaccaagatggttctatcctgtttaatgttcttaaatctaatcatggttcaactcactaagaagccaatagcacacttgtttggtataacaactactatttttattgcactttcgagtgagaaatcattgcctccatgagctctatattttccaacctataagtgatcattcctctgatactatcttttgtgtcctacaaaagatgtatctataaatcttttattaaaatgttatgcttcctagaatttgtatgacattcctctaagaaagaaacatgtttctctttgtcttgagagttctattgactatatatgtgtgatcaactgtgtatcagtcctgcccactctaatatatttctctattgacctatttagaaagtcctgccaatagtatagtcgcactgtgagatgtgtagctgcctttactgaaagcgtcagcgttcacttattacacttttcataatgaccacactcagaatacaaactcttcagaaagccaagaatgtaagatagactatgcaatgttactttcatcaaaattgaagtaattcaatgcattgtccttgagattagatttgaaaatacaattgactaggattacaccagcaggaactatcagagacaattcagtctaacttgccatttcccgagggaaagtacaacagccttctctggtctcccactgtggacacatggataagtaatctatagtctcccctgaatcatactctgtaaccatttccacagtgtaggtatcatgcctacttctaagttgaagaaagtgccactggttaaataattagcccactcacactggcaatgatacccagatctcaaatctagttctgattgcaaactcttgttctttctactatgtgctgctctgttcatatcttagactatagtcattcctagagagctgacacaagggaatccatctttctggagatttttaagagccagcagttcaattgcttccacaactccttcacactgccaatctggaggagcacggttggtttcctcactttcttcatgcttggaaacaagaactgttttcctatttctatccctaaagaaatgcagcacttgttaataaaagcgggcagtgagcattcataatactgcagagtatgtgcgcactcagagcataaggctgcaaaatcagcactaaggcattacgagaaaaactgctggcatcattccattgccatccaatgcagttattgacagttagctagaagcttcaagattctgcattgatattaggtttgatatttgaactgctctaattgttccaagtgaattactttgttttacatgaagctgttggctgagtcaacgttggagaagggaatcaatgtaataagcccaggctatattcacacatcaactgatttattgaaggtaaagtccagagaaggaacaaagacaatcagtttaactctctccatcctgaacgtgttctgggggacactggatgggggcatccagatggagagagcagagtgattgaacaggaggtgctaaagttagcttctctgaattccagtctgctcagcagttgtgtaacctggggcaacttactaagcttagttaaacctcagtctctcatcaataaaatgcaaagcacagctcctggcctttgcgcttaataagtattagctattgttattatgaacttagattcttcaaatcatcctagtctagtgtatataatagttaatactgattttggtcggagttcctacaaggactgcggaatctagctgaaatgctgatccatagcaaaagtccaagagtctcctgaaagacaagaagcaacattccttcttggtgccacctagtgcttttaaggattacagcccttgaaagctctttgagtgcaatattccataatacgtctctcacattgacaagaggttatagcgttttacaatctgaaatgtgtttcttttgtgaaactttgatagagccacttgtgccatctagagtccaaatgctcagacaaatgctccccctgctgactttctgtgaagctgcagggacaactcaggactagccaagtagaagacataagggtctggagaattaccaaagggaaaacttaaggacctcaccattgggcaaagattactccaaatgtattttttattaagtttttaagatagcaagtccttggaagaagtaggcagggactctttcacagttatacatgagtatagatcctcctttaaaaggacagatatgtgtagaataacagaaggtgtgaggggtttgagctgattttaaagaatatccttcctctcctgatatagaccactctctccatcctaccgccaattcatttcactatagtagtgatgtggtgatatataataacttaaaggcagggtttttatggcaattatttcacaacttcagctgaaagctgtggttttcagtctttaggacctggtcacttatttccatcagagaagattgtaaaaaaccaagattgatcctatacatttttaaaaagactctatcatagtcccagcaatgaatggagggatgaaatgatgactatgtcagaaacagaaaggaggaacaataaagaaattggatgaaggcagaggctttgtgtttcccttagcttcgccatctcataaaactaaaatactgcagattacaaactttactaataggaagaaggttatggtctataactcacttttattggcatttctgatgtcacaaaatacactttgctattaatgtaggaactccagtttcttattattacagttaaaaagaacattgctatttgatgtgtgtatttggcaacatttttctatgtgtgcttttttttcttttgttaacaatttattttcattaacttcatagctcttaccattccatgaaaggcatgacatgcacactattttgtgtttttttttaacataagtgtgcagcattttacagccatttcattatgctaaccttgaaatctgtcttgtgcaacaaaactacttgaaatgaatgttaagtatttttgcagctacattaatggaaagaaaggtactgggaaatgatgggtctttctaattcaactctaaagtcttgtctcattttaatagaccctttacaaaatgtgacggggttgacccatcagtcacgttttatatagtctccatgtaaaatgtggccttaagtggttgtagtttaactaatgagaaaagggaaaatacaaaaatgcttgtggagcttcttccctgtgggttccacatttttcttcagtaaaaagatttaagcgtgcatgccagaaaaatggaagaggaagatagaaattccgctcaatcctttgtcaaatctgctactgtcttgaggagaccatatcaaatgcaatctcctgcattctctactgatggcagcaaactgtttaggcttgtaaagctattgtgtccgttttatagagatagtctttcaaatttgtcatgcctatccataccaacattctttgcaacttaatggattggttccaagacccctgccagatactcaaccctgcagatgctcaagtcctttatataaaatggcacagcatttttgcatataatgttcctgtgtacattaaataatctctagatggctcataatatctaaaacaatggaaatgctatgaaaatagttgttagactgttatctggggaattgtaaggggagaaagctcgtatttactcaagacaacattttcccaaatattttcagtgtgcagcaggtcaaatgtgtacatgtggaatatgaggatgcagaaagctgactgcatgccatgagattaaccacataattgccaaagtcaataaccaggagacaagaggccacaaaaatgaccattttgcacttaggtttattttcagtcatgtcaacagccaatctcagctgagtcattctgatccaccacatgatgatctgactcagtattaaggtggccacaataactagattatgatatgcaggcctgatttaaaatcagacagacatagccacagtccattagcctcaataaaatggcacaatgtaatttccataaattactgtgttttcctccacatttcaagcaggcaatgcataaactgccattagtattcacagcataatatacctcttcccatatcaaactccaattctggaattacgccaaactcaagcttctctctggtctcagccaaaccacattccacatcaggaggacttttacaggtacagtgcaaataaacaacaaataacaacacataatcatgatcggtgtgactgcaaaaaaaatctataattttcataccattctgaattttcttatccaaaacctagttattttcatgatacaaaatatttgggtatttttcttcttagatgtttttacctattttttcattcattttttagtttcatttagtgtgtgtgtgtgtgtgtgtgtgtgtgtgttcaataccatgtatgtggatgtcagagtataacttttgggagtcaattcaatctgtccacatgtgggtcacaaggatggaaggcagctacctacctatacctaccacatcatcagttctggaaagctctttcgtagtatgaaaccacaggcaatttattttctgcttcgcctttctgtgcctatctctttagttataaaactccttggtttgcttatctctagtacagtcctgggcaacagagatgggaggagtaaaaagttggtacctgtcaagcaattagaacagcttactgcaaaggaagtgttcaattagtgacagttttagttttatcatgtttactcccctactgctatggatgccatcttgaagcattaatattctgtgcaataaagttattttcggagtgagataagtctatgacatgtttaaaaatttggatatatcaagcatgaaaatatatgaaatatctacattcttaaaccaagtacattgtatacttttagcattgggaagggtgacacattcttttgtgactcatactgatgtgttttgattaaaagagaaattttctgagatgcaatgtagtgatgtaactaatagctagaagataactgttgtgaggcagattttcacatcaaaaaaagtgaaagtgattatatttgactgtgttttagttatccagagaccaaccacaacttcagacttaaacataatcaagtatagttttaaataattaatcaataaatagtactttatttatcaaaatacttgacagaattctcaggttatattcccataaacaactggattttccacatgctaagaaaaagggggttatcttggaacaccggaatttgaattttaccacagaattatagtacatgcagagaagacgttgatttgtcagttctcagcccagaactgccctcttcccacagagtctggagatgtgtgaggctcctacacttcttctgtactttctagcagagtgggagctctttctgtgagattttatgggcatggaaaagcacagactaaccagggtggagcttttctccacagtagaactatacagaggatgatgtggcaatatttttataaaacctatggagcagatttgaatttctataaaccacactaacctccagcaatactgcaaaggaagtgaatcccaatcttaatcacaagccatgactgagcatccattgccctctgacttcccacagtccctctccatgagtagcacttgtgatggagggacataacttacaactctgattataccctaaaacttttataaaatgctggggcttaggcccaactcccataactctgatctaacttatctaggggagattttaggcaaggatttttctcttgttttgctgtcttttgtttgtggggttgttgttgttgttgttgttgttgttgtattgtgctgtgctgttgatgggcaaagttgagaattgctggtaaataacaatgttcatttctcagtttggtacattcatcacttgcaacagaatcacctatgatgcctatgaatcacatactcttggacatgcagaaatcctgaatctattttttaccaagatgccccccttgccaatgaacagtagtactgacaattttttttttcactttacaatttatccatctgtggctatattccctaataattggattaaaaagttgaagaaaaataattcttgttattaaaacataccactttcctactaattgaatactgttagaccaatttgtgatgatttgatcaaggcttcaaagaccacattgaaggaagttttaacagtaagaaatatatcgcagaaatccagtggtggttcatgcctttaatcccagtgctcaggagtcagaggcaggcagatctctgagtctgagtctagcctgatctatagagtgagttccaggatagccagggctattaacacgaaaatccctgtcttgaaaaaagaaaagaaaaggaaatctatggtaggacagaaaggacttttttgttttaagatttaggaaggaaagaagagactaaacagtgttttagtacctcccccaaactgtatgatgtttcctacttcagttaagcctgtccccagtgactaagagtcttgtgtgaacagaaaatatctgtcctcttgatctgcactaaccatttatgtgaaaaagagaagaaaccttcccacttggaaatatgccttatggtgaccaactatacaaaacagccatgtctgcattaacttttggacctcgagctaacaatgctaatttgccactatgttcccatttccctctaaagataaaaaagatttaggatcctgtattttgcgtgacatgactttatgtcacttgttccctacattgactacacagataatcatctgagcagaattaaaaagtccagatatctaggtttctccacctgagttttgatttaattgatcttggatagacagtgtttaattttctgtatgtgtacccagaaaaggtcatagaaagtaaatgtaccatgtgaaaatataaatgagaaatggtaaaagaaagattttttatgtgatttaaaaagtttgattctaaatttgtgctagttttgaatcactgagacaaaatatcaacttcaaggaggacaggtttcctttggctcatgatctcaggatttttagcccataagtacttggcctcttgctttgagcatctgctgaggcaatacattatgacaggagcatgcggctggtgagacctgttcacgtcctggtagccaagaatcaagagagagaagaaggactaggtcccattattcctgtgacctaactttctcaagctaagccccacctcttaaaagatctcatagcacaacagacagactagcagcccagcttctagcatatgactgtttggaaagaccattgagatctaaactagagaaaacctggagaggcctaaagagtcttcacatgtgtcatcatcatatgccatcatgacatcgcattgttaacccatgacttctggctgatgttttgattccattgtatcatcaacttctctctttcgtcatctctaataaaagaatgcttttctataaagaaagactttccccaattatggtgactttttaaaattgggatctgggccctctgagtctggacttcctttgttttgttttttagatcactttctgggcgcattgttggaggggtttggtggttcttcaccctgatcataatctcttcctacactgcaaaccttgctgctttcctgactgtggagaggatggtgtcccccatagagagcgctgaagatttagccaagcagactgaaattgcatacgggaccctggactctggttcaacaaaagaatttttcagagtaagtactttgttgttagttcagcctgctggtttttatttccatttcacaaagacaaatttgcagcacttttaagtgaggcttgtaggaaactttatcaaagaacaatgtcttaaatactgtgctgcttagttgtaatcggatccattgtccattagactcacgggagacataacaggtgagatgttgagagcactgaatttgaactcctagattttaatttcaaccctgctataaagtgaatatttgttcttgggcaagtcacttaacttctttagacttttgtcctcttacttgaataattaggggattgatctaaataacgcctcttctttctagcttttattaaaaaaaaaaacaatgatttttttttttatctcagtggttcatacaagttaggcaattaactgtaagactctgaaaggtgatggactagaagaaattatatattctattttagacttggttttctactgaaatgtattatcattgttccaagtatatacatgatgataatgttgttttcaagatactttataattgttttcatttcttgaatagatttgtttcatgtgcaccctaaaggacaattcttattaagaaaagagaagttattcactaccaaaacttagtaaagctaagctacataaagtgcactgccattgttaaaaactcaaatttttagttgcaccggcaaggaaaaaaaggggtgaagcttaatttaaattagaaaatgagtccattttatattgtgccacagccctctacaaaagacactatataaatggttgacaccatggagcaaaagtcacattagtgtatatagaaaaaattttgtcactctctctaaccaataaacatgttcctggatggcagttgtaattacagattttatctcaaaggtccagagtaaacagatgtctctaagatgacttgttttaataaatcagtaagcaatctatttctatgagctttgtcatgagatttttatggaagactaggaggagtgtatttcttgactttatagcaattaactaaaacctgtttttactccctgtatagcaattaactaaaacctttttattccctgaaggatgggaggttagttctgggaccttttcaagaattctctatgcctcgtgatagccatacctcacttttaccacctgtttacagagcagagcgttatgttcaactaaggttaaaaacatcaaaagcatgttaggttggtgtctcctccttctatgccagtcccagaagcttatttaggagcccctgaaatcactcacatgtgtcagagctggaagccagggatttccatctgtcatgtactgaacacctaatcagcaacttggaaatctgatttggtactaaccttcaacagagcttctgttcaccatcccaatagatatctagtcacaataagaattaattgaccatttaggacaccaaaaaaaaccaaacagaccctctggtaagaggtacttgttttacaaaaaagcgtttttccttaaacaatgatacaagattagggaggtgtgtgttaaatggtaatcaatacatgacatcaattcccattaagctttcaaagtccatccatccatactgtaggcaaaggggctatttctaaaaagatttgttagcggacaggcttgaaaacatggtcatacaatcattgtgccctgacttcatcccccatgtactttgtgcctatatctactgatccaaaggatgatggttccattaaagatcatcatattgcagctgatttgaatcaacattgagttctgaacaaagttactaccccattctagttggctggtgaattctaatgttcacacattcctagggacctttgcagccaatgagtatttcctatggaaatggagctgttttgaaaatctgattagaagcaggcagatgtaatgaagtgcaaatcatttctgatcccctaaatgacactttttctttttccccaagtagtcactagtgacatcattaagaccgtatggtagtccagaaaagcacataaaggttgttgatctatgagtgaaatcaaacagtgcagactgaaagtattctatgagtgtgacaaagagaatgctgggtattcatataatccatcccacctagcctattgacctgtatgccactttttctctaccccagccctcagtgaactcaatgcagcagaacaaacaacctgaaagaagaaggatttgatggccatagccatatcctgtcatcttcaggccctagttacttcaaagtagcaaggaaattttaataagagccccaaacagttttttaagaaaatggagcactctgacagtatgccttctggatattagacaatgaaacaagaccacatgaagtcttaacaaacataatacgagctcattttcccccttttactcaatacgaaaaccacagagatcacctagtaataacataaagcagcctagggccagccctcttgatcttccagtatgaaaaagaaatgaattaaatgaaattcttccctaattgccctgtagacattttttaactcatcctaagcaaggctgtcactaaaatgatgatagtgtcaagtgatccctttgtttgttccattttctaagctttccctagctgtcattttacattcacataaaatccatgaaacagtgggacctgtcccaccaggaaaggcaggaaggaactgagcaaagtgcatgcaggtggaggagacagctggaatattcccatcagcactctgaacttgaaaactgatttccttagacagcggctcccaaccaaaggtggaggcacacatgctaaaaaccaagctgacagctttattgtcacaggccagggaaatgccactgtgatgtgaaaagctgcaccaaagtaatcattcttcagtcctttttggaaatttaatctgctacagatttatgttaagaaatagtactgcacagaagaggcagttctaaaatccctgccttcagacctcctcaagatagcttttccaatatttggtaaggttgccattaatacagattcagggctaaaaggagggatttttaaatgaaatgtttaaagacgtgaatgtaggagctgagaagatggcttggtcagtaaactgcttgctgtgcaaacatgaggacctgagttcaattgccagcacccacataaaaagccagatgtggtagtatgcccctgtaagtccaatcctgggtaggtagaggcagacagaaggaaccagaagctccctatccagccagaggagtcaatcagtgatcttcaggttcaatgaatgactgtctcaaaaacttaggtggggagcaattgaagaagtcactcggcacaccctcgcacacacatgtgtacacacacacaaatataaaagtagaggactacaatgaatgggttctttcctttgtgccctaagatatacaaaataacggaccattattattaggaaaccattgagggaacttctttgttctgaatagaacacattgtaagtccaaaaaaaccaattacttgtgaataaggtttttgtcttaaaacaacacctattgactgttttgttgtttaaaacatttttgatgcagtaaatgaaaaatagaagtctttccaacgtggatcaagtattctgctaataatgcttaagtcagcttccacattcagaaacacactaacaaggatggaccatgtagagactgccatatccagggatccaccccataatcagcttccaaatgctgacaccattgcatacactagcaagattttactgaaaggacccagatgtagctgtctcttgtgagactatgccggggcctagcaaacacagaagtggatgctcacagtcagctaatggatggaccacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaatggaaaaaaaaaaaaaagaaacacactaacacacacacacactcatacatttcacttggacccacatttcttcagtatctgctggttgtctacaccatgactttttaagtgcatgaataaaagagaaaattccttctgagtatacctgcaccaagtatgttgacattttgagatgattgggaaaatgtaccattattctctttgactcattttacttttcctaatgttaagtagcacatcaaaatatgaaaatctttttattaaatttcttgtcacttaatattatgatgcaactgaagttgtgacacacaatgtatctgggtggattcagccagatgtcattagtttaaaaaacacaagttggaattggtggtatatatctgacatgctagcatccaggaagctagggcaagaggatgactggcttaagaccaacctaagcaacacagcaagctcaagtgcaacctgggctacacagacattgcttcaaagatgttgctaatgcttgagaatacagtcaagccagatacaaaggaacacataacaaaaaaaaaaaaaaaaaagaatttctgcctcatactacattagatagcaaaggccatgagtaaacctaggtcaagactggagatggagtgacagccacaaagtgatgatgctaaggcctccaaaaagagatccacggattcactcagagagcttcgttgcaggcaaggagcaggctgtatagagagaataacctccaaaggagcagggattgacaaaacaacttaagctcacaaccaaagcatatctaacatctgagttcaagagacagaggaaagtgtgtcataaaagacaagctagtaatagtactatacattgcattatttgttcatcattcttttagccattctccctttgagatgttctttgacccaagctccatgctaagcacagagaaaccatacatctctatagacaaaactgaaatccatcttcttgtcacatcacctgataatatccagacaagcttctctaccattgttgaaggttatttgggggataaacagacgtacacatagatagctgacataattatctgagtagatgacgatttccctcctctcaccagggaaaattattgctacttatttttccagctctccagcacaaagcaacatgtacaatatgcttatagtaactagaagcagggacactagttctcgatagaaggtcttttatcctcaactttatctgtcaactttcaaaacacagttgtatgttaccatgttgcatccacacaacagccctacaatggaatcataacaggagttattttatctataatatagaagagaaaactgaggcatgacagcattgtgacttgctgaatgacacccagctaatgaacaacagctggaactcgcaccctaatactgcaagtactcattaagctctgattgattttcaggaaccagcctctactgaacacctgctcagcatctgcatcatctccttgttgggtttttttcacctgccttcagtagagctatcttagcctggtgcatgcctaccatcctacatcctacaatcctagcacttggggaactggagtagaaagtcacaaacttgaggtcagactaggttatatacaggatcctgtgtcaaaaacaaaactgtaaaaggaaaagctatacttacggaagattatttttacatcctctgaccacttcaaatggatccaaatttggggggcaaagaaagggaagacatttataaaacttgaaggaatgctgtaagcacaataaattcctaccattgcatgatttgttttactctctaacatgctatgaccaacagaacgaaactgttttcagttctataccaaccaatcacttccctatgtttccttaaaaggaggatattgctccttagccttcaaatttgctaatggtactagtccctgctctcctttcatcatgaggtaggtgagagaataatatcaccaaaaaaggactttaaaagtatgaagggttctataaatccaaggacatagtaagagaagtcccccagatagggcaagtaaaataaagtcactccagaaaagtctctgtatagatctgaggagtgtttttcaaacgttataaggaaccttccatgctttctcagtttaaaaaaatgtattttttttctttctagtcttgtgaggttgggggatgttcatttgtatctctctccgatcctctagttataaattagtactgaattcatctgctaggcagtccaccattagccattcctttgtggcccacagattcaacaacttcaacatgcatgatttagagctgcccttgaagaccacctagaaacttcaggtgctttcaaggtggcatgcaggccatctgcccaaagtacccaaccatatggatgttattagcctatctctgttcaccctcccaggtaacctacttgcttatgagagcatttcacagcccagaaagcctaagggggttagatctcagctctccttgaggctgccaactctctctgacaacatcagggtaattaacatcacacaggactcccagatctttgtgagaactctgaaaggctcttccctagaattcctctcgggagctcactttctgtttttcatctgacaaagtcaaatcatctgatagccttccagttaaaggaaagaggacccatctgttcaattaggctttccttaggttcacctggcaaacggacacagattaattatttataattattccttgtcaccatgtgaaatcctgaagacttgactgtaaggatcaatatttaagtatactcaatctataagaacaatgaatttgaatgcttagttgcatttcacctttgaaaaagaaaagacaaatcctgaacaaaacttgtaattgggttttttttttcctcaaagcaagctactatgtgacattctctggtcttattcattccattcattcctatcttctatgtttttcccagagtaaataaatactatctgtctaccatagcagtggaggcaccagggaacatatatagaataattttaaggactgctaagggctctaaggtacaatggagaacaacttatgattagatatgactgttttaagtgaaaacttgagggtggaggggaaagtctctctagggagttaatatttaatttaagaagagaaagtcatttcttggccctggcattaccctgtactggggcatataaagtttgcaataccaagggtcctctctttggcagaaggagggtatagggaacttttgggatagcatttgaaatgtatataaagaaaatttctaataaaaaaataaaaataaaaatgaacatttttgcttcatctaatgggaaagtataacaaatatgaatttgaaaatgaaatagggaaaataggaaatgttttttctagtattttaaaatttcattatgaatacctcaaaatggtattcagtagccaaagtcagatcatatttttcttctcaaggagcttttagtgtgccctaccttcaacctaggttcttatattgttataatgcttgatacgttgtctagtgatttctataaactactctacttttcatttaaaattttatcctttacatttgcctatgaatgtatcacctctcagaattaagtataactgttttataatcattataatttgtctttaatttctctgaacatcacataaaaattagagaatttgatggagacaattagtgattatgcagttggatcatagtgactaatcagttaggagatctaacaaaggagtcgctcacatgtgttcatcacacctgtgtatttttcttataaacaaagttttcacaatcaaaaaaaaaaggaagaagagaaagtcgtgtgaaagtttgacagatgaggatttaaaacaggaagaaagaggaaaaaaaacaaaacaaaacaaaaaaaaccaaacaaacaaaaaaaccaggagcaatccccagaatgctttaggggacaggaagaaaataaattttagtagtgaatttacagaatctgctggtggatatgataattgtggatgaaaagatccagccaaagatggttatttacttatatttctttccaatggccattaatgaagttttaaatgctatattttttaatgactcaaacacttattaagttgtcataataaagggcaaaaaggcatactagaattgaaggatttaaaaaaagctgcctacttaaagagaaaattctctctgctgcaacctttgttttcatattacaagtaatctagcatgttaattggtctataatatctgttcttattcaagggatagggagttagaatcatatacatgtttgtaatgtataacgatcgaatcagagcaaatacattttccattgccctcaaatatcacttctgtgtgtcagaaaactttaaactcttctcatctgcttattttgaaatctaaaaataaaacatcaaaaatacctcccctaccacatgtacactgtattttgatacccatcacccaccctcttgtatagaactgcttatgtatatgtatagaaaacagggagtttagaagtgatttcaaaaagttatctgtaaaagatattactgcattgaaacaattatagtaggaatcaatatatagatttccaagagaaaagtgaaaatcatttctcaagtcaaaaatcctctaaattctatcttagttctaatttcatcatttacatttaatatatgaaaatgaagttcattaaaacaatactctctgaagaacattttacattctttaaaatgagtctgaagaactgacattaaaaagcaaaatccatctaaactttggcaaatagtatcaaatgcagtaaaatttcatagcaaacgtttttatatttaaatataactccattgcattaggcattgtttcaaagaatataatccctttccttaacatgatatatatgttacatatatatacatatatatatatataatatattttgatacccatcagtatgaatagagtaaaagcaaagagactcagattaaagccctctcccacaaaggtttgaagtttgattttaaaatgtttggatcttgccacttaactcagatgaggccaacagaaagacacattcacacatacaatttggatgcttatgattactatatttattgaagcctattatatattaaaatagaaggaaggaaaatgccctaccatcccaatcctaaagggtacttccactccattttctcagtcttggatttcagccaatttcataaacaatgttaagaataacacagtcaataaatcagcagtctagggatgtgactgagtggtagaatacaggtctggcatggcttcaatctccagtactactgagggagccaagggagagggtgaatattgaggataaataactcagaatcatggaaagttgtttaagagaagagatagaggcttgagggacatcttcagttttagagctgacatactgaagacgagcaaaagctcctatgtttcactgatggccatatcagcaagcactgctatctggaaatatccaacaactaaccaaaagggactggattacagcttttagaaattgtttcccaacattacatttagacatgacattcagcctaaagaggcataagcatataacaaaaatgcatagtaaaacttatcttcaaaatttgaaaagtgagcatttgaataaaagggttggacttgttctgctggacattaagcaacataaaaatgtttaaaacataatgctcaagaatagatatttcagagaaaggtagaagaaacattctaatagaatggtggttcttaaccttactaatgctcagaccctttaatacagctccttgtgttgtgatggcccccaacaataaaatttctgttgctacttcataattgtaattttgctattgtaattaattgtaataaaaatattttttgaagatagaaggttgccaaagagattgtgacatataggttgaaaactactgcaataggacaatccaaagagaaaatgactgtcctcatagtgagtcgatcatcactggcagtcttcaagaatagattaatagccaattgtcagagatgttgaataagagactctgttcgattgatgtttacatgattgctgcatataaaatcacttgaagaggtattttattattctatgttattttattgagatacagggtcttgccatgttgcacagcctagtttcaaagttctgagattaaatgaacctgttagctgagcctctcagatcttgaaactacagcttcaagagatctatattgctttttggtttttgttgtcttgttttctaagtgaagacatcactatataaccaaggctcatcttgattttgtgattcttcagccttctctccaaagtgccaatagacatgcatcactgcaccaaactttggtgctattttataatattgactagtatgtcttatgtctcccactcaagatgcaggtttctaaatacagacctctgtaggaaattccaagaaagtatatctggttgcaggctgaacaagaagacccctagaaggtgacaaatgggagaaaatgaaactggaactgaataatgcccagagacctcaattttttttttctaactttgacctacctttttgtcctatgatgtaaataacccccttccctttccattgtgcttttactgaatagttcgtgcttgatcaggactgttttattaatgtctatatggaccatacagggagccctgtcattcaattttcctatcctgaaagactattatagtcaggtccaaacactggttacctaattgtgaagtgaatattgtcaatcattatgacttacataatagcatggagctacaggaatttctgagattaaaatgaaactgaatttgcagatacaagagcctggaaactcctccccacacatgaaaacgtttgccctttgccctaatttcctttaaccgacctttttttctctttctcttcatccttcttcccctgctgaggcttgagtggttgtaatttttaggttagtggtttttaaagagacgtcaggaaactctttctcaaccatcattacctagtttgggaaactagacaactatccttagatactggcagtgtgtaaaaacagaagccatcaagtctggaaacaaaggtccacaaaatgtttcacagaaagagaaaatgagccacaaagtgtataatactcaggaactcggaagtcaaagcctacgtagaaaggctgacctaagagcccttgctcctattctttctccatgtagcctgtgggatcttgggcgatcatggctgctgggacagtccatttaatttttaaattaatttgtcttgtggtaagagtcggatgcatgtaccatggcaggtgtgtgatgtttggtgaataacgtgagggagtctgtgttctccttccaccttgttgattccagggatccaattctggtcaccagcataggtgatgggtgcctttacttgctgagacaacttgccattatggtaaatagtgattttacagaggctaaggggaatcacaagcttcaaatttccccagaaaccagtgctaaacagaactggactccacacatgatagctcaagtatgaaaatatggttggaatctatgggcaaaaaaaagtcttaaaatgaaaaggcatacaataagaaattataccagcagctttgaattcttagtcattacccaaaattgtctattatttcattaccttttcctggcctgtccttttgtgtaacatttctgatgacacagttctactgtgttactacttcaaggagctctatagctctgagttcacaactcagacagtggtatttatgtaaacatgaatcacatctcctggaatagctcgaaatacagaggaatccaatgagctagggaatatgaaaagaacttaaaagcagtatagaaggaaaaactggaatcaaaacccagaatcgcctgccctctagccaaatgcactggctttatgtgtttctttccatcccttactcccctttgctttgcctacttgtggggatacacacacacacacacacacacacacacacacacacacacacatttagtatatttagtatagatagcagggtgataatagacttccagttcttgagtaggggagacatgctctctagctcagagaccagataacttagccttcatccacacctgtcgccagaggcagttacaagttttccaattagtctagactttacagattagaactgagtatggcatcattaaatctctacaaggttaagtcgaaactcttaatgagttgcaaaaagtattcctccagaaatcattcatacctccggtgaaaatttaaaagagccagttccttctttgtagctttcttttgattgttatcctcacctgacggaaaaaaagctgtgggtagatttttttttaaagccttctatcttcccgatagctggagagtaattttctctctttcatagagaccagatcggtctttgtaagactggtccaatttttttccacattttttttttgttccacagggactcttgttgttgccatggatacctgcccttggcactttggggatgctgcagcgcatccattatatcaagaccccccaccttgaatcactttgtactgactttttttttccttcccaggcaatttatgggtctgtccttctgccaacttaaagattaacaggactagttaaaacattaatgctttgacttccttccaaatcttttcctatacagcatagcttgacctctaccttcagcaatccatctatcagaaaatgtgcaacaaataaaagaaattaatgaaaattattcacattgaagacagattcttccctggataacagaaatcccttaatgtattttgctgtttagagaccatcaagtacttttcagagaaagctagacaagagaattttcagaaataagcataaaaatttgattttcaaaaacagtatgaatccactgtatcactgtatgacatctttttctaggaacttatctgctacatagtataaggaatactctttatctagacaaagcagcacaaaaacggggaagtaagagttcagagatgtttagatagaactttatattgagtcataacataaatgctggcatgtcatgttattccagcagtctaacagttaatcctgggggctacttcatacacaacagtagcattttcaatactttttggatccatgctttagtatatatgcagcaggtaccgtcatggtgctaagactgaaacaatgtgaaacttaacagttctacattccttgattttgtttaaattagtaaccttaatgcatcaataatggcctgttttgcatatctgtttgattgtaccttcttaaagattcatttaaacctggggaggacagcatgactcctacctgcctctcattaataacatacttttcagcaactagataatgaatggcttggatataaatcagtagaaatgcagattgtcattaggtggagaaaggaggagcaatctccaagtaattttaagactgaaggggggtgaaattaacatcttagcaagaactgacgacataggaaggcttgtgattaaatattctgctgtctttacatgtcagacagtgaaagaaacgttatcgtagtagaaatgaacttttgcaaatgacttagaatttggggacttaatgggaaggagtagtttaatcatggggaaggaaatggcttttctgttggctacagattatcctaatggccgagatagtactgtatatgcaactcttaactgtgttgcctttaatgtggagccacacttggtatggcccggtaaggaagatactaatcagtaagtccagctgataaaagtctgcagctggttgatcagagtcagcagagacggcaagcagaagcatcttaaagggaaaatacataaaatgtattattggcctactccactcttctgcaataacaacagataataacattcttgctcaggatttagagggcatgcttttcaagttactgtatttctttggtgataagttgctggcacagaaaggagtgtttaagggaaatgcatttcaaagcaaggactgccaataaattatgcctcaggccccaggtttctcaggcactagcagatacatgaaatttggaaatacaatcctggctttcaatttcctttatttgtctaagtcctttagaattcaacatggctgctccctgcattttgactactgatctttactggggaaaaagaaagaacaaaagatgatagctgcatctacctgaaagtcaagtcaaatgaagtaatagagtgatctggtttgcttttaagggatttcagagtatgaatttattttattctttgatgatttcatatagtgcatttttatcatatactttcccatccactacctcttcccaaattctcctacccaccaaatttcatgttctttccctcttaaagaaacaaaaacaaaacgccactaaaaaatatgaagtccaatttgtcagctagttactcatgagcatgagaccagccctggagtgtggttgacataaccagtgtcagtccattgtagaaaacagatttcctctcccagcaggtatccatagcaaataacatcttgactaggggtgagagtttgtgcctacttcccccttttgtgcagggattttgtgtggcttgaacttaggcttgtcttgtctcagtctctgtgaggtcatatgtgtgtctacccccttgtatctggaagatgctgttgtcttggaattgttcactactgctggcccttacaatctttctgactccacatagatcccaaaacttttaaaggaggggtgtgctaaagccatcccactctaaagtcactcaccctctacatgtttcagactctgattttatttctgtccaacagtgacagaaaatgagcaggcctgaatataaaacaacccggttttctagctgagtctctaaatgacaaacaacttggcttcagctcacaattccgtttcctgttttgttattgttatttgttccctaaaggggtttaacttacaaatctacaatttggcagcatttgttttagtttacggacttttgaaatagcttggtccaagtatctggttactttatgacagcaaacaagccaaatggctttgacattcaacttgcctgattcccagggaattatcaccatagaaaatgttggttctatcttactttggtgactcaaggcaaatggacagctatgaccttaactcaaatgtagagtgagaccattgggtcagagcaccagcggatacttaaaatttttagaagaaatcatcttctaaggtctagcatttacaattttgatcatacacatttcaagctatatagcagagaagttaaaggaaagaactcttgaaaaaagtatcaggggggttttgagtattgttacctgactgctcattgcttaaagagacccagcacaaacaatttaatgcaccaacttccagaaccagagaaagaatgtaagggtggctagaaatttaaatactattctctatattttttctaacatgcattttcttgtataatattctgttcctttgaaggaaattgtggttcttggatagacataataagaatattctttcatagcacacctaggccatttattttcaattttacacaaataggttaagtttaaaagaaacaatttcggcctgtgtgtttggaatgtttgcctgcacagataacacagctgagctttccctagagggacttgccataagcacaggctgcctgagctaatccagagcaacagataagcaagagttatgcatgtccgcttgatgcaggcattgcctctaccatcaggaaaatgttataaaatcaacagagtgcttcttcgtgccttcttgctctactttcccttgacttaagatctaattctaagactcagccacctggagctattgaaattgaagttaatttaagatgaatttaaaattcacttcttcagatgtactagccacatttcaagtagacacttgtaggcagaaactagcataaaggacaacacggttgtagggaaatcaattgcatgacacttctgttaactctttttacttcacaagcataaggaccatgtcttccacactgccatttcctaccacagctagcccagtgcctgatgcaactatgaagtggtattttctatattgtaatgaattatgctaaatttgttattggcagtcttttatttcctcatctcggtaataatgtgaggcaggttctattattaccttcatttttcagatgagaacccctggggcttagtgaaattaactgatttgcctaacatcacacagctaatatgtacacaagtcaactctgtaacatggagaccagtggcttacctagaaaaatgctacatccctgcacatttcaccatggacaggtgaacaacttccagggcactgatgaccacataggtgctcaacattactcacactggctagggaaaaatcaagacatcatgagatctgtatatacgtacgaagactagggatgtaaacaagtctgctggtttgtgtttagatgttgggtatcagattaaatagctatgttgtacttgtctaaatagatcagcaaaaaaaaaaaatagtggattttatttgtcattttgcatatggcgaccattgctttgactccagtgatgaggattagtgcaacacaattattctgtgaagtcacccacacttgctgcatttaccagaaggttctatgggctcccatgaagcatatctgtgccaggacatgcaaatgccagcaaatcaattttcctgcagctttctcagtcagtgtgtttgccagacaaaaccccagccagccacttttttttttttaaaaatcaggatagcacctttagaaataatacttactggaacactcctactacagagaggaagaaacgacttaaatctaaagccagttatttgaaggagaaggtgaaatgtgactatattgaaattgaacatttaatggccccatgtggtcttataaggtagtttttaccaagcatctaggcggccacttctgaatcagtctgtgcctcgctagcactgacaacaccaaatctgacaccatccttactgtcacctttctgcatagaggtcaccaggtgccccagtgttatctacattgctctcttgtgttagttacttttcttgctgctgaagcaaaataactgtccagggggagggggattttgacttagagtacaaagggatgcagttgatcatggcagagcaggcatggcaactggaacatgaagctacgggatgcatggtacccacagtcaggaaacagggagagatgaatgctgcttctccgtccatttctctctctctcttttttttattcagtccagaaccccatgaaacagagctgcctacatttagagtataactcccctcttcagtgacacttttctagaaataccctcatagatacaaccaaaagtgtttccatggtgattttaaatcccatcaaattttcagtaaaattaatcatcgaccactccgtgacatagtcgtttccatggctttcttctattgttctggcacaaattctataacaaaccaactcatacaaattatttttctgttgctgtgataaatacaatgacaaaaagcaacatgtgtcctggagagatggctcagtgattgggagcacttgctcttcttccagagaacccatgcttggttctcagcatccatatgggttggaacttcagctccaggacaatcagattccactggcatccaaagagcccacactcatgaacacacccatacacagacataaacacatatacctaagttaaaaataaaataaattctgtttagaaagtgtcttagttagggttttactgctgtgaacagacaccatgaccaaggcaagtctttttttttttttttttccattttttattaggtatttagctcatttacatttccaatgctataccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacatctgggtcctttcgataaaatcttgctagtatatgcaatggtgtcagcgtttggatgctgattatggggtggatccctggatatggcagtctctacatggtccatcctttcatctcagctccaaactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctaatatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaatggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttggctcccttgtcgaagatcaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatggggattgcattgaatctgtagattgcttttggcaagatagccatttttacaatgttggtcctgccaatccatgagcatgggagatctttccatcttctgagatcttctttaatttctttcttcagggacttgaagtttttatcatacagatctttcacttccttcgttagagtcacgccgagatattttatattatttgtggctattgagaagggtgttgtttccctaatttctttctcagcctgtttattctttgtgtagagaaaggccattgacttgtttgagttaattttatatccagctacttcaccgaagctgtttatcaggtttaggagttctctgttggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaaggatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccgtctggtcctgggcttttttttggctgggagactattaataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtgtagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgtttcttcatggaggcactcagagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccatgtgaatgttggctttctgttatttattttgttattgaagatcagccttagtgcatggtgatctgataggatacatgggacaatttcaatatttttgaatctgttgaggcctgatttgtgacctattatgtggtcaattttggagaaggtaccatgaggtgctgagaagaaggtatatccttttgttttaggataaaatgttctgtagatatctgtcagatccatttgtttcatcacttctgttagtttcagtgtgtccctgtttagtttcttataaaaaaaaacaacatttaattggggctggcttacaggttcagaggttcagtccattatcatcaaggtgggagcgtggcagtatccaggcaggcatggcgcaggaggagctgagagttctacatcttcatctgaaggctgctagtggaagactgacttccaggcaactagggtgaggatcttatacccacacccacagtgacacacccattccaaccaggtcacacctattccaacaaggccacaccttcagatggtgccactccctggcccaaggatatacaaaccatcacagaaagcaacttgtggaagaaagaatttatctggcttacatatcccaatcacagttcatgattgaggcaagtcagagtagaaacagaagcagaaaccacagaggattactgtttcctggcttgattccagtctcacactcacttctttttctatatctctcaggaccacctgcctagggatgataccgcccacagttgcctgggatctcccatatcaatcagcagtcaagaaaatgtcacacagacatactttgcccacaagtcaatctggcagaggtttttcctcagttgaggttccatcctcccaagtagccctagtttgtgtgaggttgacaaaaaactaaccagcacagtagccatgtggacataatctagtggactaagcacttactataaaccaggccctttagtatgaaattctatgaattagtttattagctatcctatctttttttcaaaaacagccattagaatcttagagaaatttaagtaacttgcccaaatcaagcaaaagacattatctctaatagtaggctatagagccttgtgataaactagcaggtttattttaatttgtgccttttagttcaggcatgtggcttcaaaaatgaaccactggagatgattaaggctatagaaaatcacatcaaagcaatgggtccattggagcctttagggtcataataaaggcaatgatttctcctctccctggaccttgccagtgacaaataattcacgagtataattagaatacattttatgcttgtacaaaactgcaacataacaaagcatcaatataagatcaagctaaaggcaataatgatttaaaaatgagtaaaaatataaagctcaaccaaaaaaaatttaacttcaatcctttcactgacagttttggtcaatctcatcatagtaattcctccactaagaggcagcttgaagtaatgggtgagaaaatttgaatgcaaattctctcaattcccacctatactaccttagaattatcacttctctctctctctctctctctctctctctctctcagctgtggaagtagagaagagggagagaatctgtacttcattttaaaataacctaagtttagattttgggtgttcatttagatattaaattaacatttattggtggtacactatatgacatccattgttctaagcattaaaatgatattgtcccattatgataagcaaaacaaacaaataataacaaaatactgtaaatagcaatgacaaaaaagggtaggcacctcaagaaaatgctagaagtgccatttttcacagctgattgcaggagagctttttgacaactaattggagtggaaaagcaggctactttcaggcaactggaataggcttagactcacttggcaaaagaagccaaaggtgaattgaatcagaatagaaatctgattttgtgtgcctgcaagggacactgaagaggtcactggatattttgctgaacctatccatttggaaaggagtcatctgaaatagcactccttgggtagaaaagaacctgtcatgaactgtagatggcagtatgaaagtgttaggcaaagacattttcaatgagttcctgacagttgagggcaaagctcagcgtcaaagcaaaaagtgatgtctgattccactgacgttatctaagtgcccaacccccaaaataacccagagtcataatccaccagtagaaaagctaataatagacaccagaaagcatttccttctcctcctcacccttttcttaccaatactcagtcacaaggcagtcattggttgaagcaaaaggaaactgaaaggcagtgtttatatgaaaaactagcatagttttccccccaggcttgtctatttgaagtgactttatgataaatgtatagagataaataaaatctatgggctaatgtcttttctagaacctcttgcccttaccctctcctctttgattccctaattcataaaaacagaactcattgtttcattccactaatatttattgagccctactgggcccaggctctgttcttggcttccaggttccagcaatcaatgaacaatagctgctagaactgcctgaaagagcttctggggtgcataattgagatgatggtgtgtgtaaaatcaccttggcagccagaaaggtggaggccaatataccatttaaagatatccaattttcttcagcttccagcagtgaaaaatagaaggggctctctaaataaggaaagcaaatagctgaaacactgtgtgaccagcaaaattcatgccacaaatctctccccttcgtgtacttagaccctactattagaaatttccattctctgaatcacaactaaggagtgtctggagcttggtgtggtggtggacaagtataataggagcactctggagaggaagataggattgtaacaggctaccactggagggatactagctagtgaattttagcctaggttagctactaaggcactctatgtaaaagataaacaacaacaagaaatgtttctatggaggtgaggcttctatgttatggaacttgacagcaggcctatactattcacaccttactatacctctttcagtctcctaccctgcccacctcgctaggacacacatgaaccccatcagaccttaagaaaggcaaagggggtgagacaaagagaggagcagagatctccagacagctacatcatcagctctcgttccttctagctccttaccttataagggtcacctatccctatcccagtatttggtctgtagcattcatctgtaaatatgaggaaagactcacattatacatggattcagcaaatgcccaggccagacaatatgaagctcgaagataccgttttgaatttgtaacagctatcaatattacctgaatccttactaaaaccagaaacctcacaagggtaaaacaagacagacagaaactcatatggtagtttaccattgcagcctttcaattaaagaaaggttaaatctagagatgaaactgactaatctgtcaaatagaataataaagtcagaagactaaaaatgagtccttcaaactcttatcttacttcccttgattgctgttctgtacataacagactagccctaaaagctgctttttaaaatgtcaagaaccccacattcttttagaggacatgaaactcccgttcaaataaaaatgtatcccttagaaaacacagaagccccttttatatcagtgaacccctctatgatagccaaggctgatgtcagaaagggggtgtgacattgggtctctgatataatggaggaagtagaagctgagctttccaaagtcaaatctcacccttttgtggcatttagatccaaggctagtcttgcacacaaagcaatatggtttggtaacagcagttaccaaataaacaaatggagtttatttctcttgaggaacactaggaggcacaaagtgctcaaagacactttccctggctatcccttcatactaagttttcaaactattctttcatatgtgtttggggcatagagaagttacaaacacccatgctagtctcctaagaaataacataataatttgtcctgtagatagaaaactagtaccataaaacaaatttgcatattttgtttctgttgataacaatttattgatctgtttgattttttcatccaattacttctagattatttgtatgaggacaaatgcctgttgatgggaaagactgttctcatatccagatcatgagatgagatagttccttttatgctaatggcattatatcaagcagagctgtggtcaactctggtgatacactttaggagcagactttgaaaaaataaaagtagatctggaccatcataagtagaaaaggagacttgattggaattcatgtcaaatcaccaaaagagggtccttaaatatatagcctacaaaagaagtaactagcaggtaacttagagatggtaagtttcagactattatgtgggaaagagtgaacctttactctgaaaagtaggaagagttagaatagatggcacttcactctaatctctattcattccacagacacatcctgtgaagttgcttagtacgtgctatgcattattaccagattctgagatgtcaaagaccaaaaaaaaaaaaaaaaaaaaaaaaaaaaaaaaaaaaaaaaaaaagacatgacccatactcagaagggctcaactttgtctggggaatctccttttctatgcaaaagaattggtgctaactactatggaaagatgaaagataaaaggaattgcttgattcaagcagaaggcagaaataggataagggagtcttttattaaagaggtcaacccaacaaaaagaagattctctcagttcaaccttcctcattacaaagaaacctgcctcataagagctaaagagcacctcatcagcagaggggtttgaacccaggaggcctcattggatgagaagttgagcaagatggccttgaaggaacctctgatctcagctactataatgttctactaacaacaaatggatgttctattgaccaagtagatattccaatttaacaaataggaaaagtagaaatttatactaaatagtttttctcaggaacaccattcttgttcatgggagttttaatgtataagactcaaatatactataaaacataaactttaacaggggaaattagagtggtgagatggctcagtggataaaggtacttccaccaagcctgatgacctgaatttaacctccaggacccaaatggtggagagaaccaaattatgtacattatcctttggcctccagtgtaagccatggcagatgtgtgtgtgtatgtacgtgtgtttcctccaccaacaaaggccaaaaatcaaaagtcacttgataatgatttttgtcaatagcagaccacagacatttgcagtaatatacctagatatctaataatatttaaccatataatagcacttattaagtcatacttctccaaataagagactaaagtaatttataatactattgaaatatattttgccactaaagcatatttctccatttttaacataaaaagacatgcttctttccagttcaggtgttctagacactattctaagaatgcagtaacctttgaagtagatgcttaaaacccatagcattttacagatgaataaattgagatgtagagactaaataatttatacacatagcaaaagggatcaaacccaagcactctggctccatgctcatatatatataattcttttgagattacaatcccatcatctccctcttcctttcctttgtccaacccttcctgtgtatctaccccttgctctcttccatattccccatgctcttatcacagcacgacagagccatgctgtatttccttttgtctacagaaaaattcttttattgctgcagcaccgctggattacagtaactaggaacaaatgccactattacaaagagatgcaagatacagacctgagtggcaagtgagtcactaatcactggcttccacataacagatttgcaagtcctgagattcaaatgttcatctgcacacacacacacacacacacacacacacacaatttacatctttgaccttcatgccttattgcatgcaaatacttagaactgtgactgcggaagtcattaatgctagagctctacttgatctgctcttgtggattaattaatctgttcctcctctgttcatgtatttcttctttgaatttcctttgctaattacctagcagtgctgtctcatgggctagctacataagtgagtctattttcccccttttttgagacaacgttatgctgtatgggatgaaggaaatgaatcgtggcaagttgggaaaaatgaacttgttattacagatcctgccataattttttaaattgaagttcagatgattgaactagcattcaatcccttttatgcctttggtatttcagccaaaaaaaaatagtctttaaaaataaagaattctaaatttattttattttttttcttctttttttaatctgaatgtcatgccatcagttaaatactagttaggaagataaatgccacagcttaattttcctcacttctgagtcatttcttcctcctgcttctaacctccagaaactagtcatcaaccatggcctgatcacttctgccactgactgatctgacattactgtatccattagtgagtgctatgtgtacagcacatacatttaaagtaccgacttcgagcacagccatttattttcctagaaaggcatcattacctaaaggaataaatcttttagtctgtatcaggaatcaaagaactcaactaaatgatgaagtaaattagtccaaaacacagcctgcttgttcatggacttccttacctttggcttatacatttatctgtgattgtaatggcggctttgctaataatgtaggacacaaattgttctgcaacctcctccttcagagcatactttacaatcatatctgcttgggcaaaaacaaagaatacacaaaatctatttacacaaaaagacatgcccaccatagtgttgtctttgatgacattaagggggaaagttgtaaatatagtatagtcgcagattgaagggttatataactattcttaaaataggctttttttctggttaaaaaaacataaggatgtacaagttggtaataaagaccaaatcatggcaatggttatcattggcaagaagagaaacacacatgactacgaaaaacaaatagatcaatttcaagttattatagatgcttaaatttttaaaactctctagaaggcacatgtcttattaaattcttttcatatacttatgtgtacctgaattatttactttttcttaattgaaggggcaataatccaggaagttgcagttacacttaatgacaaattacttccttataacacttagcgatcaccagatgaaaataatatatgatatgaacatataattctacaaatcagatttaaattttctaagactttgattattaaaggagcataaatgatgaattagtaggtatgggcagatacaaagtcagattaagtaccatttttctctggccttgaactctctatgctcctacctcagcttctcaagtgtcagaattacatgtgtgtgccatcaactcaggctgctaaatagtattttaaatagttttgcaaagctaagtatatatccttatttagtaggtttagcaaaagacaaggtccaatcatctttagacaaactttgagttgtggtggacatttttagtcatctcaatgtcttttctcatctaagacatggtttctctgtgtatgcctgtgtgtcctgaaactcactctgtagactaggctggccctaaactcaaagatccacatggtcctgcctctggagttctgggattaaaggcatgcaccaccaccacccggcttcatcttgctatcttttggcaataatgtggttgtcaccctgaccaggcctaagtttattattaaataaacatatcattagagaccacaatgagtaaaatggtgctacctgccaacagggctagtgaaatgaataaggcatagactttgtcttcaagaaatcctcaaataacaagaggaaaggcagatatgcagccaattcttattaacataatacaacaggctgtgcagcaaaaacctaagcaaccatcaaggaagtacttctgtgggaacaggaaagatattagaagacacagcgctggctctgaatgttccaggaatgataaggtaattcaggcagaagcaaaaaacataatcaaaggcataagacatgaaactatatggctgatttcagtgaatggtctgtagtccagtatgactggattggaggagatatcagacataagactaaattttgctctttttaaagaaaattgtagagaattattaggatggttgtaatgagattaggttttcactttagaaagatcagatgaatagagaaatctaagcaaggagatctcgatgtaatgagcagacaacagagtcaagaacaaaagggtcgatggcatgccctagagagaacaaccacagcactatggatagactcgagatgacaggcttcccagcatttctgcatagaggtagtgaaggggagggggagatgggaaagtagcaccgaactttctagtttaggtgtccagtggttgagtgggagcaagagccaagctttctaatgaaatattttataagaagttatctttaggcctatcagttggagctgtccatcacaaagacttgttttctgttccctcaaagcaactctggaacataacctttcagttcctcttccattgatcctatcttagtcttgtccaccctgaacttttagaatagccttcaaagtagtgtctttgcttctactctggcccaccttctagcccattctctacagagcagtcagagtactcttttaaaaataattggatgctaacacacacacacacacacacacacacacacacctcctcctcctcctcaaaatcttccaataagtttttttttatctcctatagaataaatccaaactgtttactcatgacctacagactctgacctgattctcttcctacactcattttctattagtcttcttttcactcattcaggtttagctatcctggcttccttcttttgtgctttatgcaatctaaagctttttctatctctgtgtgccatttcagtgactccaagagagtctctgtgagtgtctaattgccataaacatgaggcttaattttcatggaggcagctctgggaatcccaggatccatttgcataagcctaggcaagtctcaaaaagaatgcaatgttaggggagtatgacaggagctggagaaatgaggagtatattataataaaagaaaaattaaaaggttcaatgtaggtgatgaaagtccagaaatgagcaagtaaacaacttatcaaacaagccaggatgtgtgccaggaaagcttacagaaggattatgttatatgtttatgggttttaacataccctcacctctaattaaatgtcatgttacagcttctatctaaagttcttcttcctaaggacctagctaccaatccaattgaaagttctggggtcattgtggtagttcttcctttatattctctacagggacacatgcagagctacacacattatttgctacacattctcagcaccacttaaacttaatgaactttaacaggataaattcgacctgagaaggtcaagacaagggtgatttggactgatagaaaaaaagctaacagtttttgtgatgcttccatttgaatggaaacgacactattcatcctattacatacctcacaactccaataggtgctcaataaatatttgttggcagggtagatgcatgactaaatacactaatgcaactttaaaccccattattcaaaaataatgctccaatgacagaaagcaaacattttgtttattctatcatggtcatacttcagtagtgcctggtttatttcaaaacactccaatttaaaagagacatcacaaattcaaatgagcttatggttgaaagaacaaagttctgagaattttggaaacagcaaaagccaatacaatgtaacctaatgagatcagaaagggacataataaagcccttgcagtatttgaaggatcaacacgaagaatagcatgcagaattattttccatagctctagcaggtagggccaaagaaagaagaaaataataaaagattgtctcagaacaaggatgcactttcttagcataatggatctccttccataccatttcaatcacccttttcaggcacattcagggtaaacacactgcagggtatctggggtgggggttggggtggcggcttggggagatttcttcatccagcagaacactcaaatgagaaaacacttttgaaaactaaacgataaccagttagtagggccatgaaaccaagttagctaagcatgacttgaatttttaagtgaatttgaaaatagcagggagcatcacaattagcaaggataagcacaatttggagaaatctgctttaaaaatgttgtcagatgtctgaaaatatgtggacagccaaaatgagcatggctttgagactgtgggctgtaataaaacatgtgtagtgaccggttaagaacagttgctactcttccaaggggccagagtttgattctcagcaccaggtcaggcagctcacaactgcctgaagggatctgatatccagcctcttcaagtatttgtgggtgcctgtgtactcagacacacaggcacacacacacacacacacacacacacacacacacacacacacacacacaaataaaacttaacatttaaaagacaaatgtgttttactgcacaaatgtccctttgcgatgtccaatctggccatccaaagaattgttatcttgtttgttgcagagatccaaaattgctgtgtatgagaaaatgtggtcttacatgaaatccgcagagccatctgtgtttaccaaaacaacagctgatggggtagcccgagttcggaagtccaagggaaagttcgccttcctgctggagtcaaccatgaatgagtacattgagcagagaaagccgtgtgatacgatgaaagttggtggaaatctggattccaaaggctatggtgtggcaacccctaaaggctcagcattaaggtgggtggaataatataacaatatccgtgttgttatagtattccacctaccctgatgcattttgttgtcgttttctttcttgtggattttgaggtaacttttaaaagtttaaaatctacaatattccatggagttaaataagacggtaaattatggtttcatctatttaatgcatccattttttttaatgttctctctctctgtgttgtcctctctgactgtttgttgctgttttaattttacagttcaacggctttttcaatttaaatggtaaaagccaagttatggtgacgaatgttaattgcatggatgtggtgttcttgttactttttttctcaaagacaatttccccatcccgcacacttcagttttgagcaaatgttatcctccatgccaccttccaatatttaaccctgtatttgctgtacagacatttttatagctccacgttctgtgaaatttagccaatttgtcctcttgtgctcctttttttatacgttaacgatttcctaagcatttgtgcattttcttacaagttatgttttatcgtttcaagaaatgctgttaacctggcagtattaaaactgaatgagcaaggcctcttggacaaattgaaaaacaaatggtggtacgacaaaggagagtgcggcagcgggggcggtgactccaaggtcagcctcaatgtcaccacaaccgggtacccttagtgacgagtaatcggcaagactgttatcttattactgaggagagagagcacgagacacacacagaaagtagaatgaccaggtttttcccctgcctggcagctttgggaaccagaaagactttagggcactgcccatatttttgatctaacttgggtcccttcttaaactcccagacagaggctccatgtccacaccctttcctttccccacacgccagactggtttctatatgaaggccattatacaggttttggtgccctaggctttcaaaagcccaagggtgtcctgtgagactcccccatctgccacagttgaattgtgtaagaaatcagatccatcccagtcactgagatgacaggatataatttgtttggttctattattttctaggatgtgatgattgctcatagaagtttcttgagtgagtgggagtgacttctattacttgtatgagtgatggaatgttctctgtatgtggtggctgatttaactaggccccacttaacttgaaaagcaaagagaacgatcaatttcaagttaaatggggtctttctttaataggtcaccacatacagagactttgcaaaaggacttttatgtatttgaacctgtgcatcgcctgtgatactacttgtgtgtgaatccctgatttggcttctctttagccgtgtttttggttcaggtaggtctaattgttatccaggttgtcatcatgagaaaacccatcttacttgccattcctttggttcctaatattcttcgaggctacaatggatgagtagccatcacccaagcaacaggaaataggggctttctcagagaccaagacatcaagtcatggagaggcacttcgggtaagtacaagagaagacctgaaaacagatttctccatggcccaagggccatgcaaatgatactgaaactcgtgagatcacaaccaagataccatgggcatcataaggtgaagaacagtgtttcccaaccacagagcaacagacaggcaagccaaaactttttttcttcagagacaatgcttataattctgctcttctctttccttctccatcccttgggatcctggcagaaaagctagtttgccagtctgcaatataatatgggtttggaaacactgatccagagcactttcaaagaagcaaattttaaaacaacttctattcataatcttaccaggcattggcaagaccttttattgtaaaaccttgattaacaagaatacactgaactggtggcctgaattgtcagcccctgttccaaacttccattgatgagatctttaatgatattcaaaatgagaagacctcgaggaattgagtttttgtatagttgccgagtgataactgcagctagatctttctcctataccttttctgcaactggattgaccctcaaacattagaggctacttccctgagacttaagagtggatacaagcatttacaagcggcatgtcactagccaaaagtattcttattaacaatcccatccatccctatggattccaattaatcaaggttttactatgtgccaaaaagcagtgacttcctttctcaccaatgtaaactgatgacactgaaaatttagccaatcatttgcttcatttgattttcacaatggctaccctgatgcccaaagtatttagcaccttcctcccagcacttttctcatgctattagcaggccaccgagaacctaattctattattcaagtgagttacagaatgaaaacggagctggactggatactttgttctcatgaactcatcattcagaggagccatggactgaatcaagatgcctctaaataatccacacagtgcccagaagtgccccgaagttttacaataaccaggtgtttgatgttttacacgcgtgcgcgcgcgcacacacacacacttacaggcatgcatgcaaacacacacacacagagacagacacacacacacacacacacacacacacacaaaatccctggatggatttgaccaacctttacttttcatgaaacgatttggtatcacgaagatcccaaatggttaaactagctttttgctaattatcaccaacaatcacatcctttgttccattcttactattgtctctgagtttttatttagtaactttattgctaacttagaatttccagatttttctgaaatatggcatgccaatagaaaatatttcagtagatcgtaattgtttcaaacttctttggccttagtgctacctaccaggcaacttgcaaattacttttcttggtcatcccttcaatttaccttttgcaataagccaactccattctcaagtatggataatagtgggatcaaagctgcgtatccaacaactgcttctttcgcctgggaattacaacgagcctgcctttatcttcttccttcttgccacctgctttttttctgaaagtgagcacaagaaggagcaaggaacgaacttgactgactgtgtttcacaactacttcgtgggtaccattcaacatgaatccattcagaaggtagaaatgcgctgaaacctccttaactcggagtgctttgattaataatctggaataaactagacaaggaccagtctacaaagtaaattgatatgactatggatgtggacaagagaggtttgttaagcaaatgcaaagtttagactagcatgtcagttgaatattttcttgagagaacaaatctttttgtttcaaaggttggaagtactcatcacatataatcatattcattataaatctacccactaacatagttctcatggggacctctgataaagcaatgttttatagccagtctgaattgcaaaatagaactaaaaggagaaaatgtcatgcttcaggcatatttttgtagctcaggatttgcttccctcattctgacaattcttcgtctgtgctagttcagatcaaggaagttttatcccattagtaaaacggcttgagaattacacttccttattgactctcgtccccagttaacatgacaaaaggaccactgaatggaccatcatagcatggggaaagtgagatccacaggtggtgctgactttgagaaggtcacacagccaatgccatcacacatctcttctgactttcagattcacctcttctgatcatattgcagaaagcaagttattgcagctacccacccatgaatggtgtgaatctgactgcatgagctacgtttctataagaatcaggtttattctcaaacaccttggttactaggcaaatggcatatttaatatttaagccattctagcctcggtactgattactaaaaatgacaataatcacaaaacctgacatttataagtgcctccactacttcaaaaacagttttacacctattatctctgaaaccaggaaaggggaaaaaatacttgtattacttatccctctgtcttgttcctataacctttaaattatgataagtgggcaattatgttaaattgttgacttttccctctctaacatgagacagcatgcattctgagcatattctacaaattttactatgctatggaaagaacaggaacttttcatgttgtcaaaaatgagtacactcttaaagtaatgtaatagatatgctattttcttttctgaatacagggaatttagaaaggggttactaactggagtagctactgaataagacccataggctagaaccaaaacactgtttgcctgtaccaatttctcaagtctaagctaataagtcttggccaaattatacccggtctgcccttgatgatctataaatgtacagaggtaactcatggaaacaaaggctgtggtttgagaattttcaaccaacaaatcaccctattgtgttgctgctttattgtaatacatgtgaaaaagcagtaattaggaggcttctaggttgttccagctataaacctagatcactagaggtttgagagacagctgatgaaagtctgtcacagtaaaacagcagatagtgatttttgcagagttcccatataagggcattaagcttctcccacagctattagtcctctcacagttttacattctagtccttcctaacttcattcccttaatcgtaagtaaatgatgccagctcagttttttctatatacctttacttagtagagcaaagaatgtcaggaaaaacaaactattgtgtacctggagtgataagataattcgaaacttatcccatcccagcctagatgtgtatcagtggatttaaatagacttctagtatctatacttttaaagatgaaaaaaaaagagcagcacagattgtgtgcctttgaaaacaatgaaacagaatgtctaaatggaactgttgggaactccttgactgcaataagtcttgtgccaaatgtaggtaccttcacttgtaaggcaaagaaagtggtgtagaatatcaataaagaaatgtagttgaaactgaagtatataaaaactagaagaaaacgacaagcataaccacacacattgagaaaaatcatggagtttattttaatagactcaaaagctccctgaaattaaaattagttgtatctattttcatctatgtgcttttaacatacatttaaagtttgttctcttaagaaattcaacagtttgcttcctcttccctatctctatcaatcttttttcttagaaaaataatcttatacatttgcttagcaagtcatccattcagagacagtaaaaaatggcacttcgagatagcctgtttccaaatttcctcagacccatagttggtgctacctaaaggaatgagactataactgtttttcccacgtgtataacatgagatcttcagttttgtatgtatttctcctcctgtgtttgtctacaattttcctctcctatgccaccatctcttaattgcttctcttccacacccagaattctttgacaatcttgggccttagggaatggatatgaatctgcatctgcctttatctgcaacaaaagtggatcttttactggcaggagccattcctaaaggttgacactttggatgcccagggttaagatggatcccaatgacactttattgacactgttatgtgtataggcaagaaccattacagaacgatgacacttcctgggtcttagcagaagttcctgtgaatccccaagactggtttgggatcaaggagtagggtgagtatactatactcttcattggtttgcatgtttctgtgctggtactgcctcctggaaatatgaagaacctgacaattttttttcatgatagtgactaaatttgctacttgaactgattcaggtcttcttcccaagagcaaatcctcactttctcacaaatgactacttcaagcaagggaccagttgtcataagaactgaaccagtccagtactgccaaaaccaatgattttgcaaatgatgctaaataaataaataaataaataaataaataaataaataaataaataaattctacctctgggggaaaaaatgtaacccacaaagaaaagaccgtttaattatttcattctttgtcttaaacacaagtgactgtgtgaccttagcataattcctatgattaggacataattgactctatatgttgctattctgataacatgaatatgtttcttattgacaaacaataaccaaaatatccaacaccagagctacagaaagaacagcaggagtgagaagcaagaaggtaagaatgatgttacacagttgtcaagaggaaggacactattgccatggcaaatattgaaatgatacatatctatgccctttcttccccttgagaagataataactgggtttcatttcatttgaagaggttgtagaaccacactgtctgaaaggtaggacagctacggaaaagaaatatgaaatatttaatgcacctaagttatttttgttagggtgggagttggggttggtggaacagggtgggaaaaattttataaagaacagttaaaatccattctcttttgactttttagagagcggtatagcatttggcccttggcacatgaggctggtacccattagtctgaggtggcaaaaatgtggtctaagtgttggattaacattttttattcattttatctagcactaaaatacatctcaaatatggatctaaagcagcagcatactatattttagtatatacatattatatatacatatgtgtgtacaaacatatatacacagtgtctatatgtatatcaatatacacagacactcatagtaagactgctagcatttcttgtctagcatcactacaagggatacaagcatggtgtatggttggtagagtgtgtgtggaaagagatcggtgtgtacctttgatttggcaatctgtaccaagtttgtaagttggatatataaccaccatttctttccatctttatttgaatataaactaagattgattatctgtagcccaaagacttacatgtcttcagaaatgttcatcacttgagtttctggcctctcttggtactgctggaataaactaaataaatcacacttatacacagtaaataccaaccacatttgaagacttgaacttctaatccatattaaaatagagtttttaaaacttatttggacaagtgggagtcccatttacaatggggtttttcactgaaatatgtcaattcttcttccatcttagtgttttctctgaatccctgctctttgttgggaaaaaaatgagtaaggaatcttcccacataattaggctatatgaaataattgttttgctttttagagacgttagccagaaagagggctaggttttttgacagaaattcatcagggaaatttatgatctgtagaatcaaagtttctcttgtttttgaatctgagaggctatcatatggaagcaccgctggatttagctccatatctcgagtttacttaggaggctgctgtgtgaacacagatggtcatcaatacattttagtcattagcattgttaggcccttagaaaaatggctcacagctttcaactcctaatgttatatgcatgcattattgaatttgctctttgcacttacattaaattatgatcccattagcaaggagttaaataggtttgagctacatttgtgaactacgtggttataaatacactctcagaggtggcttctagcagctaagcactgcataactctgcaaatcattgcagcttcttctgtgaagatgagggtcacttggacactcagagtttagtaatgccaacagtcgaagggtatggaaacaactctcagcggtccaaaggcaaaaatgttttaaatgacataaatcttattctgcactcctacatgcaggaactcctgtgaaaaatggggaggtagagcatttttaatgactccgtacacctgtacattttaggacatgtttggaactgtcacagcctccaatagctggcacagacaagtaaatcccttcactacatatatccaaagataactagtttaaaaagaatgcaaaaagctacatgttaaatccttcactcagcaaggcttcttctctctttcttaactgtcaattgactccaacaaacctgtgcagtgatatctgtgcctgcctgcacatacttcttatgcagagtgatactatggcttctctgagagaggctggaatgagacactagtgactgattaccatgactacctgaagtagtctcagtttaaagatggacaggaaaatggagaatatcattctctctcctctgggctgatgatattccagcccagaaaggtaccaagaagcaagaattagtacctttaaaacaagtgtttagatgcagaattaggtggcagaaatttttccagcttcatttatgaccatttccattttcattgcctaggtattatattgtcagagcaggtttcatattacatttataaacttaccatccttgttcgtatatttctttggcttttttgtgcaatcttttctttttctataccctacatattgacacatatatctatccttcctaaggacaccactgaagatcttctggactcattaattacccaaccatttgccagttcagtatctctattcagaaacagaaagtgcagtcttttagatcagagtatatcatccagtctctcagatagataacacactacaccatgggtttctatccagagtcatatccctaatttaaacttctttcttatcacatctagggtcaccagattacctggggacatcatcttggtaatgcatttactagactcaaattctccttttttgccctgtaaggagcctcagcacccccacttaactccattgaacacagcatggctccaagctgcttcatttattattctaagtacttgaggacatcaaaacatttaaaataaacttggcagtagttttaatcaaaaggcttatttatttgggtcttacaagagagattctgcattcacagaaaaaaataaataaacaatggtattctaatccttaagctgtgcccatgtataaagtttgccattgcgaagacaacactgcttctttaaaatggcagaccctgaaatttgacacccatctcctggaggggctgtgctggacagtgtgcacagtgagtcctttgtagctgagttagtgtcaggtatggatggctgaaacaagcaaatttattttatcatctaatcatatttcctttgtaaatacaattcatgccaggcttgctggcacatatctatggtcacagttcttgggaggtaaaacagaaagatgacaaactcaacatcagcctcagctaaatatacaggcatttgttttggagtctaatgacgagagttcaatctccagaacccatgtgaaagtcaaaggacctgaccacgtgtgtcaaggcacacacacacacacacacacacacacacacacacacactttcaagaataaacatttttctaaaaaaaattaattatcaaagccttatacattattcttcctaaattaaaggataataaagaaatggcagtccctatctgtcctccacactcaggagtgagcatcctgatacaggtcaggattatcttcatgtatttttagagattctgtaattcacatatgcccaagcacgcactccacatctgcttgattatctaccctgataataatttttatgacttccatgccataaaacattttcttccccggagaactttatattcttgccccaagccccaaatcttaaaaaaaaaaaaaaaaagaaagaaaaagaaaaaagaaaaaaaatggagaatagcaagttgctttctttttgtaaattttttattaggtattttcctcatttacatttccagtgctatcccaaaagtccccatacccacccacccccactcccctacccacccactccccctttttggccctggcgttcccctaagttgctttctaaatagtctctatttcatcatttccatgtctcaggaagattcgtatttaaaaaaaaaaaaaaggacaaaatgaaacaagaacacaaacatgttgctcaaacttaacagtgtgaaatttttaaaatggaattttagaaatagggaggaaaaacatggggcttgggaataattcccagatcccatcaaatttcaccagaaagccctccagttgaccaatgcctctcccttatgatggttgatggttctgctcagcaaaaagctcatagcaagcccttcagagagcgactgcttggttaatttccacgatagaaatctgacctactttgttcaattctttctgttctctattgaggtgagcacaataaatatttctgacttctaattctctcaggtactcagtcaaaggcctgcagtaattgctccagacttttcccatgcgaagcattgctgcatcagaataaaaggcctcagctggaatacgcccttggtagattgatagttatttggagacttggggtccctgaaaaaaatcattatgaacatctaagccagaagagaaaaaatgagaagagctacctactcttgtatgttctatgtttcagtggccaatgcatagtagagagttcaatgtatattcatttgccattcggtctgctctgtgatatgtggaggtttaagcaaattgcttgacctgcatgtgctgcagtttcataatttgtgaagagaagaccataaatctgccttcttggggtagccactaaacttaaccaataataaaattgactagtataattatgtaaaggaactaggttgaaaattaaaagctaagagttacctttaaaatggttatttactgagggaggggaatgtcataaatgaggctacaaaaccaggagactgatgcacagaaagaatcacaagacatgcacaaaaataaggcaagatggagggtgatggagggaagaaagaaaacatctgacctaggaggaaaaaatgccatcctgacaaaaccatctaaaatgaccaaatgaataactaattctcctttcttcaaaacaccagtatgagtgtgtgtgtgtgtgtgtgtgtgtgaatgtttgcatgtgtgtgggtcaatgtttgtgtgtatttgtaagtgtttgtgtgtgtgcatgtacacatgtgtgcatgcatgtgtgggggcatgtatgtgtgtgtgtatgtgtgtgtgtggacacatttagttgacttgagttatgcttcacaatacatctagtaagccagaggaatggaaaaagctgttttaaccaaagcatgtttaatctaccattttggaaatgtagtctatttcacagctacacagaatagcaggaactttcttctgttagtacctatcctcaccttgttgagtggcatcatctctgatttctgattacaacttttatgttccttgggtctgttactgcttgaaatgttcatttttttccctggtttctattttggagttctcaagagcacattggttccatcccaattttcattaacactctttcttcctctctttctttctctttctttctttgtttctttcttccttctttccttccttcattccttctcccttccttcctttcttcctttctaatcaaaaactaaccttctagaggtgtgtagtctgtcagagttctttactgtcctgagtatctcagaggacatctgaatgctctaaagccagctttctcagcctcagcactattggtgtctggagccagatgttgcattgttgaggaggctgtcctataattataggatatttatcaccatgcattgcctctgcccattgaatgcctggatcattcccccagcccatttgtgataacaaaaatgacaccaggcattaccaaatgtcctctagaggacaaaaggccctgccgccaccccctgcatgaaagctattacactaagatgacctgcactgtgaactagctgttctgtgaaagctactggatggcccaaggcagacatagaccatttgtctgaaggagagcattaaaatgctgagatactaagtctgggcttaggcaagtgtctatgattgacagcccagaataagcacctatatcacaacaaaattcattcattcgccaaagcaatgcttataaaatgttttgttgcaggactcttcatattcttaaaaactattgcaaaaatctaaaaaaaattaatttgtttctgttatatctatttatattcatcatgccagaaatagaatttaaaagaatatattcactgatttattttcaaattaacatagcacatgttaagataaacaatatacttatatgaaaacaattctattttcaaaacaaaagttagaaaattgaaaccaagtcgggcgtggtggcgcacgcctttaatcccagcactcgggaggtagaggcaggtggatttctgagctcaaggccagcctggtctacaaagtgagttccaggacagccagggctgcacagagaaaacttatgtcaaaagaaccaaaaatgaaaaagaaaattgaaaccagcctatatttttgcagatgccttaatatgtagcttatattaaagcatgggattatcatttctacttcttcattcaatttgttatgatttcacaataaggcagcctctgagaaatttgtatatgatgaaggagtaatagtgaaaagggcagtttctaccttccatcactataaaaaccttcaacttcacggacgaatgagagggttttagtgatgccccgacgggtccaggaacacacttcgagaaatgctgctctaaacccacaccgtttacttttatcgatctatgtcacttaaatgcttaggaatatcttctaaacacagggtctctagagaatggaaccttctgttaaccccagtgtggtcattttaatcaggttgttctgttcctaagacctaataaaagcagcaattctgaacagattgaatgaggtatttttaagaatgtagaaccttaaaggagaatgaggcctggtaaggacacaatcaaagagcaatgagaagctactagaccttttgcaatgaaaagggaagatggacggaaaggatggataggcccattgagcccaggtcacccttatgctattcggaagcatcttccctacatctcaaggcaacttccacaatgctgtgtctcacaccagaacctggctcaaaacacaaccctgggagagcagtgatggtgatgtcataacaaataatgaagaagagaaagaaagagatagacagtgaggggggggaggagaagacaactccgcattgcttccagggtcatagatggtcttgctgacctttacaataatctaagacaacttacactgccaatactgtcttaaggaggctagaaattttgtgtacgctttgttgcaattctggttagcacttgagaagcctaggcttttgagtgctgatggaaaaagaaaaaacttgtttaaagtataaaaggaattcaatttccatgtaagacccagaatgaagatattctgaatgctatgatctacactaacgagagtgtcacctccttgctactaaaggtttatagcttttcaaatcctgagtaccctgaaattgcatattatttttaaatgacgatacatatctcagaatatctcaaacaaagatggtccctctgccctcaactgcaaatggaaaaaaaaagaaaagtgttttgggagctggtatgacaggggtcagatcattgtgattataggaagtcttgtctgtaagcagatatgttaacagatccaacttatctaatataagctaagaaatgttatagtgtgtccatagttacataaagttgtgtgacttcctcctttaaagccagtggcactagaccaacgcacaccaccctggcaatactgttcggcatgaaagtgaacagtttagtgcctcatcataaaattaggtaaccccattgatacaacacatttttgcccaaagttattaaagagactttgtttcaaattcagtagctacaggaagaacacagggtagtggttactatttctatctgacagctgaagaaatctctcaaaaatctttgtcctaggaccagtagggtttcacacattgtgcccaatggcttcaaatataatcagtatacattaagtacgtaatagacaacaaagaagtgagcagtaacatagcgccctgaagatgtattagtcgcttacttaaagagttttatcaaactattcctctacagtcctactcaacaatggcaatgtcagtttgccattttacacaatgctgtactaacactccacttcgaaacactttagtccactttctgagcatctgacttgattgcagacacatcagagagagatgcagtcagcaactcagaaacatctccttggcctgtttgtaagctgctgaaaatgctcctcaacaaaaatgtcaaggtctacatcgaacttctaatgttaagagtagtgtgtgcgtaggaattggaatgtatgactgtcgcatgagaatacgtgtaaagttcagtcctttaggtcattttcagctgcgcaacagatttgtctaataggggacaattaattcaaaggcatgctgtttatacaggagctgctttctgttcagattcatccatttgtcttggtccacaataatacaaatgtttccctttctggccccatccccctcccaacccacccccacacccataacttgctttctgtctggaagtacaacaagacacccggttagatcaaacctaacacgcctccgtcacaaagttactgcaagctgccgccgaccagtgtcacttgaggggaaaccctcctgactatacacacagcctatctgaggagtgccttttttttctatcctcattatttaacagtgtgtgccgattactcaaagcgatatgggcaggccctggtaaatatagcgttgctgtagtgttaactttttataaggtaatgctcaggttgcctgcagtgtctaaaattactctgtggccagggccccctgctttatcgctttctatagttttaaagtagtttgaagcttgaataacataaaataacataatataatgttatttatgttatttcccacgtgaagaacgcctgtaaaccttgcagtattgaaactcagtgaacaaggcatcttagacaagctgaaaaacaaatggtggtacgataagggggaatgtggagccaaggactccgggagtaaggtcagtcgctgaaggtctttttgtactgattagcaatcacattttgacccactgtttattttctacccccaaacggctttccttcccaacacacacgccctgccacagtgggaccccttcataacaccagcactacaggactaaggcaaacagcagcctcctaggcctgtcatgggacatcaacccattgtggtagagatctattacgattagggactcgatctggcttgatgcatttccaatgctgtaaaagaatgagctgtgttctaaaggggttttactgtagttcacatttcgaaagttcaaagagaaaatataacaaccaacctcaactcaaaatatatatacatatatatatgcatatatacatatatatgtgatccagctgtgacagtactttatcttaatctcttgcagtgtcagagactgtcgttgtaaataccattggttattaatatattatgtctttgtcaaacaacaaagactggtctctgtaagcaaaatgactagttccctcccagcagctgtcatagtaaattcagccatcggtttggatctcaaatctcattaagtctgtcacacttttctcttataaaggtgtcatttgaaaatctctgtatgtaatactttgaaaatgtagccgcatgctccttaagggtacacactgtcaggattaacatcacattgataagcatgaaacactcttcccctcctccttcctgtccccttcgctcccccaaagaaagttctttttagtttcaattttttgccttttcctttttctgaactaatattgtggtatcagttaattcatttcatgaaacgccactcattttctccatgcaatgaaccattttgctactgggtttctacatcccatatcagagaattcgggaaaacttcaacacatggaacttaaaacttctgttgctgctacagatcacacaggttatgataaaggaccttttgccccattcagtgccatgcacatatacatatatggtggcagaaggagggttccagaaattggcccatttcttgattgactatgaactaactacccttgcatatagcctagtgggctacctgaaatgaccaatgtccaataagtgaaagaagtttttactatcacctacctgtcattcattctagaaaagtgactatatgtaaggctgtcatggacatgaggcacccccacatccctccctaaatacaattcaagttggcctttttcttataggtataaggttggctcctgtgaaaatagaatcagaagaacatggccatttcagtatatcagggctagtatgctgaaccacagcactaatggccagcaatagccatcatctgtccaccacgtcatcatttaaataagacgatcaaaattcacaggcttcaaaaattggggattctcttcaactcctttcagcagcaaaatggttacattccctctaaaaagactacaaaatgctattttatttttttttccaaagaaagactcctggcccttggtgtatcctacctcaaggtagggctcaggacaccaagttttttctttccattgttcagcagttcagtttttgctttttcatgcaggcagatagcttagccaggtttgctgtttgacctgaaagtcactgaccgccttcctcaatttttcctccatctgaaatagaaagaagataggtatagcattttttaaattagtcctatactccctggagtaaaactttaaaataagctgaactcttttttttttttttttttgattttggtttttggtttttgtcgtcttttttttttttttttcttcaatggtctagaaaatctttctgatttgtgtggagccaattttgggcaccatggaccctcctgatggctcccttaaactttcaggaagatggagtggagccaagtctttgtgttctcttgctctagcagcaccaagacttgctgccctgattttgaacttagcaaccaatactccacaggggcaatttatcagtcactgagaggaaagaagagttaactctttttacacaacccccacgcccaagctaaatccccacacaagaatagaagagacctcacctagtatgttgaagatgaattaagaaagtctgtcacaaggaaaacaagggagaaaggggtactgtggggcagagaggggaaagagtgcttcagttcccaaaagaaaaaaaatgttccatttgtagagaatatgtcacagctcaactctgggaaatggtttgtgtttgggctggcagagggatacattctgcttgtgtttactctttgttcccctggacaaatgatgtcttattttggtggctgaacactattaaacatttgaagatactaagaatgaaaaaaaaaaaaaacggacattgaggtgtgagattcaaaacagtcaacggaagcacaatgtaccatcttgctggtcattgtgaaacctaagccagttgccagagttgagtcctaacacttacacaaatgtttagttattttacaacttagaattgccctatgctgttgtgatgtgttatgatgtcctcttgcctttgttttcctcaagaactaatcgccttgttcatttttcttaggacaagaccagtgctctaagcctgagcaatgtggcaggcgtgttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattacgctacatacagagaaggctacaacgtgtatggaacagaaagtgttaagatctaggggtacggttaaggtctagtaaactaatcagccttacgtttgtgtgtgttaacctttttgttgttattctttcctgtttcttactttggttggattctagcattgcctctttgctactagttagttatctttaaacaatgattgtgttctcgtgtcagtggttggtgcttttctaaaagcataactggaattaagttatggtctgtgacatgaaaggaaaaaatacattcttaagcagtattattcaatgcaaatatatgtgagtgacacgtgtgacccacatgaataacatttaactgttagttacagagttaaaaataaaagaaatgcagttaatcttaatcatgcatttcattgaagtcaagatacccaaaatatttcgatttgtcacttacacaataatattgaaaatgaatgagatgttttatgttcttttatttatactaatctttgaaatttggggtgcttctatacttagggaatacccaagtgatactagcaacatgccaaatatttagtagtcacatgtgcccatggctgccatgttagacagtataattctagagaaatcagatattctggaactgaggtttaaactaggaaaaagaagcaaggtcctgccacctcatgtagggaagtccttccatgaagaagtagtggttgttttaattaagcagtggaagcatgaaacaaatttcttaattttgagtccctttgttatcccttccttggaactgatggtgctcaggtaagtaagggtctaggttacttgctggtgaccaaatcaaaattaatacttaggaaaacctgactaccaataatgcatctaaatttaaaggcaagcatggattcaaataatgcttccattctacaagtatataaaaggataaagtcttaccaccttccaagtacatttgccttactgatgtgcctatcaaaagtagaacataacaattagcaacttcctataccttattttagctggctaactttaaccctaccagtaaatgtcaatatattccaatttctatatgttgaccttcttatatataacctaataaatctaaatttagttaatttttaaacattttatccaaacaaatcatttgttattaccatggaaaacatgatcttacttgaagaagttgctcgttgtcctgttgtcctgtagactgcagccttcagctactacacactccgtacaatgaactaacctgttaacaaattgttcccactagtgaatgttcaacccataagttcatctgtcattagcactattagcatgtaatcagttaatgttctcatgtgctagtgctttgagttgatgatataattcagttgggggcatatcatttgcttttttttttttttttttttttttttttgtaggacagtacaggaacaatttcaatctagcataattactgcaaaccccaaggagttgaagtccaactatttagtacgccttaagaatatatagcagttttccatgttctgtcacatctattccctgggttgtaataaaaatcgatcaggcagtatttcccctctggtacctaaaactcagatacaacaagtggcttgtctaaagctattcaactaggtagtggcagattcaagtgtaaagtgaagcctttcttcctctttactaaaccagacttacctcttcctgacttctccatctatagcctgatagtcttcaggaaatttgaacccttagttagattttgtcaatttgacaagagatgattagtttattacacagctgtccatgcaggccatcggatgactcaatagtttagagcacttgttgctcttgcagaggaccagtgttcagttcccagcacccacatggcagctcacaaccaactgtaactccagttgcaggggagtcaatgccctcttctgcctccatgagcactgcatatatgtggtgcacttatattcacgcagacaaaacatgtacaaaaataattaacatatattattaaaaaccatcttgaaaaagtttgtagaccctccatgccgtacttcttatgcactgcactccatatactccatacagacacacacacacacacacacacacacacacacacacacacacacatatgtatatatgtacatatatgtgtgtgtgtgtgtgtgtgtgtgtgtgtgtgtgtgtgtgtattgaaaactacagttagcttctttggcttcttcaggaatgtttttgaaatccatctcatatgcaaggacacaacaagcctgtaatttcgagaaagttccatttttcctctaggtctatactattccatcctatgaaatactgttattttccaaggtatcaagattccttaaatagcgtatatgtaggtattctttgagtgggtgaaaggttgagacaggagcttacctaataacctagaatgagctaaaacccacagaaatccccctgtctcagcttgaatagtgagatcatagatgtgagccatcaggtccaacttgcatagacattcctgctggagagttttttccagcttaagggatcttgaagaagaaacaaaaactaattttatgtcaagtgaagaaaatttttttgaataactgagagggtgaagttctttttcctcagagagcttttatctgagtaccagtgctgtttcccttcctaccatttaagagcaggaaacagtcactgagaagtcaagtcactttcttagagttatggggccagataaggctatcccattggcaagaagaaagaaagaaagcaaggaaggaaaggatggaaggatggagggaaggagagaaagagacagagaagaagagaggtgggaggggaggggagggaaagagaagaggaagagaaggagagagggggggagagggagagagggagagggcaagggagagagagagagagagagagagagagagagagagagagagagagagagagagagagagactctggatctgggggagtaccaaagaagagcttttcctactttcatgttaatcttttggctctttgcattctcatacatatgttaattctaggaccagaggtagataatgatgtcattcattcaacctagcttcagggttcactcaagagaaaacatgaatgttctgttagtgtacagggaaaggtggctgagaaaggatgtgagccaacaggagacagactcaggagcaaagaatcccctgcatctagtcgaggccatgaaaacgagggcattatcagcaccctctcaatcgggcccctaatttcaaggcaaagcacctatagatgccaagctgtttcatgggtatcactgcttttgcctgttttctagaatgtgctatccctttaaactccctgtgttactttcagactttaaacactgaggttgaaggtattaagagaaatgagcagtccccagtcaaggaacaaataataatctttgtcctcatgttcaaaatggatttgaattcagtaagccagaccattgtgtaccctctgtcctaggtaaacaatccctgtcacatctgcaatcagaatatacgttgcagtgcatttgtcctgactatattaaaatgccactaaagctttctaacatacctacaccttgagtgattaaagtcttgagttagacttcctgcatgttagtaaaatccatgcatatgctagaaaaccaccctaattaatctattccaaagtacctgcacccagttgaaaattttaaccagacctatttcctaccaaactgggggtggaagatggccccagtaatggcaatttaagaaaacagtcactttttttgtccagtgtcaacagagccattaataaatgtcttggttcccaataaaagtccattcatactacaatgtccccttgccttttgcagatcccttcccaccggaagcatgcaatgagaggaaatcactgaaaacgtggctgcttcaaggatcctgagccagatttcactctccttggtgtcgggcatgacacgaatattgctgatggtgcaatgacctttcaataggaaaaactgattttttttttccttcagtgccttatggaacactctgagacttgcgacaatgcaaaccatcattgaaatctttttgctttgcttgaaaaaaaattaaaataaaaccaacaaaaaatggacatgcaagattccagtatgcgaaaaaaattcttattaaaaacattaattcaacaaaagccattctttgataccactgcacagtatacgaaaccatgttcgttaacacacacacaaacacacacacacacacacacacacacacactcacttatgtatacacattcacacatacaaatttattctaattcagcaaaatagacccatcttagctaaaagaaataattcctcctgatttaaaataaaagaaatctgtctcccagtgttcgggcagacagactggcatttcttctaggatctgctgatcagatgtttttggtatttcctgttggtggtgatgttctgtgcaccctatttccttttgatgttgctgaattgtgtaaatctttagaatgtaaatgtgacacttaagaaaattcaaatgctttgggaaagagactgaatggtgacttagtgttcttgcaatggttttgtgacaaaaaaaaaaatgtttggagaactccccatagtggaggtgaagggattaatagagcctttgaaattgacatctgtgtgtagcatggggcagggcactgtcaggcttacctctcggtgctttcctaaaacggatcccggagctttccaagaagcctggaattacagcccacagatagatctgtttttcttaattccgtgtgcattttaagtcaatatagctgagtagttgaatagtaagcactgaggtgagggaagtgctgcctattctcccagacgtgtttggaatatctttctcagaaacaacactgtgtttagctctgctttctctgctaagtatgcctaagtgtacaacacggagacagaaccgtgttgcaaggcaggccagtgggttcagaccacagttctcaatctgactttactcttgctaggtctgtttaaccagctgttgcctgttaccgcctgcctgtggctctccgtcagactgcatgtgtccttttctagtttgcaaagactaagacgcattcctaaacctattgctaacctgagggacctaagcatcactcccaggtccttgcttggagcagtttctctactgaactgaagatcgccccactgctccatgggctctcaagtaactaattgcaaacctgctgttgacgtcatcagaccagtcagaggaaatagtctccgctcactaattacctcctatataacaatgtatgctttctgtagttcagtagtatgctctcatcagtaacgtgcattggaaagtttccagactgtacaaattaggagcccaccttcatttcccaagtgtgacccttagatgcttagttgactcgcgcatatttgctctcgtctttagaaaagaaaggaagaggtctcgttccaatgaaacatttctagaaaggtgtaatataaactttcattccagaaagtgtgtcataagcaaataactcacctgtcagattttaaatggtattgaacacaaaagaaagctgttgtgttttgttttgttttcatgaaactgtgatttttcaacttatgaatgctataatgtcccagtgcgggaagctaactctgtgtgaatatcaacttgtataaaacaaaccaactgacctatacacaaacatttttcataggcactgtataaagagaaatgtatgtttattgactcaaatcagtttttcagagaggaaactttactgagatgaagaagcgggtaaattggtttgttatttaaaaaaaaaaaaacttgcatgtttaaaaaaatgttgattgcttcaaatttctgctattaacttcaagctatgggagtttggcggtagtcaattgaggatttttttccatttcttttctttttgttgttaaagctgtacttcagtgaacagaaaaattgccaagcaaactaatggccgtaaaagtgtaaattgcatgtgtgggcataattaccgaacctcattgccatgaggtatgtacaaagttttaatacattttgtaaataaaattgtaaagaaagca

SEQ ID NO: 708 - DNA, 277120 bp, mus musculus; identical to SEQ ID NO: 707

SEQ ID NO: 709 - DNA, 109594 bp, mus musculus
tgaccccgcgctcgggagctacacatccgggccactgttactagcgaggggaagatggcggccgcggctgtggtggttcccgcagagtggataaagaactgggagaaatcagggagaggcgaattgtgagtgtttctgaccgagggaaggcgccgggccgccctgaggtcggggcgctgggcgcagtcggaagtggggtacaggggccggggggcagcggcgccccctcccccacccgcacccgggcggcggatgaggatggttggttggtccggagtttccacttggctgaggagcggagccgggagccgccactatcgccgccgccgccgctgagcgtcttgccttccctccgacctccccgaaagccccgtggtccccgggagccccgcttcctttaggtctctccgcagaacttccgtctcgtcccctcaggtccccctgggctcctgccctgtcgcttttttgtctgtctggctcatcgtcttaactcagctcgctgggctcggctccttttctctccgtggcttcgcagccggagctgtgtgggtccgccacttgccatgtctctcactgtcccgttttatcttcttatttttatttgtcccccccccccccgggatctaagacgactcccgcactttggttcccggcctctcctgtgcccgaagtcttaggagggcgaactgtcccgaactctctgctcctcgccgctggtggcagaggagcccggggcgtcggggacagccaggcatggcacctctgctttctcagggagcggcagcttgcgctgccctggccctgcggtactcgggaaagtgtggcagggattgccgcttctttttgccaagtccctgccggcgtgtcacctcgccgtggtttcgggatgggattcaacttttcctggtagaaggtttagggaactccattttggcctgggactgcagcgagtgctcgccctcctcgaggcttttctagtactttaggatgatctctgtgtcctttaagtcataaacttactttgtaccgtcaccggtaatttcctacagtagcggctttcgcgcctcccagtagccaccccacccccgactccccgtttaagttgacagaattaatcactgattaaaaaaaaaaaagttgtaatttcttcttctgagtcgctctggaagcttagcagtcaatcctatgtgagattaactctctttagctgcttgagttgtctccctccacactcccacactcatccagtatcaggttcccagttgctcacgggaagataggaatctttaaaactttgttacttcaaagaaacccggtacaccaagctcttgtgacttgacttactcccacatccctttgctgttctgtgaaacgttaacagcgtgagtcctagaattggattgtctgagtaagtggctagcttagcccacttaaccagctgagtgaccttggataaattcgtaaccatttggggccgtttccccttgagtaaattgggaataagaagcgttctactcgaaggattgttgagaagagttaatgtctataaagcacttgggttatagtaagtgcgcaagtgatagctattaaaagtaatattattccagcttttagaaatttaaagttctcgggacagctctttgcttggcgattagttggcctctgacatcctgcatatttacttttgtatgctaatgagttgagaggcccttggagaacggggatgtcatctcatttttttttttttttttggtaggacatgtcctccagtatatacttagagttccttcgagttttgttaactcagaggtctgtctcacatctaaaagaagcattcatgtttactttttatgtgctgtttaaccagctacctgtttgtcgagtgctgagaaggcaggatgggaagcagctcgagggaacagggccagattggagggagagcctccgcagacagttcagtccgtccttatttagcatctaaagcggattcatttgtgaactgtcgtgtttgtgggtttctcagcttccttcttctggatggatttcactgtgtgtatggagggtagcatgtgctccatcagtgagctacatccacaggcctagctgcttttgtttttgttttgttttgtttttttttaacagtttaatgtttttacttccactttagaataggaggaggagccctgcctaacttctgactggcaataggtggagaaaaactaagtggtgtatgaagccaagaatataaagtgggattttgagtttatatgtgtttacatgatccatgctacctagtgttaaaagagctacttaaaaactgtacttaggattttcatgtatttattgtatagcttgtggactgtgggtttgaagtacagtagattcaaattagtgtgacagtttaatgattatataaatataatttctgtaagagaacttatcttaaaaaaaaaaagccaggaggcagaggcagggggatttctgagttcgaggccagcctggtctacaaagtgagttccaggacagccagggctatacagagaaaccctgtcttgaaaaaccaaaaaaaaaaaaaaaaaaaaaaaaaaagagagagagagagagagagagagagaacgtatcttttttttgagacaattaccttgtagctcatactgagagagagagagagagagagagagagagagagaacgtatcttttttttgagacaattaccttgtagctcatactgaccttgaatttattatcatcttacgcatgtcccactacattagctgagaatttaaagttggatggcacagcttgatgtggtgtctcacacttgtaatcctagcacttgggaggataaggaaggagtcccgggagtttgaggtcagcagaggctacacagttaactttgttggaaacaaaacaataaaaggcaaaagaaacaaggcttgagagctgtctggggtaaggagttaggaacctttacttacttcagttcttaggacccacatctgatggcttatggtctcctgtaactctagttccaagggataaaacctctggtctcacaggcacctgtacacacacacacacacacacacacacacacacacacacacaccaaacacatacatacacacagctatacaactaaaacatatctaaataaccaaaaaactgaagctgtttaatctaacgaaatattctaaggtttgccttactggtgaatgaatctagaggctttgtacatattaagcaactactactacgaaactatatcttcagccctttacaaaattattatattagcatacagagtaatacattttattatggcattttcatacatgtgtcatagttttagtttgctggtttcctccctactgctttcctctgcccacttcttgctggcccttttttcctaactagacctgccattttcttttcgtcttttctctttttttgtcttctcttcttcttgtcttgtctcttctttgactctgtagccatggctggcctgggactcactttgtagagcagactggaaaatgctgggattaaaggcatacatacatacatacaccaccatggctgaccttcattacctactctttgttaattaattaatttatttggtttttcgagacaggaattttctgtgtagccctggctgccctggaactcactctagaccaggttggcctcaaactcagaaatccgcctgcctctgcctcccaagtgctgggattaaaggcgtgtgccaccattgccacctatttttaatctactcttttctttcacttgaattctctcctcctctctcattgtacctttctattttcatgacttacacatacgtatatgtacacttagaaatgtggtttttggcatgcttaaaataataatttcctgttgtatctgtaaatatattgattttattttcctttatgcctggtccattttgctgtcaccttcttttcttccttgtcttcttcttcctcctcctcctcttccttcccctccttcccctcttcttttattcttttgggttttcaagtcagggttgtctctgtgtagctctagctgtcctggtctgcctcccaagtgctgggattaaaggtatgtccccaccacaggcaggcttccttttttaaagacggtgtctcttgtatcctaagctggctttgaactgttgtataactgagaatgaccttaaatttgtgatcttccctctatttcccaagtgctggaaagttctaggaaggcgaaccacacccggtttattcactcccggggattgaacccagggcataagatatgctaaggcaagcactgtaccaactttttattcagtccgggggattgaacccagggcataagatatgctaaggcaagcactgttccaacagaattacatcctcagacctttaattttctgttttgagatagggtcttgttcagttgtctaggccagcattgaacatgaaaccatcccatccccattccattctctcaagttgctgggattgcaggactgcactgtcaggtcctgtcataatgaactattttaaacaatcactatttagatattgtaaacacatcatcatcctctactctgtttttattcatttgtcttcttttccttatgtacaaactttgtttaatagagcttaattttagaggttttaaaaatcatgttacatacattagcattttcatcttgttaaaacaaataatattgttatttggaaaaaatgtcttgaatatgaactagcaactggaaatgctaaaatgaggggtagagtgaatacatttggtttttcgagtatgccatatgtaaagttatttcttaggattttttccttttcatttaataattttaaatgtttttggtttttagagataaggtcttatgtagcccacccaggctgatctggaacttgctctgtactccagggtgaccttgaattcattatcttcctgctttagcctcctcactattgggatctcagtggctagctgattatttctttataaaacagcaacaagtgctttccagccctgaatttttttaagtatgtgttgtgttccatgagattcccaagtttgtattgtttgtagcatcgtagcagtatatagctattgtgagagttacagggtctgtagtgatagagaagcaacatgatggtgagaataagctcagtgataaagcagtttgcatagtgtagctggtctttgctattttctggcttcttctttttcttaccctttaaccccatggtttcaccccctaacactagttagtcgagaatcaaggagagatgggaagggaaagagaaggaggaagaggaggtggaagaggagatggaagaggaggtggaagaggaggaggaggaggagaaagagatccctgaatccagtttctttccgttgtttctttgaccaaaccccatcgaacttctgggtgggggtgtcccttgaatttatgtaccctttgtaaagttcccagaattccaaatgtcacacaatggcagaaattatctgcagctgccaaagctgtgtttcttctagagcacaaggcaaatattggtcacctgctgcagacagtctgaagcagccccacatcccttcatgtggggttaagccaaaagcacattcctataaaaagaaaccaaaagtccagaattctcaaaaatgtcactatagcatgctctgagttccccgtcttcagcacttaaaaaaaagaaagaaaagacaagaaacagaaaaagaaaaaatgaaagacaaaaaccacaaactgtatagggcattttataattttcaagcaagtaattttttttttagtgaaatattccttaatttttttattcctggtactactaccacaattttcagggcagtatatctgatgtaatgaaaagacagtgctaaggcagagacattaggaataaacatctaattaacattctactgcattaatcaatattaatcaacagtttctttccccccctaaactgtgcctctggcagtctaagcaagaaaggtttcctatttaagctgctactaggaacttttggctatagattatcattgcttctgtctcagacttttacttcctgtctcaaagtaacctgcagttcccctgacaactcctcatcagttaataattgtaggccttttcctagtgtctttaaaaagaacaaaacaaaagaaaaataaccccccaaaaccttcttttactgtgtccaccacaacaaggactttaaaaatatgtttcttttattttttgaaattataatattacatcattatcctttccctttttcccttcaaacccttccatatatcctcttgccttcttttaaatttatgactaacagagcttttaatgacaactatgtactgtgctccatgaaaaccagttgtctattatcagatcatcttaactttgaggaataagctttgttaggtaatatttcacctatcaaaacagtccatccctcatatacctctacactattggtttctagagtatatgtataaatgtcacttatgtttttaacatttaaatgtgtgtgtgtacttatgaatgctaggacgaaggacagaagacagttcttgataattgttatcttttttttttccttccaccatgtgagaccaggggattgaatttaggtcatcaggcccaattggcagcaagcatctttacccactaatacacttctctggcccaccaaatatatttttagatgataaattatgtaattgatagggctggagaaatggctcagggtaagaacatgtactgcttttccttaggaacagagttttattcccattgtctatgttggggtgactcctaaccagttacaaaaagtaattcttaactgcccaggaatccatcccctctggcatccccagacacctatacatgacatgtacacactcaaagacacacaaacacataattaaagctaatcaaagtcaatctttaggtgctggagagctagcttagcagttaagaacacgtgctgctcttagacctgggtttaactgccccaaactaggtctaggagatatgtctcccaccctcttttaattttgtgttcacatggtgcatatacatacactttaaacacacatacatataccaaaaaattgaacaaatctttaaaaggttgtaaaacttgtatcatgagttttttccacaagaggtataaaaacagtagagggctcctgaaggttttaattgttttattgatttattcagtaatttgtaagtattgttcaagctggcctagaatgtctggtaattctcctacttcagtgtgcttggtctccagcccctgaaccttgtttttttgttttttttgttttttttttttgagacaggatgtccaagctggtcttgaactggctgtgtagctgaggatgatcttgaatttctaatctcacgccttcacttctcaaggacaaggcttccatacagactgatgatatcacacctagtttatgtgccactggggattaaacataaggcacagaatacattggcaagcactctacccactgaactacatctctggtcctgaagccttgcctaatttgatttcatattttaagttgtattcatgaattaagtgcaaatcttggtctgtttttctgttaaaagaaattcattcttcagaacatgttgatgcaatgttaggaagttattaagttactactttgtttgctaagttattttataatgccgaaatagagactttgccattaatgaaactgctttttcctacttaacaagggtaaagcttttgttattttgtttttttgtgacctttcttgttttcttcataagttcatgtttctacaagataaaatggttttgtcctcgtatttatttatttatttacttattctttttggttttctgagacaaggtttctctatgtatccctggctgtcctggaactcactgtagaccaggctggcctcgaactcagagatctgcctgtcgctgcctcccgagtgctgggattaaaggtgtgcgccaccacgcccggctccctcgtatttatttttaagggtagtatttttgttataacattgagaaaagagacaagtaagtactttgcttaaactatttaacctttcttgctattttgtttttaaagacaagtagaagcacaggtgagtatcagtcttttatatgtgaaacaagcttgcagctgtgagcacaactacttaggtcttgtttgtgtttcctttttgctgaaaatagggataagtaagatggaaagctaaatattcatgttaaaaagactcataacatccttctgaaatcattaaaagaacataactcattcattcacattttcacagatctttgatactggatttctgtgttctcagggagttgaggcagcatttccataatagcacaaaactatttgacaagaggaaaaactggtcaacttaaatattgagggaataaattaatactgatgtttgtgctgagacagaatatttaaatatttttaaggccatattacaatgggcaagtatttgaggtccttttgtctgttatctttctgtaatgtaggttagtttatcagaagtgtttgacagattggatagtgaccaattacttttaaggatacttgtgggcctactatttgtggacatagttaaactgatacttaaaaacaaaacaaaacaaaacaactttttgagacagggtactcctatatccaggtctgccttaatatttccatcttcctgcctcaggttgtaagtgtttatttttgttttaagtacaaatatctattatgcaagtgacttgtctgaatatgataacccattaatgattttgtacacaattttagcaaatctttgagatgatgacaatatttattatctgcaggctaataaatgtgcttatggcttagtgactcacaatataaactgacatttcagttatttcttttttttcttttttttaaagatttatttattattatatgtaagtacactgtagttgtcttcagacacaccagaagagggagtcagatctcattacagatggttgtgagccaccatgtggttgctgggatttgaactcaggacctttggaagagcagtctggtgctcttacctgctgagccatctcaccagccccccagttatttcttagttatgtaatgatgactaccataggtaggagttcagaacactgacacagcctctcttcagtcattggaaggcttattgaaaaagacatgtgttaccattgctgaaagtagtggaagatgaagctggcagaaatgcaagggaacaaaggcatttgtaataatgaagaataaaaagaaaattctacactctctccctttgagacaggattttattctgtattccatgttggtttagaacttgtggtaaccctgccttagtatttcaagagtttgggatttcaattgcatgaatttcgacagttccttccaattccattctttttctccctccctgctacccatccttcaaggtatcatacatcccaggtacaaagcttgatatagttcaggttgatcttgatttctgatctttctgctactgtatcccaagctttggaattacagtgtatgccaccatatcaggtttgtgtgctcctaggaatcaaatccaaggcttatgtatgctcggtgatcactgagccatatcctgaacccacagtgagtatttagtacatgtatacaaagctaagtatacccaatatgtggaaggtggaggcagcaggatcaggagttcagtgccagtttgaactgcatagtgagtttgaggtcatctttggttatgtgaactttgcttcaaaaaccaaaacctcaaacccctccaacaataatacatgtatacagtgtgtaatcactagaccagggtaattgccatatctattacctcacattagccatgcgcaacctttctaatgctgtgaccctttaatgcagttcctcttgttgtggtgacccctagccataacattgtttcattactatttcataactaattttcctgttgttatgaattataatataagtatctgatatgcaggatatctaatatactacccccaaaggggtttcagcccacaggttaagaattgctgcatcaaatatttatcttttgtgctgagaatacttgaaaatctctctactggcaacttttttgagacaggtctttttctactgaaccatcttgctcgccctgtctagtagaatacattgtttaataggtggtgggtgtttaatagtttataatggagattttcaatttttatatagatttagtaactgtttttacattggccttttattcttaatttggaacataattgtgtaacttggttaggtgtaacttgagatagtttgtggtttgcctgggctacagagtgagttcaaggctagattgaacttgtctagactgtccaaaggaaaacaatagaagagggataagggtctatcttattgatagagtgcttgcctagcttgtgcaaggctgtgggttcaactgcaggagcaaaacagcaaagaaaataataatttataaatgaattatggaccagaagatgtttattattttttttgccaacaaatggagtatcaaaatatgataccgaggcaaggtgtagggatgtgggtaacctatagcatagatactctctgttagtgatgatcttgtggcatcatattagcataagatagaatagagaaacaaaatctataagcttttttcccccagtgctgaggattgaactctaggctttgcatgttcaacccactcaaaagttggacaggagtgaaaggtgctgacaggagttggaggtgagaaagggtagagtggaattgatgtaaattcagtactcatgaaattgtcaccacgcccagcttttttttttaattgttattttggttttatgatttttttgttttttgtttgtttgctttttgtttttgttttttttttcgagacagggtttctctgtatagccctggctgtcctcccgagtgctgggattaaaggcgtgcaccaccacgcccagcttccacagttgttttacaacatatagtggccatttagaaaaagtctttcactgaattatgcaactcttccaaatattgaaaaacttcattgtatggtatcagatacactttccttagtgtctccaccaaagatgatcagggaaacctctatgacagtagtcatccccatagtggcagaaacgaatttttcaaaatgattttatcaaatactgttttccttgaagtgacaaacttggttcattgtagtcataacttgttagttgtttctcaagtggaaaaatggtgttctataaaagcaagatagttaagtctacagttaaaaaacactgttataggcttgttggtgactacctataatcccagtactttgggtggttgaggtaagagaattacattgaattagaggctagtcaaagctacagagtatatcccaaccataaataagaagaccctgtttaaaaaatacagatttacaggtagttttcatgtaggcaactgttaataattaaatattgggtagggattgtttattcaaatttctcattttatggggcattaaaatgacattttaaaaaaatgacagcactggatatggtgttgcatacttggaatctcagtgcttgtggcaccgaggtaggaggatcaagtgtgccaggctagcctgggctgcacagaaagattctgtgtctgccaaaccaaaaagccaggccagtactctggaggcaaaatctctgggatgtatagtaagactgtctcaaaaagccaaaccgaaccaaaccaaaccaaatgacaacaaaacccccaaccaactaacccccccctcaaccccaaatatttcagagctcagacattttttttttttttggttctggagattgaacccagagccttatgcatgctaagaagtggattaccactaggctataccccagccctgtgctctggatttacatatattaataattaatacattttttggtgctagggattttattcataaacaacattttttagactctgttgcagatgtgctgaaagatgataacctagatattaaggttgattttttttttttgtctcacatggctactaaggatctgagtgagaaaatccagtagcagttataaatacatttggtgtacaggtaaaattggaggtagatagacttagaagtgggtaagatcacccagtgtgtgtgggaataaagtggtgctgctaagagcaaaagcaatcacatatgaggacaaatgcacttgcaagcataagagatgattccactgaaaaggaaagggagggagagaagaggatttggacatccctaagctgaaactggaaatgctccaatgtctgaaacttcttgagtactgagataccactagtagaaacttccattactgacaggctgaaagaacacagcttaggaacatggtttatttagtgtgtccaacgaaaacaaggtcctgttagtccctttaagctacaataacactttttctgagcatgtccaggttctcacttgcaagtctgctttctaagtaatagaatgtattgtcactgtacagtaaactgttgagtgcataaagttaaaaatatataagattattggtagggggttgtagaaatggctcagcagttgatagcacttaactgctctttcagaggatctgagttcaggtcctgggacctatgttgggcagctcacagctgcctgcctgtaaatccagctcgagggaatctgaaaccttgtgccctccacagacacctgaacatggtatacactaatacaaatatacacatatacatgaaaacaaatcttattatgtgtaaggtatatgtgaaacaaaatacattttgtgttatgttttagtcctcagacattttaggtacatacaaatattttgaacagaaatacgaaaaaattaaattctggagtagttttcattgtaagcattgtagataagggacattcctccctacagtgtattaatttgcatcctgtgggctgccccttttggtattttgattgttttgtttttattttgggttgcacaaacattttctagtttgcagtttagtagtcaccaattctttaccaatcttgtttcaactatagttccctttaattattttattgttttatattactttgtagcaggtagcatgttatctatagtgttatattgaagatgagaatgtagtatttctttgacattctgattttattttctctgggtggtgtattatttcatctgtagctgggacataatgcttttagtctgctaccatggtgtgaaaagccactgacagatggtggatttttttttattaggtatcttaaaatgaagatgttctaattctgtcattttattggcatatattattgtacaaaataatgggtctcattatgatcttttcatttctgtgtacaatttactgtggtcatatccaatcctattcattccctcttctctctgcctgcccatcgcggtgctccgtttatgttttagccattgtcaaaaaaagaaaaaaagaaaaaaaagagaaatctagatttttcattcaccattccctctgttggctgaaatagttcaaaatggagacatttgattttatagagggtatcaaattcctatggtagcagaggctgctgattctcctttccttacctcttaagtcctaggattacagtcattcaccactatgtcaagtagtgatgaatttcttacttacttatttcttacttactattgagttactcagtgtttataatgagaggcagaaacattttatgtaagagatgaatcgccaatatttagaaagatgggtcgattgatctcgttctgatgtgttagaaggttttgtgtcatgatcataggtatttaaatacatctggggcatttctatatactttttaggagataaaacttgttccttaggaatcaactgtttttatgattgaaaattgatagtgtttttgttttaaattctagtttacatttatgccggattctcagtgaaaataaaagccatgacagttcgacctacagaggtatgatttttttttttaaaaagtatcatagctatcatttttggtttgtttaaagttataaatcttgatttgattttatataagagtgcatgtaattaagaccttatagtcagtagtaaaactgtagttacagtaagacatcttggatatacacattttgtctgtttgacttttataatagttgtatatttgtttaaatttctgtagttagctgtaccaatcataaatgagagagaaagctatcctggaaaaaaacctattttggtcatagttgcactagaaaatttccaccaaccaagttcagtgtttttgctcaagctggttgtgttcaggtggtatctggggagcttgttaaaggcagttgtcatggaaaatataagcaaaggagtgtttgctgaattcacagataggatatactaagtaaaaatgctccataattaagaaggatgtagattttacttttataggattttaccatttagctttcattaatttaaaactaggaacatggatttggcaaaagacaggccagaaagcaattgtgtctttatttataatgtttttacttatagctttcattggagataatattgtacgttttggtatgaaatcagtatttttataattaatagtttattttaacaaaataaatatataacaattattgtagagacatggcattgtgaatagatgattaagaacagtgtttttccagccaggcgtggtgccacacgcctttaatcccggcacttgggaggcagagacaggcggatttctgagttcgaggccagcctggtctacagagtgagttccaggacagccagagaaaccctgtcttgaaaaaccaaaaaaaaaaaaaaaaaaaaaaaaaaaaaaaaaagaaaaagaaaaagaaaaagaaaaaaaagtgtttttcctatagaaaaacttattttggttttaccaaaagttgagtattaccttaatttaagagaatatatttattagatggaacatttggagggttaaggggaaagtatttttaacaaatgaaataccaagttttggtttctgttattttaggaagctctgttttaagacttcacatctcagctgggtttggtggcacattcctgtaatcctagaactttggatgctgagatgaggattgtgatttcaaagccagcctgggctatgaagcgagttctaggccaatctgagctgtatagtagaaccctgtctcaaaaacaaccaatcaaatagcaaacagaaaatcaaaatgtcttttaataggtctatcatgacacccacaaatactagatttttaccttgtttataaagtaatataattgggctgtataaatgtatagctcagcagtagagcactggccaggcaaattggaagccctgttttttgtttctagtattctagtaaaatctgtatggtcactcataatgactttcaagtgtgtgtgtgtgtgtgtgtgtgtgtgtgtgtgtgtgtgtcacaaacacatatttgttttgttttgcctaagtatagttgactgctggaaatttaggaaagtataaaagtgtatatgtgtataaaattcttctctcatattgttaagttcctctgcctccgttcctcccaattcaccctcctaccttccctctccccgagatctactcctcctctgtctcctttcaaggaaaaatcaaaacaaaacaaaactatcagattcccagggatatctactgaacatgaacatggcctaacaagttacagtaggactgtgtataatgtataaaccttcatatcatagttggaagtggcagtccagtaggaggaaaaggatcctaagcacaggcaaaagagtcagagacatattctactcccactgttgggagtcccataagaataccaagatacataaccataatgtatatgcagcggacctagctcatcagacccatatagggtctgtgttgttgcttcagtctttctgtgagccccttatgagccctgcttaggtgattctgtgggttgtgttcttgtatcctcattccctctggttcctacaatccttcttctgcaggatttcctgagctctgcctaatatttgtctgggggtctttgtttctgttcccatgagttgctggatgacagttgggctaggcatcaatctatgagtatagcaaaataccattaggaatcatttcattgatttttctttttctgtttcttccaagttgtgccagtatccctgtctagttgctatccttaaaactgcttttcctaaaatgttagcactaatgtgaagtatttactaaaattttttcatgtatgagggttgaatgtttccctgcacattgtgaatgtaagtgtaaagttttccgactctagctggcttggtagttttaaagcatcattttcttagggtttctgttgctgtaacaaaactccatgactaaaagtaatttggggaggaaaagatttatttcattttatagcttgcagtctatcattgatggaagtcagaacaggaactccagacaggaagatggaagcagaagctgatgttgaagtcgtgtaggagtgctgcttagctaggcctacccctccctccctgcatacctgggatcaccagctcaagggtcacagtgcccacagcgaactgggcccttctatagcagccatcaaaaatcagtcatgaaactgtaccacaggcttgcccacaggccagtctgttaggggactttttctcagttgaggtttggtcttcacaagtgattctagttcttgtcaaattagcataaaactagctagcacaattgaccccttgtcaggttgacacacaaatgttagaccctaacatttctttttgttcatcctcctattaatgttaatattacaatataaaatattccaactttaaaagtctcagtctttaaagattcaaacactttaaaagttcagtctctttaaaacagctaaagtctcagagtttaagcatctgtaaaatattcaaattctccaaaatatccagtctccaaaatatcaagtccttctaaaaattccagtcactttaaaaattcagtctctcaactatgtgttcctggtaaaacaaaaaagttccatagtttttgactccaagaggaaataaccagggcacagtcaaagcaagcaaaagcaaagttcagcagtggacagtgttcagtggttgatgtctgggacctactctttatcatctgggcatcaaagggctagaattagcactccttgctctgccagccacagctagtttcctaggctctggatggctccactccatagcttcgctgtccttggcattcatctggcttctccaaaatgctggggtctcctgctataactaggttgcatcttcaccactgtcctttcttgagttctcttcagggactctgattctgccacaaggcatgaagccttcttgtttccatgactgcttcattcctggggcttctgtttcagttgaggctatacattcacccatggcctgtcttggtctcgaataatgtcaagcctcagctgctctccatgtcctcttcagtcctgggatttacactgctgcggaggccagacttttaccaatggcttctcctggcctctgagtgttgctcttcataattctctaatgcagcgcttctcaagctgtgggtcaccacctcttggtggctcaaacaaccctttcacaggggtcacatatcaggtatcctacatatcagatattttacattatgattcataatagtagcaaaactacagttatgaagtagcaataaaaataatgttctgattgggtcatcacaacatgaagaactgttttaaggggacttagtcttagcattaggaaggttgagaaccactactctaatgcctataaaatcattagtaaactcttcaaaattacttagttctgccagcatgaggtataatcttgacccttcctggaccacagcttttgtttgctaactccaaggaaatatttcccagattttgcctcactgatgctagtctcttcctcctcttcttcctcctcttcttttgaggctgcaacattttttccattttttgttaatttttaaaaattatttgtttcacttttattttatgtgcattggtgtttgaatatgtgtgaaggtgtcagatcttctggaactggaagtatagacagttgtgaactgtcgtgtgagtgctgggattgaatccggggcctttttgccctttctcacttctccagctgctgtgacagttttcattgagagcaatcaggcttttttatacctttatcagaaagagaatataatggcagttgccaggatcaatacagttgtagttgccaggatataatgtgtgcaagctattcagagtacacaagattgtctaagaccaagtcaagcttacatacttccttgacttctgagggaatatacagagaaccataaagtggcctgaacccttcactgtctgagggagtgtattagtctttcaggaactgcacaacatattgtgctccatgagccatggactctaacctgaaaacctgtgaggcatatgcctcagggcagctaggccagtcaaagtctatggtttccctccctgcaagtcagcccaattagagtggataatagtggatctttgctttattaaaggagttgcaaaaaagaaaaatgtccatggctcccacatcccacttgaaaccactcaagccagactgtattgtgtgcaggaagaaagggagtctcatgtctcacatattcttagcttcaagagtatttgatagtatgaaaatagtaggcatcatagaattcttagatgtgggtacttatttttctgttgaaagaggaaatatataagaagataggtgtattagtcagggttctctagagtcacagaacttatggataatttctaaatagtaaaggaatttattgatgacttacagtcggcagcccaattcccaacaatggttcagtcgcagctgtgaatggaagtccaaggatctagcagttactcagtctcacgcagcaagcaggcgaaggagcaagagcaagagctagactcccttcttccaatgtccttatattgtctccagcagaaggtggagcccagattaaaggtgtgttccaccacacctttaatcccagatgaaaggcgtagcccagattaagggtgtgttccttaaactcggagattcaatcttctggaatccatagccactatggctcaagatcttcaaaccaagatccagataaggatctccaagcctccagataagggtcactggtgagccttccaattccggattgtagttcattccaaatattgtcaagttgacaaccaggaatagccactacaatccaccccttgtcaacttgacacaaataatatctcatgttcacatgaaacaataacaaggttgtaaatatgcctaacatgatataactatccctcgtacaatcgctaacgcattagtaaatttacaatgggcattcatattactttataatcctcgtttctgcaactggttacgtggccttaattggtatttataactaccttcctctactacccattctgtatttccttctccttcagccagcacctcagcaggtcttggctcttttcctggaggattgacccataccttcattcctgatgggtctgcgtcctttgtcatcctgcttggattaggctgttgtagtttcccattgactttaatcacaggacatggtagtactaagagacgccctaagggatctcctacactccagacataatcttgcttaccaccattgtgaagaggtaatccaatttccccatggtaatctggatctatcacccctcctaacactgttattccttttttagcctgttggtttaagggcattagaagcccaaaatgaccagggggaagtctgagcttccagttcaatggaatgtttgttgtagctcctggtaggagcactcccttctctggagccaaaacttctaggccagcagaacctagagttatggggacaggaagcaaaaattttcctagagggtcactaggagtgatagtaagtggaactattccgttttccaccccttgattcctggacccatgaatcctggctatgggtgaaactgtaccatatatcgagcgctgattcaaagcatatactgccttctgaagaactctgccccagccttccaagctgttaccacctaattggcgctgtaactgcatcttcaaaaggccattccatctttctatcagcccagctgcttcaggatggtggggaacgtggtaagaccagtgaattccatgatcgtgggcccactgtcgtacttctctggctgtgaaatgagttccttggtcagaagcaatactgtgtggaataccatgacgatagataaggcattctgtcaatccatgaatggtggttttagcagaggcattacgtgcaggaaaagcaaatccataaccagaataagtatctactccagtaagaacaaaacgctgtcctttccatgaaggaagtggtccaatgtagtcaacctgccaccaggttgctggctggtcacctcgaggaatggtgccatatctgggacttagtgttggtttctgctgttggcagatctggcaatcagcagcagctgtagccaggtcagctttggtgagtggaagcccgtgttgctgagcccaagcataacctccatctcgaccaccatggccactttgttcatgtgcccattgagcaatgacagggatggctggggagagaggctgactgtccacagaacgggtcatcttatccacttgattattgaactcctcctcggctgaagtcaccttttggtgagcatttacatgggacacaaatatcttcacatcctttgcccatttggagagatctatccacatacttcttccccagatgtctttctcaccaattttccaattgtgatctttccaagtgcctgaccatccagccaatccattggctacagcccatgagtcagtgaataatcgtacatctggccatttcttcttgcaaacaaactgtaataccatgtgtactgcccgaagttctgcccactgtgaagatttcccttcacctgtgtctttcagggttgtcccagaaaggggttgtaatgctgcagctgtccacttctgggtggtgcctgcataacgtgcagagccatcagtaaaccaggctctagtcttctcctcttcggtcagttgatcatagggaacaccccatgaggctataggtgcatgcttggcagcagatggcattgtaacaggagtagaaaccataggcatttgagcaacttcttcatgtaacttgcttgtgccttcaggacctgctctggcccgatcacgtatataccacttccatttgataatagactgctgctgtgcacgtcccactttatgacttgcagggtctgatagtacccagctcatgatgggtagttcaggtcgcatagtgacttggtgtcctattgtcagacgttcagtttccactaaggcccaatagcaggccaagagctgtttttcaaagggagaatagttgtctgcagatgatggtagagctttgctccaaaatcccaaaggccttttctgtgattcacctacaggggcctgccagaggctccaaacagcatctctatcagccacagacacctcaagtaccatcggatctgctgggtcatatggtccaagtggtagagcagcctgcacagcagcctggacctgttgaagggccttctcctgttccaggccccacacaaagctagcagctttccgagtcacttggtaaataggcctaagtaacacacccaagtgagggatgtgttgtctccagaatccaaatagacccactaaacgttgtgcttctttcttggttgtaggaggggccaggtgcaataacttatctttcaccttagaaggaatatctctgcatgccccacaccactggactcctaagaatttcactgaggtagatggtccttgaattttggttggatttatttcccatcctctgatacgcatatgtgttaccaatgagtccaaagtggttgctacttcctgctcacttggtccaatcagcataatgtcatcaatatagtgcaccaatgtgatattttgtggaagatccaaacgatcaagatcccttctaactaaattatgacacagggcaggagagttaatatatccttgaggcaaaactgtgaaggtatactgttggccttgccaactgaaagcaaattgcttctggtggtccttatggacaggtactgagaagaaggcatttgccagatcaatagccgcataccaggtgccaggagatgtgttaatttgctcaagtaacgaaactacatctggtacagcagctgcaattggagttactacctgatttagttttcgataatcaactgtcattctccatgatccatctgttttctgcactggccagataggagagttaaatggagatgtggtgggaaccaccacccctgcatctttcaagtccttgatagtggcagtaatttctgcaattcctccaggaatacgatactgtttttgattcactattttctttggcagaggcaactctaaaggcttccatttggcctttcccaccataatagccctcactctacagttcagggaaccaatatgagaattctgccaatttctgagtatatctatcccaattatacattctggaactggggaaatcaccacaggatgtgtccggggacctactggacctactgtgagtcggacatcagtcaaaactccattaatcacctgccctccataagcccctactttaactggagggccacaatgtttcttgggatcccctgggatcagtgtcaactcagaaccagtatccagcagaccccgaaaagtctgattatttccttttccccagtgtacagttacccttgtaaaaggccgtaggtccctctggggaagaactggagaaagggtaacagcaaaacctttgagtgtcttatcaagatccttcctcagaggaacctggccaccccttcattcaaggggttccggatctgcaaactgtctcaagtctggaaattgattcactggccgagattgctgtttaccacgatctaatgtagcctttctttcatttgtttgagaatttttctgcttatacagatcaaacaaatatgcagtaggcttcctatgtatttcattcctggaaacaccatgattggttagccagtaccaaaggtccaaccgagtcatgccattataaatttcacctctcctgtgctgaccattactgggtatgttattataaacattcttttgtctacgctgtccattataataactaggatcaccttgtctctggcgattcaatgctgccacctggcccttgttacctcgggatccaactaaacccagtgaatttaattcatctaattgagcagaagcatctccaatgctaagatctggcacaaggaaaagggaaagaacaaaacccttcaaatgtgctggtgcccctctcaccaatttgcgtcttatagagctggtgaaaggcatatcttctggaccttcccattgtggacaattatgctttacacaatatatccactctagcattgcaatttccctaagtcttaaaatcccttcatcaacactaagccacggaatatcaggcatctccaagtcatttccagtaggccatcttttgataaacacctcagccaaccattcaaacaaacttttgacaccttttttaactatgcgagcttccgtattaaacctagaatctctactcagaggacccatgtcaataaactcagcctgctctagttttatgttccttccacccttatcccacacccttaaaatccattcccacacatattcaccaggtttctgcttgaatgaattagcaaactcattaagctccttagtagtgtagcgaatttcctcatggactatactttctacctcccctctaggagcctgttttgctttgagtctggttacaggtctagaagaaactattggtgggccatgagcagactctgcaaaattaatttcctcatgtggggaaggcattatttcaagaggtggggctgagggtactacttcctcaggtggggcaaacccttgagaatctgaggattcaaaattctcagcttcaacatggtcttcccacacatccccgtcccatgttgtaggatcccattctttgccaattagagcccttactttaactgtcgacacactctgaggctgagacttgaattttctctgtagttcagccaaccttacaatgagagtttctgtttgattttctgcaacttgagctctattgctacaagagagaagattctcctcaaggacacacttagcaacttttagatcgtttacttgtgtctggagcctttcgattttatcacacaactccttcctttcattcatcattttttccacagatactaagagcagccagccagtaaaatcatttttcgattttttccccatcttgtagaaagctttgtgcactgaatcacctaattcattaagaaaatcaagggcattagcttctttaagttcggaatatagtttcaaccatgggtcttcaaaattctctgagctcccaggagggagagaatctggagaggtttcaatatttgaaagtgctggtggatcaacaagccaattccagtattttaaaagattcatccttgtacttctgttactctagaaccactcctggtaccaacttctgtattagtcagggttctctagagtcacagaacttatggataatttctaaatagtaaaggaatttattgatgacttacagtcggcagcccaattcccaacaatggttcagtcgcagctgtgaatggaagtccaaggatctagcagttactcagtctcacgcagcaagcaggcgaaggagcaagagcaagagctagactcccttcttccaatgtccttatattgtctccagcagaaggtggagcccagattaaaggtgtgttccaccacacctttaatcccagatgaaaggcgtagcccagattaagggtgtgttccttaaactcggagattcaatcttctggaatccatagccactatggctcaagatcttcaaaccaagatccagataaggatctccaagcctccagataagggtcactggtgagccttccaattccggattgtagttcattccaaatattgtcaagttgacaaccaggaatagccactacaatagggctaactaatttcaacacttagcccacaacaatcaataaatccatttttttgtttgaattccattcatgtctctgttccttacttttactttgcctttcttacatttaaaaaaaactattgattctttgtgaatgacacattgtataccctaatcctattctcccagtccctccatagctggcctctacccttgcaacctcccctccaaaacaaagcaaaaactaaaaaataaaaattaaacgaacaaactcccaacatcttagtgtgaaaggtgtggtatgtcacactgtgtcacacagtatacctttttgcccaaacagctttacttgtaaacgttctttgcaatgattcattcgtctggttcaaggcctctggcttctgctaccccatcaatactggattctcaccaggattgttgccctgagtcatggagattttgtagctttgcttctgtaggacgggctccttcacatactccagcagctcatagatgggatagatggtgggctgggccaactcaaggctctggatctgggtctggctggtagctgagttggtcagcccactagctctcatgtccaagccactaggccagctctcccgtgtttgcctagatgaggggtggaactagctctcctgagtgccagagcttggtgaggggcagaactagctttcctatactggtctcttcttccttctcctcctcctccccttcctcctcctcctcctcctcctcctcctcctcctcctcctcctcctcctcctcctcctcctcctcttcttcttcttcttcttcttcttcttcttcttcttcttcttcttcttttgtggtttttcgagatagggtttctctgtgtatccctggctgtcctggaactcactttgtagaccaggctggcctcgaactcagaaatccacctgcttctgtctccagagtgctgggattaaaggcgtgtgccaccactgcccagcttactggtctctttttaatcaccacatatttctctgctctagccaacaagcatcaattgccatgggctctgggctcttgttaatcaccagttatctcttccactctagctgacctacagatgattaacacaaaatattacacaaatggccctggtcgagtctttgcttccctttgaaacatcaaacacccaaccactattatctgcattgctttcagcattcttatcatctaagctccctgatctctgaactctaagtgtctttttcagctcagattgtaaatgtcgaaacacatggtcaagtctgtcatagcaatacctcatgatctgataacaatttctgtctatttctgtctttagggtttctattaataaaataccatgaaaccaaagcaacttgtgtttaccatttccttaaatataatagaggttcatgatcatttataaatatttactcagaaaagctgcaaattagaatctttcttggctactcggtggtctataatttggctcattttatatttcatttgttcaacaaaatgacctgggtcacttttctctattttaatcttttgtggttaagattagaatccacagagttccagtgaacagtatataacatactccaagaccacaattaatgaaaaccagctgttttgttcttgtaagtgattgcttaaaaaagtcatgtggataatttaaaataaataatattgtgtattttgtaagaaattttgttaacgtaagtgaaaaataaaattgacctcatttctattgtagcaacaaatgtttttctttgtttatatggcttatttacttttaaacacagtgagggcatagcagaatacttaaaataataagttcttcatgaagaattgatgtcatatttgtttagaaaatgaatttatggacacatttatttcactgctaaataatatctttattgtttaaaagaagatagacagtatattttgattttattttgtttctgctttatgattagtacttacatcgggattttttttttctttttccaattttttttattagatattttttcatttacatttcaaatgctatcccaaaagtcccctataccctcccccccaccctgcttcctctacccacccactcccacttcttggccctggctttcccctgtactgggacatataaaatttgctagaccaaggggcctctcttcccaatgatggccgactaggccatcctagagacacgagttctaggggtactgattagttcatattgttgttccacctatagggttgcagaccccttcagctcttgggtactttctctagctcctacatcggggggccctgtgttccatcctatagatgactgtgagaatccacttctgtgtttgcctggcaaaaacactggcaaagcctcacaggatgttccaactggtaataaggacacatgatccactatgttcataggagccctatttataatagccagaagctggaaagaacccagatgtccctcaacagaggaatggatacagaaaatgtggtacatttacacaatggagtactactcagctattacaaacagtgaatttatgaaattcttgggcaaatggatgtatctggaggatatcatcctgagtgaggtaacctagtcacaatagaagtcacttgatatgcactcactgataagtggacattagcccagaaacctagaatacccaagatacaacttctaaaacacaagagaatcaagaaggaagaccaacgcttggatacttcattcctccctagaatagggaataaaatatccatggaaggagttgcagagacaaagtttagagctaagatgaaaggatggaccattcagagactgctccacccgggggtccatgtcataatgagccaccaaacgcagacactattgcatatgacagcaagattttgctgaaaggaacctgatatagctgtttccagtgaggattttttttttaattttattttccataaaaggggattataactaggctttattttagtttctttgagggtgaaatggtgtggggcaggatctcatgtagtcaggttggcctgcaatttgctgtgtagatgagatggctttaaactcctgctcttcctgcccctgctttctgaattcgtgctgggactatggactggctgtacaccaccatacgtggtatttctatgttttagaggaagtttcctttgagtacttttctatttcgtcatcctggggattgaactcaggatctcagcaatgctagggaatcactctatgttgagctacatttctctagctcctaggctttattttatatttgtgttttaggttttttttgagaatgtgtcatgtagcccatgctgatctggaacttgatatctggaatttgagattgactgcagatctgtctacctctatctcctaagtgcttggtttacaggctactatgcccagttttatgtcatgtaggaaatagaatacagagctttttgcatggtaggcaagaccttgacaaactgattcatgtcagtaaccctctattaatggtttttagcactccttgtttttcaactttagtgattggaaggagaaaaattattatacagaaataaaaaatgactcgaaggtgttcagtcaacttctaactccccagtcaataaaagactttttgttgaggaaatgaggcggtgataatagcatggttacttgtagttgacaattcttataaaatagcaatttttgtttgtacatatatatatttatatatatctttatttttttgaattctgatataaattgaagagaaaaagaagtttagattttgggagaaatttcctaccatatttaactctactccttaggtcttattgtagcctcaggattgaattgagtgtactctgaatacatttaggcaaatctgtgaaggtggctagtggggagatggttaattttgtttatatcttgttggggtacagtgtactcatttaaaatatttctgaaaagacactggcaaaatgccctaaaatgtgttagtgggtcaggtgtgctagtacatgtcctgtaaattcagtacctgggatcttgaggcaggattgtccttcacaagttaatgagacattgtctaacattaaaagtggctggtgatgtagcttattgatagagcacttgcttagcacacattaagctccagcactaccagaagaaaaggaagtattgaagaggaataaaaaatattaaatgatgtccatagtaaatgtgtgaatatgtgaaatttgtagccatggaaaaaagagaagggaatgcttaacctctagttgtattacagtggagaacgaatggttaacttttcccaaacccattaatgttgttttttgtagaagtaaaaagatatgctcctacagtaaacttatattagatatatatatcttgttaccgatgttttgtaattatgagaaataaagaatagatttttcagagtttgcctttcttgttaaagatactatctttacactgtgtcttttatgttcaacagattttcaacaagctctgtatgagttgtcataccatgtcattaaagggaatttaaagcacgaacaggcatctagtgttcttaatgacattagcgtaagtatatctatttcaaacagtaattgtttcgtatctcctcatttttgctacaaagctctttgacgtgtataacatgtactttgtcaaaataatagttttaaaggtaatattggtaagccatttttgctctacaaaaatcgacattttagtctttccttctgtttgtaaggaagaaaaggttataaaaactggcttgagcaaaacaaaagtactggaatgacgtcaaagccttaactaatattttgactctagaaataaagtattttcttcaaataatgatactttttggtaattatgactataattttattttatgaattaaattattttaaattgcagttgcataatcctgacattaatttgtttgtatctacttcctacttacttttagaaaataacagctagattttttttttaaaccttcaagtggccagtttggttttacttacatttattggaggatttaggctagattcagagcaaatactttcgaatgtagattcaatgtagattgctaatgactcaggctgtttgataatttgaactggaagagggactgttaattgttagggtgtttattgtaaactcataatttcaagtggtgtgctagtctgttgtgagactggtctttagatttgtgtaaattatttgtccaacttttctaataactattgagatggtattcgggaacttatgtgaattttctgtatgtttatgtttctgtagttctttcctgtgggagtttggaatgtgcttcatatgatttttgtgcttttcttgggtagttttaatggaagttttaagtttagctgttgtgatactccacccctcccgaagtacatttgagcaggacgaattttaatatatatttctcttccttcctgaaactgtctccagttaacataaagtggtatatttctttggaaaaaacccttgcatctttctacttctgttctttaattaatctgagtatttgcattcataacccttgaacaactgagagccactaagataatttcattctgtaaattgagagttgatataattttagtctgtatgcagaattgactacaattatttttccatttatgaaaatagtctaaataaacattatctatactgtgtttttagaagttagtgtgtcctatattttgaatactttattatatgtatatacttctaccctgcattgcctttgtcatggcttttccatactaatatatatttgtccagtatcttaatcacacatatggatttatatgactcctagcagctgccagctttttttctttgaatttctttcttatagtctctgaaaatagatgaattttagggttgctatagtaccagaaaactactaattacagtaactgaactgtgatccttactaatgggaaatggctctaaaattgatcatggaagtagcaagccaagaaataattgtggactaatgctggtgctttcatccagaaacaagattttgggtcagccccccccccaaaactataaacaaagagtgaataaacaaaataaaaagaaaaattgataattatgtcatcttcacagaatcttgaattatagaataattgcttttaattgatataaattttagatttctgatcttctgacatatgattttttttttgagatagggtcttactatgtatatgtagccctggctaacaaggggtttgcagacatactgacatactgcagacatgactgacagaagcctgcttgcctgcctgcctctgcctgtctgtactgggattaaaggcctgtacacatgcagcccaagtcctttcttctaactgatcgacattcttatacttatgaaccttaccttggagaattctaatgtagacatgctggactttagttgacttctacttgattgatgagaattgttttgaaataataacactttttccgtgctattctggaactgattgtaaatctttaatgtaggaattccgtgaggatatgccttctatccttgctgacgtgttctgcatattaggtaggtgggaaatgtttattttgcatgtaacaattttgtgataagatcaggttaaatgcttttttttttttacaaacgtgcagattttctgcaaatcttcaatcatttttaactttacacagaatatagttttgtaaatcaaatataattactttataaattttataatttaatttaacagtatacttttttgattgataatgtatatttatgtaagtttgagctaaatgggctaatttcaagtaaaaaaaaagtcaagttttctcacatttgcctgcatttctgcaattatagtaactacatcatgtcattcaatgagatttctctgaatctcaaacgttcccttttaagtcttaattttaaaatgagtaagattagtcaaagtcattaaaagtacattggttttgaggataaaaagtttgtgttgtatttatccagaattcatataagaattcatataagacttttttctcaaaaaggaataattctttgatttccaattaaaggtagtgtctctgaggaaaacatggatttacaaataatatgttttgaaaatttatttgtctaatcttagctattgattaaataactgagcatggcttccccatcagttttgttctttctgtaattttgagtccaaacatataacattgctagacatatattacctttaaagcaagccttatcttcaagggtttgccaagttggagttacttcagtttattacttttaattcccaggatttggtgagttaattaaatggctcactgagtatttagagtttgttcttagctaatatgaattcctttggtttttgagaatgtttcaagtttcagaacagtggcaattttaggaacaggttaaaatatatttgagcgagtgataaatgtgaaagaaaggtcactaatgagtcagccatgtgtcctgttttttccccctcctggaaaaatcattaataggtaaataaaattaataatgaaataaataaataaataaaatcagtaataattttttacacccaactgtcctggtttgaatgataaagtacatcttcactgtatttaactgattggtttatacaaaatgaaaaaagatacttaatatttgaaaatgatgctaacaaatatttaatacacaacaaattccaatgtaaacacaattgtctttttccacaaattatatatttaggaaaccaatttctaggagctatttttttattttatttttattaggtattttcctcatttacatttccagtgctatcccaaaagtcccccataccccctcccccactcccactttttggccctggcgttaggagctatttttgaaagatgttgtccttagtagtgttgtctttctttagtactcatcagttactagccttttcgctctcttcgattcttcaaatctagtagtttttaaaaagttgacttattttattaaaataatacctttccttcatttttttagccaagtgactctttctacaggtcattgcatattattgtaacatagattcatgatggtgatatatagttactttgggggaaatttattccatactacccaacccatttttacaggcatgatttgaatcccatacttgattaagaatatccttcatctgccccctcgtgcacactcactctaggcaggaaaaaatgatacaaggatgactccagaacaagtagagaaattaggattaagaatgtgatctagggctctagagatggcctagagcttaaaagagtagatagaggctgctctttcagaggtctaagttcaaattcccagcaaccaaagggtggcttgcaatcatctacaatgagatctgatgccctcttctgatgtgcaggcatccctccagacagaacactgtagacatactaaaaaaataaatcctaaaaaaacaaaaaggaatgtgatctagctggctgggaaggctcagtagttagtaacacttgttgctcttacagagaacagagatttagttcccagcacccacatggcagctcctcatccttaggtccagttgtagaggatcttaacctccataggtaccatgcttaactgtgtatttgtacatatacatacacacagttaaaactcgtgcatataacgtttgcaagaccagtgggcctctcttcccaatgatggctgactaggccatcttttgatacatatgcagctagagacacaagctctggggggtactggttagttcatattgttgtttcacctatagggttgcagaccccttcagctccttgagtgctttctctagcttttccattgagtgccctgtgttccatcctatagatgatggtgagcatccactcctgtatttgccaggcactggcatagcctcacacgggacagctatatcagggtcccttcagcaaaatcttgctggcatatgcaatagtgtctgcgtttggtggctgattatgggatggatccctgagtggggcagtctctggatggtccatccttttgtctcagctcgaaactttgtctctgcaactccttccataggtgttttgttcccaattctaagaaggggcaaagtgtccacactttggtcttcattcttcttgagtttcatgtgttttgcaaattatatcttgtatcttgggtattctaagtttctgggctaatgtccacttatcagtgagtacatatcaaaggggaacgccagggccaagaagtgggagtgggtgggtaggggagtgggggggagggtatgggggacttttggaatagcattggaaatgtaaatgaagaaaatacctaattaaaaaaattgaatctataaaaaaactcatgcacataaaattaatctttaaaaagaatgagagttatgtgtaataatgatgatgatactaataataatatggcataggtgctatttttggaacacctttcatattttaggcatcatgttaaagtttttcatcttataacatcttatatcttaatcttataacaactatatggtaggtatgcagataggcaaaatgaggtttagtgagagggagcctgagtaacttgagaggctgattctgaagtaacatgatgcactgatgagaccttggaggtgggccagttggctgatgatgtagaagacaggaggaggaggaagctgagggctttttagataatcataggggaaattaaaaaagaacgtactaagtgctaattaaggatactggacggaataaggtatgatgaaacatttatttgaatgctgttttgagtaagaaggaaaataataatgaaaatagaggaagtataattgggataactactaaactgtgtgttgagacaggttaactaacagatttcctgaggtcctgttcagtattactaccataatcacaagctgagagaatagtaccttaatcaggtcaggtagctacgaggacttgagcaccatgtgcctgaacttaaggaccttagtgatgtcatcttaacaactaactcagagataactgggaacccctggaaaaattaatgagatcagttaagtctttgagaaaacaccgctaaacgtagagattaactgggcttgggggtatatgcttctagtcccagcactctggaggcagatgtaggtagatctttatgagcttgaggtcatcggcctggtccacatagcaaggtccagacttgccagggatgcattatgaagccccatgccaggaaaaaaaaaagttgagattgtattgtaagttacattgcataaatcataccctaaattttctgtttaagtctttcctgtgtgctgtagtgtatagaacccatgatctcacagattctaagcaagtacttgtaccactaagccacacccttatcccctaaaattttcttaatgtacttgtgctaactttgtgctacagttgctaggatatgggtaaatggcagttgtcaagaaggaatagtgaagggtcaggaaaacatttgatgttataaatttccttctcttttgatttttcatgttgacagtagaatgtaaactaaagtaaaactatggtaaagttgcattatttcggaagatctacttagaggtactagttattacttcaataagactaatgacatttattgtacagtctaaattaccagttgactttaaaaataagtaattctaagcacttggtaggtagaagcaagaggatcagaaatttaaggtcatcttggctatttagtgatttgactgcaagagactctgtctcagggaaaaaaatcagttaaagcaacaatctgaggtcaacctttgtgtaattctgcttatcttatttgaaaattttgatgtttggcattttgcattaattgttttattttatccacacctcagatctaagcttggatacgttttctgaacaatttttaaaacggagggaagtctgtatttttacacatttcagtagaaataaaatgccagtgttgagtatttttatttagtgactagaattagtcaaaacaggattttaaatataccttttaatactgacttttcatagacttggtgacattagacttctcaacttcattgataagtgactcttaaggttaggaaacattttttttttggtgccagccctggggaaactgagaaaagagaattgctgttgatttaaaggtcagcctgaagttcattgcaggttgaagacaagcctgtgctacataatgagaccgttttgttaaaaacaacaacaacaacaacaaccctccccaacaacaacaacaacaatacccccctccccaagacagagagctgacttagtggataaagccttttgctaaggcatgaggatcagagtttgaatcctcagcacacacaagaaagcagggtaagggccatgtggctgtacacatacagctctagtcccagcactagggaggtagaggcaggtggatctttgagttagaggtcatttgtattacgtagtgagactttgtcttaaaagggggaaggggtcactatggtggcttgcctgtgtgagaaacggacataatctttggcaagctggctagttatgttagctaaattggcaaactttgagttcagtgagagagactcttcctcaataaagtggagaacaattgaggtagacactcgacatcaatcatcctatggcctccatacacgccaatgttaacaccacactcctgagtatgcacagagcacatatatacccactcaaaaaggggttgggagacaaaacaaccaaccatcagaatggccctttttgctgttgttgttacaatacagaatcttcctatttagtccaggctggtcttgaactcatgatccttctgcttcagccttctgagggctgtgattacatttgtgtaccacaaagcccaactaatgtggaagaggttttttcttgtttcctagttcaacttggccattatggaatgagtctctatttggcacctctgacgagtggtcatttaaactttgttagaattttttcctttttgaaaatagtatttttatttctgaaattgttttcagtgtttcttgtgatacaaacttatttatggatgcatgctataggctacagggtcagtcatcagtattaagagaaattaaggttttatgagtgtatgaaagatatattattacagtttatattttttccagattcagtaagagttatttttaatcaattatatttatttttgagacaaggtatttctttgttcctggtctgacctggagctcatactgtagactaggttggtctgtagcttcggagccttacgccccctgctcctgggtgctgagactgcttacaggtgtgtactaccgtacctgacacagaaagcggcatttttaactaagttttaaagaagacgaatcttttagtaggggagagtatagaaaaatgaaatttgtatctctttccttcccattctagatattgaaacaaattgtttagaagaaaaaagcaagagagactattttacacagttggtattagcatgtttggtaagttttcagatgtatttccccttctcaaatttgcattgaataagtataatcatagttgataattttaaatgaaggatgatactgacattcatttgacttaatgataaggtgagatttagatcttgaaatggaatgttttgtgaaattaggtattcaatttctgtaaaataatcataattttaaattatttaatctattacctataaaaacccttagtgatatttctgacccagtcagttcctaatgtagaaattttaagcaactatgaactaagtagaatttgttgtagtttgttcttaaactgatttttttgtaaactttatttgttagggataaaatgatggaggcagtttaagaagaataactataagttgtgctgtggatgcggtttagttgataaacttgcatacacgaaaccctggttctacccctagtaccctataaacccggcatggggacacttgcttgtagttggaggtggaaacaggatcagaagttcaagatcattcttaactacaatgagttcaaagacagcctggggttcatgagacactgtctttaaacaaacagcaacaacccttccccataaaaatagaagtcacaattgtctagtaagccacttcatgttcgtaaaattagagccaaggaaaagtaccattactaggatgtagaagaacgtccttgtctttgttatattacagtttggtttactgtagaaaatgtagaatgctgaagtactttgttaagtgaaaactgagttaagataggctcaatgtaaggaaatttttttttctcgaggcagggtttctctgtgtagccctggctgtgctgaaactcaactcactctgtagatcaggctggcctcaaactcagaaatccacctgcctctgcctcccaagtgctgggattaaaggcgtgtgccaccactgcgctcaatgtaaggaaatttaatctgtagttttactctaagctgtgtatagcaaacatgtaattttaaagtaatttttgaaagagctatataatttacttttcagtatttggagggtcattttgttgaattgaaattttaggcttataaagagacacagttttatattcttacattggaaagattattttgaatatatttaagagtgtgtgtacatagttggaatgctaaagaataaatggtctttaatattttttaatgcagtatttagtttcagacacagttttgaaggaacgattggatccagaaactttggaatcattagggcttatcaaacagtcacagcagttcaaccaaaagtcagttaaaatcaagacaaaactcttgtaagtatatgtggcttatgttacagatcaagtagctgaatgtatagttctcattttaaatcatagcagtttctaaaggctccttgaaggtttttttttttgaaattaactttatccttttaatgatatttctgatttcagttataagcagcaaaaattcaatttattaagagaagaaaatgaaggttatgccaagctgattgctgaactgggacaagatttatctggaaatattactagtgatttaatattagaaaatatcaaatctttaatcggtaagccatacctgtgtctatataatatgtgttattaagacaagctttaattttaacttttagaagatatccataaagaaaaaataaatcaccctcagttgtatggtgagtttgtggacaacaggaaaaaaaccaaagaactctacacctgggattatataacttttaatttgagtattttataaatatttataaaatttatcatgatctttatgaaaaatggttttgtcattgttgcctgtatgattattctaatgttctctctaattcttctgtctgtaaattttaactatatctcagacattttcatagagggtaaaaataaaactttaataaatgtttacagaaacttgataaatagtttttttgaacttgattttataaatacagtttgtgactttgataacacattttacctttatttctgaaagtagcagaagttgcaaaaatatagcagaaaatattttctctttagttttaaaatagcatttctgtcacattacttttgtcttgagcatttgaagagagtagctgacaatggacaggaggaatgaatagggcaagcctggttttctaagattggcaagaattcctggtattatatagtaggtagtgttctaatgagggaatattttggagttgtgtaaagtcatagtttttgtgatttccaggagaaatattatttcctacctcattgattacaatgtagctgccatttaccctcaattgcttcttgttgttgtttttctttcttaatcattccatttgtttacatctcaaatgatatcaggggatatcccttcctggttgctttatttgaatgcctacacaaagcattaggagaagggaataaggaacataagtttggctgaatccttattcccttctcctaatgctttgtgtaggcattcaaataaagctgggtttacttcattcttccttatttggcttggcatttggtgactgcaagtgcacaagctaaggctacattcagtttaaatttacctttttctttgaagtcaggttttggtagctgatctagtttcttttgtacttttgtcctatggtgattgaacatcaggtgagtgagcctctagccctgaaggagtcttgctgtcttctatggccttgactatgtcagtgacctgtttttaaaactcctctagtacagatttcttttctttccagaacaggctgtgcatttttccctgcagattttaccctcttttatctagcttgtgaagcttgtcagtactgtcatactgtactgttttttcttccttgtactgtgtcatgtccttacttaagatagtgttctctcgctcttgagatctcatgttatggagagcctcccagcatttgctttcattttgtctccttttatgtgcacaactcctttttctctttttcttttcttcttcttctttttttttttaattcctttctggattcttaccttttttatgcctttgttattttaggagcattacaaagacttttcttaaaggtatgctttgatgtaacaggaaattgtatactcctctctccttcaactttgctctcctagaaaagtttattatctctgttgaccaacgtgatggcatcttcactttaggctcatgatccacgtggatgatctataattaaaacaacttgatttcttggtctgcgtttattttaacccatctggcatcctgtaaagtgtggtagaccagatagactcagattgcatcttcttaaggctttcctggctatcattttcagcactccttagttttctcaggttatttttcttgttaacacttaatgctgtattgagtatagttgattctctgtttctacaaggttgaaaatattcatggaagaatctgttatgagtatgttgtattagttataataactaatctttctgtgttatgaagtatgcaagatcatatatatcaattatatgcacatcttgttccattttatataagaggctgtagcatctgttgattttggcatccttaaggcagtcttggaacaaacttagacactgagttttatgtctctaccatcagctcagtgaggacaatgttttttgtttgctttgtttagtacccaattcttaagggttggttggtgctaaataaataactaaatggaaagttaatgaatattctgcccatttctagtgtctgtagtgatttttagtctctcttttctgacatggaggcatttagaaagcttaactccctgactctgtttctttctggctaagtaaccttttgttccctctggttggttgagaaaggaacattttatgttgaaattgaggataagaatttaatttcatttaatgttttttaacattcaaattaattgtgtgcactatgagtacaactccatttaggtctgaccaaatgcttcagctttacagcatcctggtttctacgacatctttggctaggtttcttcatgttcatttccactattgtctcttaatgtgtaatctagggaggtaatacttcatataaaactatcttagctctgatgttcattagccgttgtgagaaactgattcctagtttggaaggtttgcaggctgggtacagttatattcagatgcactgatctggagaaatcctcacttacaccctttaagattctggcagatgaaagtctatgtaactgtttagcctgtgttgtgtattagtatgcaagtaagtacagaagcagagttgctaggattatgtggtgatggttgctagctaaagtgtgacagtaaatgggaataacttactaagtagggatgaaaaatgattactagactactaagaaataggtcctttcaagggaattttaaatcaaggtggcagatataatgtatattttaaacatcaaagaaaaatagaggtgggctcgttttttctgaactaaactattaacgtatacccgtctgtcctaaaaaaacaaaaaacaaaaaaacattttcaataccttaaatatgtacaataaaatatgattgcaatagtttcatctaagttagtattcaacaacatttcttctttcatttttctttctgttttgttttatctttgagacagggtcttgcacatcattcaatcttgcctgaaacgttgattctcttgcctcaaattcttgattttttttgcagtctttttaattgttgtagttcatacatattttactttactaatctctcatttgatacttagttggcaaagccctcccacccccctcccccaccccgttccctgttctgtagactgtcttttcactctggtgatcatttaatttgctgtgcagaatcttctaaatttcatgtaattttgtctgtcaattctaggaatcatttcctgttccattggagtcctttacagaaagtccttgtttatgcctaaatcatgaggtattttcctgtagcatttcaagtttcaggccttatgttaaagttattgatccattggaattatttttgtggaggagagagatgtgggtctacattcttttccacattgatatatactgtttcccaggcactatttgttggaaaggctatctctttttcaatatatgtttctggctaccttgtcaaaaattacatagctgtttttttatttctggatcatctagtttatttgtttgtatacagtatttgtcaatgtggttctatggtgtaatttgagatcaggtactatgttgtcaccagcattagtttttatgctaaggattggtttgtacttgagaccttttgtgcttttataatgaagttttaatttttgttgtgagacagagtcttcctatgtcttcctgctgcttattacttgctctgtagatcaggccagcctcagtctcaaagagattggcttgcctctgcctcctgtgtgctgggattaatggtgtgtatcactatgcctggtcatgtgtggtcttactctaatgtgttcttgaatttggtttgtatatgtgtcttgttggacagattttccacctatgtttttcagggaaattgatctgttcctttcatttgttgttgggatctgacctggcatttctattaggttagtgttgattttgtaggatgacttggctatcttttcttccctttaggttttgtggaacagtttcaggagtatcagtattagtgtttctttaaataattggtaatgtctgggagttatttttttcagttgtggcttttcttttctgggaggtgctcttttgtttcttgctcattgctgttacggatctatttaaattgtttttagcttcttgatttaattttgatggatcttatgtgtttaggaatttttcttttagaatttcaagtgttaaatataagttttgagagtattctataatgctcatctgaattttactggaatttgctgtaaaattctccttttcctttctattttactgatctgggccttttctttcttcggcttgttttattagggtgttaatcatactcatttcaaaacactattttcttgttttgttgattctgtatttatctccatttgattaatttctgcccccatctttagtttttttttttttccacctactgtgtttgggggttgtcttgttcttgttttttttttttttctccctacagcattgggagtatatcataagggtatttatttgaaagctcactgatttaaaaaatgtaaatatctagttacaatcttttctcttaaaactgcttgaggtatagctcatagcttctgataaagttgtgcttctacttttcactttgaaatttttattgaactttttatttttttcttatttcttcagcggctcattttagttatacaagagtatattgttcattttccaatccaagtatttgtgatttgtgtaatttcttttgctatcaggtgcttgttttgttccactatgatctgaataaagaacttacttcagttcttttgtgtgtgtgaagacttgttttatgttgtatttctagcaggcttcattgattgcttataagaatgtgtattctgtttgatagaatattttgcagatacctgctaactccacttgatctatggtgtagtttaactgacatatttctattagagaaaacagaacaaaaagaagcaaccaaacaatggcacctgccttggttgtttattgctctagttctgtggcacctagcatttgcattcccattcttgtggtcccctattttcaggcacccagtatagcccagttttaagcaaaaggtaaattctgaagatgatgctgggtcactgcactcttgagtcacttctgcctattgctgtggaggaatctgctattttgtggaggaatcactttcttcaaaaatctgcatccggatttgaggcttttgaggtctgtaggcttgtctcaaagtatgcctgccagtctcttttgagcagggtagcctatctcacctttttaatggggcttctgctttccttaacttcaccagggaaccatgtggctgtatctgtgtgtgtttgacttggcttcttttcaatgtgttacctgttttttccttgatagtttgtagctgtttagtgagagctgttgaatttccaaagctttctactttgttgttttggagcagtgtattctttttacacttctcatctctttacctgggtcatcagatgctgctttcagtctggtgtcttaccacagttttgtttgttgttatctaagcttgaagatttggtgtggaaagtaggatgagagtcttttccaatctcatgggttcttttagtcacattacagtgtgaccagagaaatactaaaaagaaaattaagtgtcaagccgaacaattctttgaaagatttgaggacattcaactccttagattacattattttgagagtgcttagtataacctgaatataaaatttattcattccagattcatattgtcactatatcagctttttagaaaaatctctttaaaagggaagtcagttggcttttttctgtcccctaaaccttttcttattatagtcacagtactacaaaccaccaccaccactaattaataacaacaacaacaacaacaacaacaatgaatgttttctctgtgtatccctgactgtcctggaactagctctgtagactaggctggccttgaacttagagatccacctgcctctgcctcccaagtgatgggattaaaggtgtgtgcaacattatcctacacacaggttttaattcattggttcattcattcattcatttttttcacacaaagcatcccatatctatccatttattcaaccattatttcagaaaatatatacccactggagccacccctccctccactcctcccagtccccatactacccccgctctctcccagatacactgctcatttgtttcccttcggaaaagggcaggcttcccaatggcatcaactaaacatggcataataagttgcaagaagactagttaaagtccacatatcaaggctggactactcagagacatatgcagttgactataatttgaagtttccaccccctactatgcaaaagaagatagttattagtgttctcaagcataccttttaaatttttttcagaataatgatacttttaagtatatcttctgaatcttgatccagtgattcttgcttcaagatgtgctttatcatgtttttttctttttatataagtgatatttctgagacattgtctactgtagattatttagcttgtttctttctttgtcagtattttggagaggtgtgttgatgtgtgtgtaccttcatgtgttttcatttctagaggttgaactcaggaccttatgcatcctaattagacactattaaactgtgtcttcagccttattaacctttttaaaaagtaattcttcctggtttttatttttacattaaaaccacaatttcctctgtgttctaaggtctatcctgccagcaacatgattattgaatctgtaatcttgtttacacatggacacctctcctagtattcattacagtattaccttggtttgttatttccatggtaagaatttcagtttgggctctagagagatggctcagcggttaagactgactgatcttctagaggtcctgagtttaattctcagctcattactatctgtaatgggatttgatgccctcttatggtgtacctgaagacagcgacagtgcactcagatataaatgaataaataaatcttaaaaaaatgtttggcttcatttttacaacaatcattgtaaacttaatcatatttttgcttgtaactggttgcatttgctgtactatactatctgtccatcttttgataaactccagttactttcagtacaatttcttcaatgaaaggcatggactctctttaaggatagaagaggtagtgtattaattgtgcatcacaaggtcatggcatttagtgcattggatagctatgtacacattagatggaggaataagttcatggctatttcatgtctgtcacttgcttttccacatgttctattccagaatgattttctctttctccaaaggcataaagagctctctctctctctctctctctctctctctctctctctctctctctctctctcccctccctttctttctccttctccctctccttcctcgctccatctctatttcttgcttgcttaattttactggtagttgagagctaggataaacaaaagcatttcaggatacttaaacacaagagtgcctaagttccacacagcaatcatttggaaaagaataactttgaatattgaagcttgctgattgtttagagttttactattatatagaaatctaaagttaaaatgtttcaacccttcagtgtgacgtctttaaactattacaaatgctaaaggtactttctttctctggttatttctattttcatgtataaagtatgtagctttaaaaaagcttcttgagaagattgtcctctgaaggaggggatataaactttgaaaataagttattaaaatatttttatcttgccatatattatcattgttgatgactttatcagagatgatgtgatttcttttgaacttatatgtacctcttctgttccaggatgctttaatctggatcctaatagagttttggatgtcattttagaagtgtttgaatgcaggccagaacatgatgacttctttatatctttattagaatcttacatgagtatgtgtgagccacaaacactgtgtcatattcttggattcaaattcaagttttaccaggtaaaaatgtgtgtgtgtgtgtatatatattatatatatataatatatatatatattatatatgtgtgtgtgtgtgtgtgtttggatcagtgtcataattttgtatgtatagtttgttttaatttgtgttgtattatttactaggttcatcagatgagatagagaaatgaaaagttaatgatatgttgtgatgagcgctatgttaaaagtataaatgatttgatgagacagtagaggaaagcagaattaaattttgcctcaggagacagggtctagtaatacttggaggagtagggatgtgttgaaaattttctatgcagaaataaactgcaagactaaatattggtggtgtgggaatatataactgattgaagaaatagctggttgtcacttgcctgttttgtaacgtgaggaaggagtggtagaaaattgtctctagatggagagctgtgtattagattgccatagacctttgactgcatgttattttaggatttgattgtacatatgaagggcattagaatgttttggggatgttaagtacttcaagaatatttcactattaaatcagtatagtagctgaagacaccctatttctgtgtttctcttttagtctgccatattgctactgttgttttctaaaagatttggtggggatgcctgactactgaaaagtcatttctggtggtgttaagcttttattaaaacattagccacagctgcttctcattttcctaccaggaacctgagaccccattcttattatagggaagtaagtcaaagtgtcttatcaagaaaccaatggctgaaatggaaaggtagagaaaatttaacttggtccaagattaatactttcagatcggataacattgaagattgatgacattctgagtaacattaagttaattgttagttttagaattaaaagtagttttacatgaacatacagttagtgatataaccagtgtaaatttgggactatcttataatatttgaataatactttttggatattttaaaatatatatttaatatatatttttggattttttttaagtataagaaatacttaagtgttagaaacaacttgttcttgtaagaaatacctctatactgctctgtgtgacaatctttcttttttactcttgccaaatctatctagttattgtgagagtgtagtcttatgactgctgaaagaaagaggaaattgtcagagattttaaataatttgtggtcatgtgagggaaagtaaggaaagctgtgtaaaccaagtcttatttaggagatgtaaccacgggtgtaggctcttaggaatgtgtaggcagcatgtatattggtctcttccctaatgcttttgttctctccaaccaccacctgaaaatgctaactccctctttttataactcacatatgacaaaaccacttaaagtggaaggacacaaatgtgtaggtacaagacagttttattctattgtagctaagctgttaattaaatcaaagtaactttttcctaagtctaaaattttaattgtaatgctgaaagtactcactaagaaacagaaaaggacaagaaagaaatccaaatggcacacagaccaaagaagctattgggaatgaggagcaaaaatcacagcaaaaggcccagaaagtctatccttcatattaattcttctaactgtaaaattgatctctctaattaaaagtcaggttttggcagagtacacttaacacaaaacacaaacaaaaaccaaataaaaacatgatccagtattatgctaggtaaaagaaaacaatattcaaaggtacaaataattagaaaataacaatctagaagccggtattatatttgcatgtgggagaaagctctggtgcccatatcaacagcagatagggtagaattcaggtcagaaattgttatgaaatgatgataaatggcctgtaaagactgacagtccatgtaatgatttttaaatagtttatactagttataaacacaaatcagctaagcagcataacctctaaatttatgaagtagaggaacagtttatatttgacccgagagtataaaagttgttgagatgaactgtttagaataggattaagggaacagtgcaagtggtcataatatattctattcaggaatctcagaagagattagaagttaaagaagcttttgtatatttgctctttaaccagctattgccaatagactagactgatatgaaatttatcctgtgataattattcaccttttgtgtaccctgatcttaatcaatgatcaaattaactagacatgttaaaaatgatgagtttcacctgtaatccaggtacttgggaggttgatgcaaaaacatgatgagtcttacttgggctacatattgaaacctctcaaaatacaacaaaacattaaagtgaactgggtctaatacacacatgtggaaaactccacccaacaataccaatatatttttctttatacacctggaacattctccagcgtaggccatatatttagaatttagaccacagaacatcttgaattacaaaatactttgtgatcatatgctatggtatttgattatagctatagtgatggacaatgatgtgaaattttttgacatcagttatctaaattgaggttatgagactagtgaatgtggttttagtatattcaagtcatgtatctcaggacagattatcaataagttcagtaagctttgttttggtatcaaacttggaccaatatttgtttttactgaaaatactttaattcaaaatatccatttatgtgcaaatgtttagaatcaagaacctattgctaagttgaagacttatctattgttaaaaaatacaacaaaacagtatcttctttaaacaacacaacgtagtttggttatggttatattacacataccaagtgtggctacctgtacttacagacgttttatttcagtgttgtaggaaatctgtacctttttttttctctgatatccacttattttttttccattttttattaggtatttagctcatttacatttccaatgctataccaaaagtcccccatacccacccacccccatgatatccacttactagtgagtatataccatgcatatccttttgggtcagagttacctcagtcaggatggtattttctagttccatccatttgcctgcaaaactcaggatgtcatcccagggatgcaaggttggtttaatatatgaaaatccattaacattttcatagtttatatagtggatataatccactatataaacaaactaaaaaaaaaaatcacatgatcatctccttagatgcggaaaaagcatttgacaaaatacaacaccccttgaaattaaaagtgttggagagatcaggaattcaaggcccatacctaaacataataaaagcaatttactgcaaaccaatagccaatatcaaattaaatggagacatacttgaagcaatcccactgagatcagggacaagacaagaatgtccactctcctatatctattcaatacagtactcgaagtgctagctagtacaatatcacaacaaaaagatgaaggggatgcaaatggaatattcttatgcattgtaaaagatgcttagtctcaaaactgttttcttgtacttatctgaagatgttttgggatgctggcaaaagtctttgtcccactgttcagatctttgattttataatgaagaatattgaagtgtattacttaattttattgatgaatggtagagaaaaggtaagattttaattttactctataccttaaggaattcttcctcttttaggaaccaagtggtgagacgccatcgtctttatacagagttgcagcagtcctcctgcaatttaatctcattgatctagatgatctttatgtgcatgtaagtcaagtgctttgttaagagtttttcttatgcatcccaggggtaaggaagagggtaagcacctcactgctggctctagacttccaggtattatttttgaaggcattatatattattgccttgtctaaatcaaaaatagagtagattttcttctttgataaacaatggaaggtaacttcctcttagtcacccttacaggtttcaagattggatatatagctcttttttaaatcattgccagtgcttagctcatggggagaaaggtcaagcactaaacaatgtcgttttaggcttttttatttttatatgaaacttgtaggaaataggggactgtctagaaacttctaggtaggtaatcattgctgtacagcttttacctctaatgtttactggttgtttatattagccttagctatttgaatagattgtgcattttacaggggttaaaacattcctattatagctcactgtggtgcctaagtcacttaaaaatctttttggctgtgtttttgtttgtgtcaggtttattattttgaaatgcttatagtaacaatcctccacttggacaaggtagctagatctgagataatcaaccctcaacgatggaattgatactgattagaaattagtttgtgatttatgagataccaacttattaatagtttttataattgaaaattagaacatttaaatctattcttttgacatatatgcagtactttgtttcgtttgaagtttggcttttaaaggtaaaatatgtactttttattttggtggtattagaggtcaaatatggggtgtagtttgctggacaaactttgctttactgcagagcacccctcctcctggtgttttcaatggagtaggtatatattttaggtatatttataaattcaatggtaaacaactctgtagtatgaatttagagcttttaaaatactaaagataaaaaaatatttgttgctatgtgactttaaaatgtatgtaaaactcaggtattcaccttttaaaattattgggcaataaggcaaacttatttagaaagaattcatatatatgaataaactagccttcttatttatagatgtactaattgagcaatattctgcattttatatatgcaagcttcttgtattaacttatgaaattttaatgatctatttttagctccttcctgctgataattgtattatggatgaatacaaacgagaaattgtggaagctaagcaaattgtaagaaaactcacaatggttgtgctgtcttctgaaaaacttgatgaacgagacaaagaaaaggacaaagatgatgagaaagttgagaaggtacatccctcaggccagcaagacttaccttgtttagaattatgacctttcatttctcatggttaatcaccttatggagtatgttctcttaattttgattatgtgcaatttgatttaggtattattcatttgaactttaatatgaatgataccttcataaagaaaactctttttcttatgaatttcaaaataaaagaaaaaaaaaatcacaaaatattgattttatttttctgtttatatactttctttttaatcctaaagggattctcaaagatgaatgaattctagtgtctcttgtatggtatagcattaagtccaacttaatttcatatttataaattataatgcatatgtatgttctaaatgggaaaatgcaacaacaacaagacaataaaacaaatgcccaaaagatcatattttgtttttcaagtcactgaaatttcaggcaattactgttaagtttcctaactttttttgatgtacagtattatgatacttaggtcaagttttaaagagaaatatctgtattccaaacatcattgtcatgtttgttcatttttagccaccggacaaccaaaagctgggtttgttggaagctttgttaaaagttggtgattggcagcatgcacagaacatcatggatcagatgcctccatactatgcagcttcacataaactaatagctcttgctatttgcaagctcattcacataaccgttgagcctctctaccgaaggtttgttattctacactaagcattaagatacaaatagtttcaggttactaaaaagagttgtgtattactatctttgatctttaaatctagtatctgttactatattttttcaaaacataagaactattcacagggtatgtcagtcatgtgtgcatgacttctgtcctaatttcccagtcttctagaatgtgtgctgcaaaatatgaaaactccaagttaagtttctggagcctgtttgcattattgagagtgaaaatacctttcttctgattttgcctttcttcttgggaagcagaaagtttcccctttaaaaattagccttagttccctattcccatttttctattctggtgttaatggttctgactgaagacattaccattctgacaggctgccttttgggggaaattactagtttaattccttttatcctgaatgtgtcaactagtcctgttgacatcagcctatttgtagagtgcttaggagcagcattagcagcagctgtggcttgaacttcatagattagagcctgcttcaaaagccacaaccttcttgacttgtgtgtagctgctgctttcattgtaacctagggtgtagacagtgcaggcctcttctcaaagatagagccctgagacttaaagtaagacctctacttactctacatgagaaacctctgggcatgctgtcctttctactaggacaacttggattggatggttagcttgcctgctactgcttcctcatactcagtataggaaaacagtagatcctagattgagacatgtttgatttcatcttgtcatacatctgatgtccatgccgtattctccattcctataaccgcaggctctgtgttggtcaagcttaacttaaactcatattcaatgttacttgagatctacaccaagagttcctttatgttgctagtttgaaccattgtctttttgagttttgctttcatgcttactgaatttatttttgtgttttgccagctgagaattatttactgtaataaagtgagtgatgattagaatagttaaagcaaatatgaacaagaaaatgattgtgtcttatattggagacttatatatatatagtgcatagatttctaaatcttgctttttttttaaatagagttggtgttcctaaaggtgctaagggctcaccggttagcgctttgcaaaacaagagagcaccgaagcaagtagagagctttgaagatttgaggagggatgtattcaatatgttctgttaccttggtcctcacctctcacatgatcccattttatttgcaaaagtcgtgcgcataggcaagtcatttatgaaggaggtcagtaaggtttttcttcctagtagaaaattaaaaattgaaatgaaatgttgtgaatatgttttcctgagtatttctagaaacaaacaagcaaaaagtaaacatgagttaaggaaagttgtgttgagtaaactcatttatggaaagccctttgtgtctcaatggtgattatgtctatgtatcaaaaccccagatctaggtatacgattcaagtacctcccttgagaaactctttgcttgatttccattgtaacttgcacttgtgcttactcttcttttcccttacctgtcttctatggattttctttcatgcagttttgagtcattattaaatgtttggatgctttccaacttcaaacagtgcaggattattattgtattctttacgtattttgggaataaggattgagcttggggcattgtgtgtttgtatgtgctctactttggagctatgattccagctcatttttctttataagtaaagtttttattggaattaattatgtgacagaaaaatatataaatgctgaatatacagttcagtgacctttttaaaactaaacactcatgtgtctaccacctaaattaaaccaagaaattgaatagtaccagtagtggtgctacctcatttgtaaccacttagactatttcaaaagtctgtggtgtagaatgttcatttgctagaacatctccagccttagatgcttaattttcaacttctgataaattgtctgtctgtctgtctatctgtctgtctgtctgtctgtctgtctctctctctctagtttatacccattgccataatcaccataaataattactagactattttcatcatacttgctgttaacttctgccacttctgtcactttcccctgtgttgctgctttctgtcactataattttgctttttctatgatctcatataaatagaattatatgttcactcttctgatttctttcacttcatggttttagactcattcaagttattgcatgtgttagtagtcctttgctgagtaataatatcgcactatatggaaacatagagtccttgatacatttgtcaggtgatgaatatttaggttatttctgtgagtagctagctatacttttgggaggcatgtttttgtgttgtcagaagtgggattgattagtgaaatacataagtataactgcaaaattgttggatgttgtgatacatacttttaagctcaggactcaggaggcagatgcagtcaggtctctaatgcgagttatgagtttgtggtcaggccagccaagcctacatagttaaacactctcttaaaacagaaaaaaagattgtaaaaactgtttgacagtgttggcaatgtttatagtattttatatttttgagaacaattatttgagacttctagatgctctacaccctcactgacacatggtattgtaatacttaaatttttgttatcttaatgagttgtggtatcttattgtgggtctatttcttgtcatgctaatgactaatgatgttgagtatcttttcatatgtttatttgctacttataattatttttagtgacgtttgttcatatcttgtccatttttgatatgactatcttttttatatgtctttgtatattgttatttctaaggccttgaccatatagttagtttttgaaaaagtctttcagtctggtttgatgtttcagttttaaactgtcttttataaaattacgtgtatgtgtgtgtgtgggggggtggggggtggggtagtaggaggtttgtgcaagtgggcacaggtgccaggagagatcccttggagctgtagttacaggtggttgtgaaccaaactcctctcctctggaagagtagagactattgaactatctctgtgacatcttaaacatcccttatatgcacatacccccacacagactcatacaactaaagataataaacaaacacctttttaaaaggaaaaattacatcttaataatttcagtttattaatatttactttgaaatttttcgttttgtactcccatgaaaattttcctcaacccaatgctttcaagctgcaaagaattcataatttctttttagttataaaacagaactacaaaacaatatttagaaacatgtatgagcacctatatacatatattgtttggtgattacatttttaatcttagacaatactagctgtatggaaaaactaaaaacagctcttgttatgaatcttatatgatacctgaaatatttgacttggctttcaatacttattagctggtagattattttctctttttttcaatttttattagatattttcttcatttacatttcaaatactatcctgaaagtcccctataccctcccctcaccctgctcccttacccagccactcccacttcttggccctggcgttcccttgtactggggcatataaagtttgcaagacctaggggcctctcttcccaccatcttctgctacatatgcagctagagacacgagctctggggccactggttagttcatattgttgttccacctatagggttgcaggccccttcagctccttgggtactttctctagctcctccattgggggccctgagatccatccaatagctgacaatgagcatccacttctgtatttgccagtcagggtcctttcatcaaaatctttctggcatatgcaatagtgtctgcgtttggtggctgattatgggatagatccccgagtggggcagtctctggatggtccatcctttcgtctccgctccaaactttgtctctgtaactccttccatgggtattttgttcgctgttctaaggaggaatgaagtatccacatgttggtcttccttcttgaatttcttgtgttttgcaaattgtatcttgggtattctaagtttctgggctaatatccacttatcagtgagtgcatatcatgtgtgttcttttgtgattgggttacatactcaggatgatatcctccagatccatccatttgcctaagaatttcataaatccattgtttttaatagctgagtagtactccattgtgtacatgtaccacattttctgtatccattcttctgttgagggacatctgtttttttcccagcttctggctattataaataaggctgctatgaacatagtggagcatgtgtccttattatcagttgggggcttactaaaatgcagattgtgacccctaacttcagtttctgatcaattggcctgggctagaaggtgaaaatttgcatttctaacatgttccctggtaatattgatgctgctggtccaaagaccagattgttcttctaatatagtaagtatatttgatcctcctttttgtgattagagggggtggcagtgactattaatctaaaatatgtaccaagagccactactatactttctgctccagcatcctgggcatttctgtccttaacatactgtgtgaagacaaaacctctatgaacagagaaacccccgagtgtaccgtacttcatgaaaggttcctcggtatcaggcttcttgagtgagaatgctgagattcccaaagaatgcacggcagttcatggagtgctgatggctcttttcctgttagcagcatatgtttctattgcctttcatgataagcttccttaggaagccaaaaaaaaaaaaaaaaaagctgaaaaacacctgtagcacatatatccactcagtcttgtttatttccaaaattcaagggcagaaaatagttctaattggacattgcgtgtgaaccggtcagaggagttattcatatagaagcaaatatttatgtattcatttttattagcatacaaagaaggaggtttattatagtattttaaaaacaatttgtttctgttttttttcctgttcattgaaattatagattttttccctcacacaatatatcgtgattggggtttccctgattctcctcctaatcccccctcagccccctcccattcacatctgcctctttctctcattagaaaacaaaaggcttctacgggacactagtaatacagaataaaatgtgataaaacaaaaactacacataagtattagaccaaacaaacagaaggaaagagcccaagagaaggcacatgaaagagacacactcacttgtactctcaggaatctcataaaacactaaagtagaagtgataatatatctgcaaaggacttggagcagacccatacatgctgtttcagtctctctgagttcatatgagcattgatatgttgatttagagggccttgttttcatggtgtcttgcatcccctctgtgtcttacactccttttgcctcttcttctgcagggtttcctgagccttgaggggagggatttgttataggcattgcttttagcactgagtattctaagctctcccactctgtgtataatgtgtgactgtgggactctgtctctgttcccatccattgcaggaagaagcatctctgatgatggccgaaaaggccgttgaggatagcagagtatagctattaggagtcatttttattgctttttttttttttttaataaaagcccagtagtatttggttttcccccaagtctctgaactatctatctagtctctggttcttcatcacccaagcagtgttgggtatgggttccattgtactagcgtatcttacatgcaggacactgttgtatacccaaagttttgtgactgggatggtggttgtttttcttttggtagtgtacagattatattcttgtactaaagacactaaaatgtagaggtgaaggctctatttaggtactagtttgacttctccatgttgagtgagttgtgtagatatttcttttagcagtgagggcttactgtcgatttgtggagaacaacctatattctttgacaacagcctgggtcatttggggatttttatgggaccctaaaggacaattggatgtaacccagtcccagcactggaagttcatttggcaagaaatggccgtttgtgactctgtctacttcattatttggctatttcatttagattacccccaaatatgtacatattttacaaagcttctactgtattagggttctatactgcctctcaaatgacccttaattttagctgtttctccccatattccttccctcattccccctcccatcctgagttgatcctttttttttttagctccccccattcatccataattatctgttctatttctatttcctagtgagagctgtctgtcccaaatccgttcctctatacccaacctctgtggttctatagattgcagcttggttaccattgacttaacagctaatagccacatataagtggatacataccatatttgtctttctgggtgtgggatacctccctcaggatgactcttttctacccatttacctctagaatttattattttatttttaatggctgattaatactccattgtgtaagtgtaccatatattctttgtctactaatttgttgaaggaaatggaagttgtttctgtttttttttttgctattatgaatagagcaacagtgaacatggttgagcaaatgtctctgcagtaggatgaagagtcctttgagtatgtgcctaaaggtggtatagctggatcttgaggtagatacccttcttcctgtttgccccctgccccatgttctttacttcctttctgaagaaacagactttttatgacatttattttgtgtttgtgtgtgcataagcgtgtatgccacaggactgtatggaggtcagaggaaaactcgtgggagttagttctctccttccactatgtaggttaaaccatggattaaaccaagattatcagctttgatgacaaacacctctacctaataagccacttcaccagcccaagaatattttaaaaacaactaaacctttcattatagttatttccaagttgatacttatcttcaaatagatgcttgttgttgataccatttgttgtacctcctactgtatttttgctgttgtaataattttatacaaactcagagttagagaccaagttctgtttgttttttttttgtcattttgagattttatttttgtatacttttgggtgttttgcctgcatgcatctctatgcatcatgtttatgcagtgctcacagaggccagaagaagagattggatctcttgctaccagtattaaagatgtttgtgaggtaccatatgtcctgggatttgaacccaggtcctttgttagagcagctaatactcttaactactgagtcatctctccccaagttttttgtttgtttgttctcttttttccttttttgtttatgttttatttattttggtgaggcagcatttcactgtatatccctggctgtcctggagcttagagaccaggttggtcttgaactcatggagatgtgaatcctttgcctcaaaagtgctgaaatgtacacaactacacatgaagagagcaaatttaatgtaaaacagttccgcttttcaatgatcctgatcagggagaactactgaaatatttatatttacattgtcatttataatagttggtttgaagctcacctcatttccttcatgtgacagtgttcagatatatttagagactggattacaaaccaaactttatgtaccatttttgttcagcattaaggttattgaggaggggagcagggtgggggcatcagtccttcttggctacaaccaagtatgtcttcatggctgccagcaagtagttcagctcttcttcctttcccttggtgcagatgtgctagcccacccttttcttgatgaacttgaggtagtgcttgttcttgaacaccttgaacatctccttgagccacttgtcagttgtgaagccgtacacttcctggatcatgtcccacatgaacttggtgtgctgtacctcgatttgctgatgttcttcagtatgttgtggccgttgttgaagcaatgggcttgctagagggatgggatagggaatgggttcgggggagggctttggctgctgctctctgatggcaaccaggataggaagcttatgtagcaggtttttttttaaatctattaattttttattaggtattttcttcatttacatttcaaatgctatcccaaaagtcccccatactttcgacccacccactcccacttcttggccctggtattcccctgtactgaggcatataaagtttgcaagaccaaggggcctctcttcccagtaatggccgagtaggctatcttctgctattatgtagcagttttaaccttagctatacttcctaggttcagatactaagtaccaataggcaaatggcaattctatatgaatggtgtgtaacttagtttttaggagacttgttttactaagagtgggacttcaggtacaaagtcaattatatccttcctaaacgtacatttccatataagaaaaaggtagataatatttttaacccttgctacatcttccaataaataagtttgtagatttgagtatgggtgcttgcatgtgtgtgcatgtgtgcctgtgtatgtgcgtacgtgctggcactgcgtgtgctcaggtgcccgaaaagccagagatgatatcagatcccctggaactggagttctaatgaattgtgagccactgtgtagatgctagaaattgaacctagaccctctgcaagagcagcaagtgctcttaactgctgagccattgctccagccttcaagtacttgttttgggacaacaatctttgaagttaatttcaagaaagaacaattccaaatgtaaagaactgaagtaacatttgaaaatatttgtgatactgctgacctgtgagaagctgtgttttgtttgtttgtttgtttgtttttgttgttttttaaagctcaggacatagcaaatgctgtcatatactattttgttccatcaagtagttatagttagcatgagatctgatttcctcactgattattcctgggatccagtgctatacacataaggtaggaattgccagggaactattatcatagtccatttcctcagctttttaaaaaatatacttatgctgtgtgtatgcctgtgcatgtatgtatacatttacataccacagagcacatgtgtagatcagagaatacctgatctcggggtctgttctttccttccactctgcgggttctggggaatcaatgtcaagtcattagctctgtttgcaggcgttttcacaatacgccatctcataggacctctgctcagatttcagccaatgaaagacaagaatcgattgtcttaaacacatttctagagactcggaacctgttgtggtattgaacctttttaatccacatggccagttttctattgctgcttcttaggattacatgcctaggaaatccaaacgaaaatgtaagagtgcgtttctttaaatagatttaatggttaagccataatttgttcaaaagttatatgcacatgttattttttgtttatgatggaaactatttaaatgtagccatatctagtgctggaaaaatgtgaaagaatttcccggtgtcatcaccattcctgtaactctctttctatatgagttagtttttttttttttttttttgtctccacccccatcgagttaggtatatcttttagtatagaataaaatttatttaggagcatgggaaggggcgttgagaagggagtagaggcaagaaagagaagggacagtgaaggatgggggaggggggcctgccaggaacatatggagtgggggagaggaagtggaggagggagaaagggctcggagagaagagagtcagagagatggggaagggacagagcaagttagatttttaaactccaaattattcttattttatcttgataattagcctgggcttgttttgaactcaaaattctcgttcctctagatcactggattccagacatatgccacttccctcagaatttctaaattattttattttacttttacttgattattttaaaaagtctggatttatgtgtgtgggtgttttggctccacttatgtctatgtagcatatgtgtgcaatgtctgcagaggccagaagtaggcgttggattccctggaattgaagttatagatagtaactgtaacaggagttatagctagctgcctcatggatgctgggaatcagacctggggtcctctagaagaacagtcagtacttttttaactgttataccatctctctaggtcagtgcagaaggattttaatgggacctgctttggatcctctctagcaaaaatgtttttcatagaatagttttgaggcatatttgaggtagttttaaatctaatataccatacctacgaaatacttaataatttggtacttagtataaagaatatgcaagtaaaaatagtaccataattttttacagacattttagtcaaaaatcttaagtgtttttttcctcagaggtactgtatagtcttaagcagcatttgaaatattcgtgggttaaaggcactgaattagttcattagtcataagaagctgtttgtttagtattgtctataattccttctttatttcccaactctctcaagactgtcttgatgaaatacctatcactattaatttttggtgctgaatattgttgtatagtgccatcatccgcactgcctttctagagtgatattggaacctcttagttcattttgatgatggcctttgtaaacatagctaagtgctgttttacttaaatttaaaattcaaatgctgaaagtacttcagagttgtcacctcaaagatgggagggaactgtgtcttctttctgttcaaaaggtcagtgcatggcacttggtaaacaacgaccccttggacctacttccatgtgtctctctcctttttgagtgtggtgttcatggtggcattgagcagtctatgttacccctgacctaaaaatgaagtaaactaaaagaaaaagaagctataaatgctgcagaatatgtttatctttaaaaatttgctttttgattggcatgcccccctgattatttctgtttaatccttgttgtcgtcagtgtttgatagtaaggtttactgttcttctagggagctttgttttcttttccatattaaaacaaatctcttttgcttatgaaatattatggacatttgcaactcacttgagttactcaggaaagcaaaacagctaagtaagttactgtgaaaatttggctcgtttaaatcctggtatagtaggaaaaggggtagcctaactgccttaaatggtaatacacaacaaagcctagtttgtcccatttctgccccctgttatacattatatgttacctgaattaccagttctttatcacaaagaaaacagcaacaaacaatagctgttacatttttttttcttccaggccactcttctataattgaattccttatttgctgtcagaatacatgttgactcagctgtagctgtaaaagaaccatattttcttgaacctgccaattagaaaaagaaaatatgttgttatgcatctcgaattaattgttaggtaaaatgaagcacttagatgccttaataacctactcagaagcatacagaatgtgtgtggttgcgtcctagctgtctccttcccatgcatgagtattgaactaggcctttccttcatgtctagattgtccttagatatcagttctttgtacttttggttttctacctttatacacatatacacgtataggcaccactaactttgtttgtttgtttgagacaaagatcctctgtgtagctctagctgccttggaactcactatgtacagacaaggctgatgtcagtctatcagaggtctgccttccaagtgctgagattaaaggagtgagccactttgcttacctttcagagtattgttgttaagtgactacacagtgttgtcaaacaagtcacttcaaggttcagcctgcattgggatagtacagacccaggatgtgatttttctttgtcagcagtgtcctgaatattttggacttactttttgttgagtgctttggtaaggttgaattataatgcaactaaagttcatttccatagttttgacttttggttacattagtattttattttattttattgattttttgcaaaacatcagttatctgggccatggccattggaaaatacatatttccaatggtcttaggaactttgataccacttagtagcaaaattacagttatggagtagcaacaaaaatcattttatggttgggggtcactacaatccaaggaagagttgcagcattaaggaggttgagaaggacttggattgaaaatacattagaactaaatgaccaggatggttacagtttcattaagtttatttattaataggagttttaggaagctttggtttataaggagaaaaaaattggcacttaaaattgataacttagggttagagatgtagatcagctgacagaatgcttgcctagtgaatcaagcccccggcttgactttcagtggtggcacacatttgtaatccaagactaagttcaaggtcaacctggactagatttggaaaccagccaggactacatgagatacccttcccgcccccctgtgtttgtgtgtgtgtctctgtctctctctcctcccttcccttctccctcccccctctctttctcaaacaaatacacacacgcgcacacacacatgcaggaataacacccttccctggatttatacttgaaatttatggaattttaaatttagaggttaaaaatatacatggaaatttgaaatacttatatttagtgataagttatttgaaatatacatgtctgtaaaaggcaaacaactaagtaatatataacttttttcagattataaactaaggcagtgatcaactttctaacatattattgttttaaattttagtttcagtctgatggaagcaaacaggaagataaagagaaaacggtaagagactgaaaaaaattaaataatgggtgtgtttgtcaggatatagcatgccaaatattttactgtgaacaagacttagctacccttagaaatagttattttatactttacatgctcagtacagcatttggcaactcattgaacattttctttgaagattaatatcctctttttgaaaattccatgtgtaaaaaggttaagcctctcattgcctagttaccttctctgcttcttttacttcatttgctatcttaggtaaagaaaaggcaatgatagggtgaggagtgtgtgtgtgtgtgtgtgtgtgtgtgtgtatgatttaaaaatgataattcttttaaggcatctctattttgggtgtattgaaataaacctaatgaaataatttttttgttttctttttaggaagttatccttagctgtttgcttagcattactgaccaggtattacttccatctctttctttgatggactgcaatgcttgcatgtctgaggagctgtggggaatgtttaagacatttccctatcagcataggtaaatacttattcagattgttcactccaattaattctagtatattaacttctaagcatttaatattttctaaattttcatctcattttcttaaagatatcgactatatggtcagtggaagaatgaaacttataatggtcacccacttttagtaaaagttaaagctcaaacaatagacagagccaagtatatcatgaagtaagtttaatttttttcatacttacctcaaatatgtctggatataatttactgtctttcagctattttgtttagactgccagttttgagaaagattataaatacttagaggtatagttgattacatattgcagttagaatgagttttttatgttttatttttataatttttaggtttatataagtgtatgggggataggagtaggtgtgtgcacgctatagtatgcgcatggaggtcagagtggtggggatgggctctctctacttcatgtttgtcccaggaatcaaactctgctcacaagattgatagtcatgccgctttcttataaagttatttgaagcttatgaaaattgtatatttcatgcaattattagtctagatactaaaaactcttctatttgttttcaacaaggattttgtcagttgtccaacattttataaatccatttacagttattctaattaaagttacattttctttggtttcactaagtataatagtttgaagtgatactgtgtttgcccagtgacattgtctttggacattggctattgggaaaacaggcatgaacatggtcatagtttggcttataatgaggtgtgacaatagacagaatgaaatatctaattaagttaataggggaagaaattattgctggagaggctattcagtttgatgaacccaagaaagttttagcttcagaagcctatagatacagtatcgtttttttttttttttttttttttttaaagcacactggacgatcatagttagcacttggcagacttcttatttatttacttagatttatttattaattttatgttatgtgagtaaactgttgctctcttcagacacaccagaagagggtatcagatcccattacagatggttgtgagccaccatgtggttgctgggatttgaactcagaatctctggaagagcagtcagtgcttttaactgctgaaccatctctccagccctgaatttacagccatccctctgacttgtggaagtcagatcaggttttgtctatatatctgcatatacatatgatcaggtcattcatatatgcacacatacactatttgtgctaggcgctgagttgaatgctttttaaaaataatacttaatactaattttcttgattctctttactctgtaagcacaaccttaattcttttatctggaatagtatagtaacttgaattattttcttatttcaaaatctccccaccttttgttttttgttttggctttatggcatggtgctgtgagagatactccttgatctttcctactgtatagcctacctcatttccttcctaatgatgacactttaagctctactgaacttacttgtttcctgaaatacaccatgctctccttagccttacttcctttgtatgtgttttttgcttcctttatttgtacaaattttcccttatcttgcctttccttctccatctggtgattcatcttagaaagtgtgcatgagtgccagctctccgaagcctccacaggacatactgacaaacaaagttgatttgtgccaccagtacactttaggcaaattatgctagcattccacttgtgcacattactatgatagtgttcctttttgtaagtatataaaatcagcagatgaatgaatatactgattctacatataaatgtcattatatagcagttctttctattcccagcttagttcaggtaccacggtgttctccagttttgtccatgttgtgaatgacagaatttccttttttgtttgtttgtttttatttttattttttatttttatttttttggtttttcgacacagggtttctctgtgtatccctggttgtcctggaactcactctgtagaccaggctggcctcaaactcagaaatccgcctgcctctgcctcccaagtactgggattaaaggcatgcaccactaacacccagctcttgttttattttttattgtccggtttttcaagacagggtttctctgtgtagccctggctgtcctggaactcactctgtagaccaggctggcctcaaactcagaaatccgcctgcctctgcctcccaagtactgggattaaaggcatgcaccactaacacccagctcttgttttattttttattgtccggtttttcaagacagggtttctctgtgtagccctggctgtcctggaactcactctgtagaccaggttggcctaatttgctttttttaaagtgaaaaaggacactagtaggagaattattggggaaaagagggatttgaaggaaaggagaaatgttgatcaaaggatgcaagattttacttagatttaagaaataaattttacttacatattatactttgtggtgaccatagtcaacaataataatgcctattgcaaaatttcctgaagactaccttttaaagattcatattacaataaaaagtaagtattgagatgaaaaagtcataatttgcttgacagatttattctataatgcctatatagattaaaaacatcacattgtgctcttataaagtatacacgtttttaaaaaggtgtatgtcccgttcttcacacactcagttctctcccagagaagaaaagtaaagtaaccagtatttacattcttatttatcctcccaagggtgtatataaggcaatgtagatatattatttatactttttaaaaaaaagatttatttattattatacataaattcactgtagctgtcttcagatgcaccagaagagggcgtcagatctcattacagatggttgtgagccaccatgtggtttctgggaattgaactcaggacctttggaagagcagtcagtgctcttaacctctgagccatctctccagccctatttatactttgaatgttattgattaaatataagtgctgttctgaaacttgatacctttttagaaagcaaatttgtcaggaatggtaaggtacttctgtagtccttgtacttgggaagctgaggcaggcggtgatgactctggccctgtctttactacctgagacgagactgggtcagaaaaagcaacagacagacaaacagacaaggtaaaaacagaaattctaaaaatacggttttaaatttgtgtctttagttaggccaggcttgagagcaagaactgctcttcatttttatgttcttaatgcctagtgttttgtcatagtaagcattaatatgaatgaatgcgtacatgaatgcatatttttatttagtgtagaataatatgtgtagaattttttttaatatacttgggtttttgttacattttagctgtagctcagctgttgcaccaaacttcatgaatttactacaactttttacattgacagtggaatattttaggatattatttgtataattttataatttttcaagtcattcattcttcaaatgctcactgattgtgttttatatgtctgacattctggtagcttgaaggtaggacactgtctggagaatatttgtttaattttgcttattctcgcttcagggtagtgaagagaaatggaatagaataaaacgtgtacagttttgtgtgactgaggcgagtaggagagccacctggtgcacgcttcgaaatagggaagggtggtgctaagttgaaggccgaggtggctatggtttccgatgtaaaaccaatggtctcttttctccatcagcagggaacaggagaaactgagctctaggaaaccagaaggggaagcagctgatgattacaccattttaattctcacaagacgcttcggaacatagttatattattactttacaaatggttgcagtccttgaattacaaatggaacttcattatttatttctaatgtttagtgctgttagatgtatattccttttagaaatgttctttcctttgttcacttgctgctgtttagagtctctgttatgtaaccatccccaaaacacttacgttaatctttagcagttcactgttacagagttttagaatcttagaaaacatatgctgatcacagaagaaataaaaaaaatgaaagaaatgtaatttattgattttaaaaattgtgtatcttgaataagaaaatgagagaactaatttctgaactgataaatgaaaccttgtaaatctaaaatacgtatgaatctttttaaaaagttttcatgtatttatacagtaaaataagttttactcttagtagataactagcatttaaactctgaaattccctaagagagtccaccttttgctacagagtggatgaaaatgcagttgtttgcatggatccatttgatgtatttgagttttccacatagtacagcaaagcttatcagcatcctgagtaattgtacttaatactgagccttggcatttctctccctttgtaggcgtctaaccaaggaaaatgtgaagccttcaggaagacaaattggcaagctgagccacagcaatccaacaattttgtttgattatgtatgttttgaagttaatattattttaagagatttcccttttgattgtctttatatcagtacaggtggaaatgaagtaaaatttaaaatgttagaaaacagcagatgaaataccactttatagtaaaaacaaaacttttcatatacagtatttcacaaattgatctgttttctagtaatgtacaacagaactattgttaaacatttgaataccatttcactttgattcccttttagcagtgttaccttctttttaacattatcattgttgaaattttcatacagtatattttgatcatatttcccctcccacaagtcttcccatatcctatctactttcctagttaccaaaccccatgttttctctttcacttggaaaagcaaacaaacaacaaagacagaaattaggtacccaggggctggggtgggggaaagcacagagtccattttagaaagactctaaataacatttaaaacaggactagccattactattacaaaatacaagtttagacctcttggaatcgtttcctaggtagaaaatgtagccttgggaaaatactctatatagcaatgataatgtaattttttttttgtaaaatgttttatatagatgcaaaccagagaaactttgttttcaagacagggtttctctgtatatccctggttgatcttgaactcgctctatagaccaggctggcctcaaactcacagaaattctcctgcttctgcttcccaagtgctggagctgaagtctgcctggctggaaccactttaattttattatttctaattttagagaagtatgaaccttacttagcatagaagtttttttatttatttaatgcaacttactctttcttgatcttccagatcttgtcacaaatccagaaatacgataacttaataacacctgtagtagattcattgaaatacctcacttcgttgaattatgatgtcttggcctgtatcctttcatgtggagcaaaatatagatttcatgtgtccctttatttaattgctgaatgattaatttttctctgactttctttagtaatgatctaaagttggtctaattggctgatctgttgtcagcccaaagtattgaaaaggaaattgtgtatgtgtgcatgtgtatgcatgcacatatgttagtgctttgtgttgtataaagggagagacactcactttatcaagcatgttgatacaggtggaatgttacttgttaggagatgggaaagagggttgataaataatgagtatatggtagctattttcattcctctctgaagatgtgggggtttaagggtctttattactgatgttctggtattttttttcttaatgtatgaaagattgtatcattgaagctttagctaatccagaaaaggaaagaatgaaacatgatgacacaaccatctcaagctggcttcagagtaagtactttcacttttctcaggatggtagtactagtagagactaaggaggtggcaactgccaggctttctttacctgcctatgctttcaggcttgtaagtgcttatttctcaagagctcttgacagtatctagccactaagcttgttctgcaaagtgtcagagaccttgggtctgtatggagattttattaagtacttactaattttctttactgaagagactattttattttactatgatagaatttgaggaagttgtctctggccataccaccctggacttgttgagtatcatctgatctgggaagtttagtgcaattggtctgggttagtatgtaaataggagaatttggggaaacatttggaagctgacattcactttctttctaacttactgttatttagaaattacactctttccttgtctaatgtatatgaatctgaatttcccactgtacttaaggtccttaagtcagaacttaaagtttggtctaattatttacataattagcaaataacttaagtattatagatgattagataatcttcctctagtcttcacttcctttccaggaaataatagggactattggttaaaattggtcttctaaggttggcaagagggctcaatatttaaaagcgttgactggtcttctagaggactctggttttagtcccagaacttatgtggtcactcaaccctttttaaccccagttctggggaatctgacacccttttctgatcttggtgggcactaggcatatacaagctacataaatgttcatataggcaagacacccatacatactacaaaaaagcattctgcttctagcaaaattacctgtttcttttgctttgtacaactgtagtatgttcctagatataaataataatttatgactcaaaactttttaggggtgggcatttagttgtttgagtttacttggtattctgtgtggttgagtcctaattggtcagggtgcatagtttgaatcactgctttagtttatattgtgccttggagcaagtcatgcgacccttttttcccccaatttacctcatcagtaggtttatactaacctaagtcagttattgatataattaatcaatgtaatgtgcttgcttatgtatgcttaataagtattacctattactgtggtaaaagtccattcaattgtacagtcaaatgtacagggctggagagacggctctggttaagagcactggctgctcttcaagaagacccagtttcccagcactcacatggcagctcatggtcatgtgcagcacctgttcaggggatctaatacccttttctagctcttccttaggcacttggtaatgaacatggtacacatatgtccatgtaggcaaaaatgtatacacatgaaataaaaataaaaatgttttaagaaattattcatacctcattttgctttagaaattgaatttaatgaaattatacttactatatttttgtctgataaactatttttgtttttgatttcatgtaggtctggctagtttctgtggtgcagtattccgtaaatacccgattgatcttgctggtcttcttcagtatgtagccaatcaattaaaggcaggcaaaaggtaaattatatggaaatgaacttcaataactcaagcacttctggtggttttgaaatgttgagattactgttattttgaaagacacatagattcaacttaaagactcacacacacgggggggggggagggagagagagagagagagagagagagagagagagagagagagagagagagagagagagagagagagagagagagagccatgtgccatcctggaactcacaatgagatccaggctggccttgaactcaaggagacccacctgcctgcctctgtctcctgagtgccaccatgcccatatacaggaaaaatactttttgaatatgaatttgatatgtaagatttatgtacatctttgtaaatgctgaagtttattctgggccagtggcagtgcttaggttttggataaatagatttgttaaacattagtactagtagattgattataatcaaatattttaggtgtgctgtgaggtagatcatcaaggcttaagggtgtgtggggcaacagatttttcagcaagaaacgaagaggatgcctgcctgcctgcctgcctgcctgcctgcctgcctgcctgcctgcctgcctccctccctccctccctccctccctccctccctccctccctccctccctccctccttgtctgtgtgtttgtctgtgtttgtgtgagatacaggtgcgggaaggagggtgtggagggagtgatgagagagaaagcaaaagagacacagagacagacagacaacgttctgtgacctgcctccttcagctagacttcacctaaagtttcaagaaccttccaaaatagtgccatcagattgggatcaagtccttaactcatgaactcttagagaacatttcttactaacaatcaaaacaggagagaggtagaggtggggtgtgtggaggaagtgaagggaagtacaaatgaaaactgaggaaaaatacatgaagcttgggtaagggagaaggaagatgttttcaataatttttatttttgtatcttattccaagcttcaaattaatccaggtaaaaataaatcaaagagaaacatgaaatatttttattgtaggtctagaatttatgtaacatttattttgaaaataagataaaaaaaaacaagccctgctgttgtctctcattccttcgtctaagtaaagattctcaggagactacttattatgtattattattttcatacttaaagttttaacttcaaatacttttcttttgattttatagtttaatttttgtatttctttaaaatcttgtattagttttgacctactaatattgaaagaagtggtacaaaaaatggcaggaattgaaattacagaggagatgacgatggagcagttagaagccatgactggtggggagcagctaaaggctgaggtaagtaaggacttattatttgtggctttgtctttcaagatgtcaattactcctgcttagccacaattcaaaattaaagagaaacatatccataagtagatgaattataatattttactttgagactcattttatatagaatgataaaaatttttgcccttcttgctcacttttggcacataagttatctttttggccatcgtatccacagtgtataagctactcttaagtcgtagaatagccatctttgtttccatattggctatgtggagagtagtcctggttctcagttggctatattgcaaaatgtttatatcaaagtaacctttgctcaaatttcccaattcttcatcactctgcctgtgttgtttcatatcattaagaatgtcaatgcagtgcagtaatatatttggggagtgaccatatttatgtaacttttattgtatcgttgagattgttgtattaattgctgttgctaatttttttctctttacttttttaattggttattttatttatttacgtttcaaatgttatccgcctccccagtttgccctccacaagcctcccaccccactccccgtgccgctgcttttatgagtgttccccgactttcctacccattcctgcctccccgccctagcattctcctacgctggggcattgagcctcccctcccattgagcctgacaaggccatcctctgctacatatgtggctggagccatgggtccctccatgtgtactctttggttggtggtttagtccccgagagctctgggggtgaggtctagttggttgctaatttcttactgtgcttaattaagctttgtcatggatctacaaaatatcgtttgtgtagagtttcgttccgtctacagttttcatttatccactgtgagttgtagaacataactgccacagataagtgtgtgatgatagtatagaacctaaacagtatctaattacccaaagctaaatgtcaaagtcatacatgttctcctcttaaaaccactgctaccttcttttgtaagagctgtgaaacactagtaattggaacttgaaaacacgcaaaagtataaaagacaataacttatttgtactgaaaagattttccttgatatttccactggaataaatctctatcacagtctactaaatcttttcactgaataaaaaaataatcctttgtgagattttaccaagtagaaaatggaaacaatgagttgcacaattgagctaccattagccagattatagtaaacagtagtatcattaaaactaatttgttaaggagaatgtttataggttatagaagtgctttattttatttggtgttgctttatattaagccaggcatgtcttcttcttattctgttttttaaagacagagtcctttctactcatttcaagctggactcaaacatgtgtagttgaggatggtcctgaacatgcaatcaccttgactctcttgcccatgtgaatggatgataacttctagctccgaaatattttaaagattatgcctcaattttcttgtgtgtcttttcccagtaagacagcatggaatacattgcatatagcaataatttttgtcttcttttatgcagggtggttatttcggccagatcagaaacactaaaaaatcttctcagagattaaaggatgcactactggaccatgatcttgctcttcctctctgtttgcttatggcacaacagagaaatggggtaatttttcaggagggtggagagaaacacttgaaacttgtggggaaactctatgaccaggtaagtgaaagaagcttgggtgttgaggaaaacttttttttaaatctcaataaaatagaaattgtgatgtcatttgaaacataccatttgtacacataatgtgaatgtctggcacctctaatgtcaaataggctttccttaaatagagcccctatttctgtgcatactattctatttacaagatgggtgtaggggatgttatatataaggtcttcagttaatgagacattccatcatgaaaggccatcatcagattgtttgccttctttttgatctttggaaatttgtaattttcattgcaccacagtagatactatatcttatttcttagtaataatattgctaatacgcaaacccattttgttggctagtaatgtttttgtggttaatattttttatcctttaaacaatgacagtcactgacttctcattgcatgcatacacacacacacacacacacacacacacacacacacacacacacacagttttataggattttaggcgagtgttctgagaggctcttgttgaactgtccttgactagcaactcaaaaggtggcttttcaacctagtgttaagtttctgtttcatagtctatggcttttaggagactcttatcaactcagaggggaaattttcatttacactatgttttaagcactgacatgtattaagagcatctttatgtaaataattgatagtgtgattccttgactcttttgacatcttcactgttatttgaccctcctcccctcttctgtatttcccttcctccccactcctgtaataaagattaccttgttttctccattgttcccttcaagtcagctgtctcctgttatttccctttccattgcctccctcaccatagtgttccctttgcacttttctggtttctatagttactacagtttttatactcacagctgaagatgtagtagtaggttatagatatgtatcactgttcttagagctcacatgttctctctcttcttttggagtccataaagaaaaatatatttgaccgattacaactatgtgaatatataatatttgttttaatttagaatttttatttgatacgtagtaattgtgtatgtttatagggtacattgtcataattcagtgcatgtatataatgtgtaaattataaaattgataatttctatcttcatcttttgaaacatttattattcctgttgacacaaattgctttaagccataggcagtctatgttggctgtctatcacttgagcttatgtctcctatagaaatgcactgtgttaccccagctcctgcatctctctgccctttccagcgacgctcgtcgcctctcagagctactcttctttttacttttgtgatggcaacatttttttagactttatgtacaagtgggaatatgtgaaaattatctttctacccttgtttatttcactgaacatagtgttcttcatttctgtccctgcctaaactattgaaatttggattctttttttttttttcattttttattaggtatttagctcatttacatttccaatgctataccaaaagtcccccatacccacacacccccaatcccctacacaatatgtactcactgataagtggatattagcccaaaacctaggatacacaagatataagatacaatttcctaaacacatgaaactcaagaaaaatgaagactgaagtgtggacactatgcccctccttagaagtgggaacaaaacacccttggaaggagttacagagacaaagtttggagctgagatgaaaggatggaccatgtagagacttccatatccagggatccaccccatattcagcatccaaacgctgacaccattgcatacactagcaagattttatcgaaaggacccagatgtagctgtctcttgtgagactatgccggggcctagcaaacacagaagtggatgctcacagtcagctaatggatggatcacagggctcccaatggaggagctagagaaagtagccaaggagctaaagggatctgcaaccctataggcggaacaacattatgaactaaccagtaccccggagctcttgactctagctgcatatgtatcaaaagatggcctagtcggccatcactggaaagagaggcccattggacacgcaaactttatatgccccagtacaggggaacgccagggccaaaaagggggagtgggtgggtaggagattgggggtgggtgggtatgggggacttttggtatagcattggaaatgtaaatgagctaaatacctaataaaaaatggaaaaaaatatagcattggaaatttggattcttaattgtcaattaaaattctgttaaaataacatatatcttaatcatttgagaaaggtttatgttggttttggaaaatgttaacatctgttttttgtgtttgtttgttttttgtcttattttttctttagtgtcatgacaccctagtacagtttggtggatttttagcatcaaatctaagtacagaagattatataaaacgagtgccttcaattgatgtgctctgtaatgagtttcatacaccacacgatgcagcattttttctgtctaggccaatgtatgcacaccatatttcggtaagtatgaatgtcttcattggtgttcaagagtaattctgaatgatttacacaaatatttgattttttaaatacacgctaatttgataaatacagattactctaattttctattactattcttgtctcagcagtaaacagtgaaatgttgttttacaggacaggtcttcctattactttctccatagtcaattcatagagacagacccagcatatcctccggtttgttaatttggagtctagcccttcagttcttctttttcttttttattctatagtttgtggcttccagtccaatttgtggagtgaaatcatttaattctatactgtgtgtggtatttactccagtcattggtcccgtctcttaaactaagttttcctttttatttcctataaaatttctgttatatagtgtgtagcagaagtatttagaaagacactaggggagaaatttgacattcatttgatcatgtaattgagaatactgttagtgtttacatatgaacaactgcttcagtcttacttgatttaatgaccacttcactggcgttatgcagcaattcctttcctgaatattctagagggttaataggaacaaaaatggattttaaactcctttaatgtctcccattccagagaattcactgctgtatgtagttaatgttttacattctcaccctaaccacatcaaaaaatctcatccatagaaacataggacctgattttttcaagaacctaggtagaagaaatgctttatctaagggatttcatatcatattttagtaatttgaaactggacaccctaatcagtaatgagtcctagcaaatgaatacctgattgtctgaaatattcctggtcaaaaaaatgacatatcttttgtgggatgaaagtgttttcttttaagagatatacaatctaatcaaagaaatggcattttcttctcagggtttaagaataaagaaatatatcgtggcatttatatactctaggcaataataaagtgctcccaacccacttcctatagggcacatgcctctttggaaagggaattcctcagcagcctaggatgcaattgaatgggcatccacactgctctaactttgtctcttaggtgaggtctttagtgagcttttgatgaatgagagagaatgtataagaaagtgatgagagggctggaggtatggtttacacagaatgctattctctggcttccacaggtagtcatatacatgtgtcacacacacacacacacacacacacacacacacacacacacacacacacacacacacggtggggggggcggggagagagagagacagagagagagagagagagagagagagagagagagagagagagagagagagagagagagaaagaatatgagaatgaatgaatcattttttaaagaatgagagaggaaatgggataactgcagattcccctcaggaaattggctactacaggccttcaatgaaacactgctcagattcttggcctgacagaaagctttttggacataaatcagtggtactatattattctctgtttgttggaagatgtaaacttaagggctggagagatggttcagaggttaagagcactgactgctcttccagaagtcctgagttcaattcccagcaactgcatggtggctcacaatcatctttgatgggatctgatgccctcttctggtgtgtctgaagatagctacagtgtattcatgtagaataaataaataaataaatcttttaaaaattaaaaaaagatataaacttaggtattagtttaatttaagagaaggaaaattagcattgtagatgaagtataaccatctttttgattaagcttagttttctgactagatactagtagcaggcctacaaactagattcatagattcaagaccagagagttgggaagatttcgtattattggtgctatttagttttctcataactataaggtaattttcacttttaattattgatactcaaatcttgaaacagatctaaaaggaaggttttccttgttctagctattctagacttttcccattcaggagtcagcttgtcatatgcaggtaattccagcactgttttatctcatgcctggtagagcattagcagatgtcatttcactcatctagattcatattagttaccttcagcaaaatctattttttaaatttaaaatccttttcacccccattcttagtctctgatagaattgttatactttcctgtagctaacgtttttgtagctttatcaattctatagtttgagtagttatcagcctgctctctagcatggctatcaaaataaataaagagttctacttctagaataattgcaagattcctggattttgcttgacataacattgaatgtagtagattgtacactttcagttgagtcagcttggatgaagcccagtcagtctcaaggcagctgagactattaccagtgtagaactcagaacctttgactgatgatcatcttggtatatacttaggataaactgaagtatttcaatgctttttctaatacgaagaagcagctggttgcaagacttctcttagattcaacttaaggatcatgcctgttttcttggcaagaggtctttcatcataaaatggctgaaagacatgagatagtgtattaattttctttgttgcatttagaaataattatgtcagtatctctgtactaatagattcatttttaccttatgtaactgaaaatatagtcttcctcccaattctctttctattaggacaaggcagtcaggacaaagaaactgtagcatcacttctcacatggtttcaatttaatttacttcaggtacttatggaaattttcatttggcttggcagtaggctacagtagctgattgctatgtctggaatgttgtcattttcagcattgaagtgttcattctgggacctctaagtctgtggcaaaactgtacatttagtttctgaggtagtcatctcagcgcctttttataacctttcttagtggcagtccaacttactgactgacacatgccctattggagatagtaggtcaacttttattgacaaaaactagttaagaacataaaattaagaattggaacagatttcaaaggtaatttatcttaaaataagtgcttttggtaagaaactagaattgccatgatcattttgtacaaatatatatgatatgttttaactttttatctacagtcaaaatacgatgaacttaaaaaatcagaaaagggaagtaaacagcaacataaagtccataaatacattacatcatgtgagatggtgatggctcctgtccatgaagcagtggtctccttacatgtttccaaagtctgggatgacatcagtcctcagttctatgctacattttggtcattgacaatgtatgaccttgcagttccacataccagctatgaaagagaagtcaataaacttaaagtccagatgaaagcgattgatgacaatcaggaaatggtaagttttgatgtagcgatgcaagtatagttgcgtcatttatgcagtattatccatattttgtaattattttagtttaagattcttccatcttgttcctctataatattttaaagttatttgatggtaacatctcaatggttggggcaggatcttaggaaatggttagaaatcatgattaaggaataaaagacatgcatgtcttttctactgaatactgccattgcagcgtaatgttttttgtgtggtttttgtttcaagaggagtaggaattcccaaagtattattattatcatcatccacaatatgtatatgtatgtgtatgtgtatgtgtatgtgtatgtgtatgtgtatgtgtatatgtatatgtatatgtatatgtatatgtatgcataatccagcaaacacagggagtagtatggggtttaaggagacttcctttactctacttgatgatgtatttaaaaagtcaggttggtaaaaaattaggcaggtattgaaagttggatagaataataaatatgatataattaaagaactaatttagataccttagctgtgaaataacaggtgtaaaaatggaactttaaagagattatgagagtaatatgaagagtgattttgctaggggggtgttatttagtctgaggttagagaccagctagctgcgtgtcatttagagtactttgttatgagatactgagaatataggctatgctagagacagtggcagtccatatggcttttaaacaagtaggctgtaggaatgaaggaaagctaaagataacttgatttttgcctcagatgtatactaccagggttaggaaggtaacctgttccgaaggtgtgtgaggactctgtgatactgatttggatgtgctgaatgggaagagaagtatacactcaggcatatctactggacaatcatgcctcaataatcatagagtataagcacttttctcttgacaattttatacatgaaaggagataatacagttagaaaactgactttactttgtagcctccaaataaaaagaaaaaagaaaaggagcgttgcactgcccttcaggacaagctccttgaagaagaaaagaagcagatggaacatgttcaaagagtacttcagagactgaaactagaaaaggacaactggcttttagcaagtaagttcttgggattgactattcctgctgctgctgctaaattgcaaaagcaaacatttctaactttggcagtgttcaagtgattatgcacatattctgctttagttactcattaccacagaatcaacctcatgtattcactgaagtgactgatgacagtttgctaacgaaataaaattagtttgtgtaaagataatactaatagcttaggatttaaattttctgtacagggtcatagtatagatactatatatctataatatgaacattatagataaatgtccacagagtagtaataggaatctttatcacctcatttgtggttttataacattgtgtacactacagttaaaatgttgtcatgtttggtagccttcaggcactttagggagaagataactgcttaatatgttcttttatttttagagtctaccaaaaatgagaccatcacaaaatttttacagctgtgtatatttcctcgatgcattttttcagcaattgatgctgtttattgtgctcgttttgttgaattggtacatcaacagaaaactccaaatttttccacacttctttgctatgatcgagtaagttcttatcacaaccttaaaaaaaatccacataaacacagctaagtactataaactctagaggcattatgtatacagtgaataacatgatcttaaaagccaagtttgtgaccttgaatcctaactctacttctttaaaactatatgtcttagggttctcattgctgtaaagagacaccatgaccaaggcaactcttatgaggacaacatttcattggtgctggcttagaggttcagaggttcagtccattatcatcatggcaggagcatggcagcatccaggcagtcatggtatagggactagggaaaactgagttctatatcttgatgtgaagactcctaggggaagactgacttccaggaagctaggaggagggtctcaaagcccactcccacagtaacacacctacttcaacagggcgacacctcctattagtaccacttcctgggccaaacatattcaaatcaccacactatatctttcacaaggtatttaacttctctgtgcctcagttttcttatctatagaaagggacttgctttgtaagattgatctgagggttaaatgtgttactatatataagaactccctgaaatggtatctttgcactcaaggttaacctattcactcaggctttgaatttaataaacttgtaacttcattagtggggcctttctctattctttaatttttgctcctcaaaataaaactaaaacaatcttctacccaaataaaagcctttatacatttacaccacatgaaagcagggaaattctttagtttcatattcatgaattttccatcttgcattttttcttatattaccattatttgtgggtttaaaatgtgtattatagtttgtttgctgcatatttctaaattttatcacctttacctttgcctactatctattcagtctcagtcatgaatgactaagtctccaagaagcattatgtaataaaatgataataatagccttttcttttatcattataaattagatttcttcaaaaaatatacttggattctttatgattgctatttttttttttttacagaatctagagttgccaaaaaataaaatctctgcaggtgtgaatataataggagaaagtacttttttttactaaatttatctgtatattgtgatatgctttaatatagtttttaatattttcagttagtttgattttttcgaacgtttcttctctaggttttttctgacataatttacacggttgcaagctgcactgaaaatgaagctagtcggtatgggagatttctttgctgtatgttagagacggtgaccaggtggcatagtgatagagccacatatgaaaaggtatataattaacaaatatgtttatattttacttgtatatgtattgtattacttgtattacttgtatatgtattgtatatgtatatatattgcttcagattggtcagttttaaaagaatttaagactcagctataaagtgatacttaaaatcataatatatcataaaaagtatgttttttattctatttcaacttgatatttcaagttattatcattgggtaagctgaaccattcttttacataaagagtcactgatctggtcttattctcctattttgtgggatgaattttacctctaaaaatgagaaacttatttttcttaggaatgtggaaactatccaggattccttaccatattacgggcaactggatttgatggtggaaataaagctgatcagttagattatgaaaattttcgacacgttgtccacaaatggcattacaaactaaccaaggtaaaatatagtagatatttttcaaagattttttttcctcttcaaacctgtattttatgataatcgttctttcaacatctgttataggcatcagtacattgccttgagacgggcgaatatactcacatcaggaatatattgattgtactaacaaaaatacttccttggtacccaaaagttttgaatctgggtcaggctttggagagaagagtgaataaaatatgccaagaagaaaaagagaagaggccagatctttatgcattggctatggggtaacacaattatattttaatgtaacttataacactagattacagaaggattctgaagatgtgaaaatgttttacaatgttgaagtcttatcttctgctttacttcaggagattatgggagattatgcgatcatgttcccacaggctggtgagagttgtcacttctgattatcaacttccggtctatactggatgatagtttcaaagaaatatatttcttgatggggggagatataatttttaatagttctcacatcttgagtaacaaaaagaaaaaggctctctagttaaagaattagtttaatttgaaagaatgactaagtttttagaacactctaaagaccttgaggaatatactgaaaagtggtactttattttctagaaccaagtggcagagtgaataatttgtaaaattttatttgattaaactccatatttatgtttttttttatttgtgtacgtgtatttaaacactttgtgcgactttcagctactcggggcagttgaaaagtagaaagtcacacatgatacctgaaaatgaatttcatcataaggatcctcctccaaggaatgctgttgccagtgtacaaaatgggcctggtggtgggacttcttcatcatctataggaaatgcatctaaatcagatgaaagcggtgctgaggagactggtacgcttgtttgtagacacttctaaataatgtatcgaaatattttattacatgataattacaatgctaaccccatattgcattttattccctagttatgagtatgtaactattaagaattaatcagcctcctgggccttcctaattatccacaaatcattttgctgtgaagtcagaatttgtatttagagttagctaacaaaaaccttgtttttatttcagataaatcaagggagagatctcagtgtggtacaaaagctgttaataaggcttctagtaccacaccaaaggggaattcaagcaatggaaatagtggctctaacaggtatgaacactgtgccatatgttacaattctaaaccctcgtgtgtgtgtgtgtgtgtgtgtgtgtgtgtgtgtgtgtgtgtgtacaccatgggtgtgtataccattcatgtatatgtaagtaagtagttgtgcatggttgccacaatgtgtgtggaggtctaacatcagatgttactccacaccttgtaccttgtttgaaattggatcccctttgctgcatatcctaggatagctagcctgtagactttgaaaggttctcttttctctgccttccattctaccgtaggagcactgggattacagatgaggtctattgtgcttgtttttaggtgggttctgagttaggtgggttttaggtgggttctgaggagttgaccttgcgttattatacttgcatggcaagtactttacaaacatagccatcttcctaactccagagttctctcctttaaaaaattatcttataagtgagcatacagagtaattgtggcatttccatatgtatgtctcattatacttcattctaatttgcccttacccccgtgacctcccttgctctcattgtctcttgctagtctccgccttctttccaaataatctcttttctgttcttaaatgacacatgtattctattatcttcctttctgcctcttgttcctcttttatgagaactgtttttctttcttggttccttttctactttcataatgtatatggtatttacatacttacatataggttctgcacatggtattttcctatttgagcctttctaatttcaagtactgtaaagatttcccggtgaatccatttccatcaaatgccatcatttcagttttcagtttggttgcatttcattttgtataaatcccatactttctttatccatgaatctgtcaatagataaataggctggctcaatttctttttttttttccccacagaaaattccatgattttattattcgtgcaatcctttcagtttcccccccccctttttttccattttttattaggtatttagctcatttacatttccaatgctataccaaaagccccccatacccacccccccactcccctacccatccactccccctttttggccctggcatttccctgtactgggacatataaagtttgcaagtccaatggatctctctttcaagtgatggcctattaggccatttcttgtgaatagtaaaacaattaacaaaaatgtaagtatctccatgttatgttgaattagagacttttgggtgtacccccaggagtggaacagctgagatattctattagtttttgagacacttgtatatatactgactgctatagtggttgtatgagttaacatttccactagcaagttataagtataacgttttacccacattctcaccaactttttttcttgtttattctcttgatgagagccattctgactggttaagagcggttttattttttatttctatggctaagatgttgaacacttttaaaagtatctattggacatttaattttatgacctgtttatgagttcattactagcctgtttattaggtgaattttggagaattatttgcaattctttttttattctttttttattagatattttcttcatttacatttcaaatgctatcccgaaagtcacctatacccttcccccgccctgctcccctacccacccactcccacttcttggccctggcattcctctgtactgtggcatataaagtttgcaagaccaaggggcctctcttcccagtgatggccgactaggccatcttttgatacatatgcagctagagtcaagagctccggggtactggttagttcataatgttgttccacatatagggttgcagatctctttagctccttgggagctttctctagcttctccattgagggccctgtgttccatcctatagatgactgtgagcatccacttctgtgtttgccaggccccagcataacctcacatgggacagttagatcagggtcccttcagcaaaatcttgctggcatatgcaatagtgtctgcgtttgatggctgattatgggatggatccctgagtggggcagtctctggatggtctatccttttgtctcagctccaaactttgtctcttaactccttccatggatattttgttcgctattctaaggaggaatgaagtatccacatgttggtcttccttcttgagtttcatatgttttgcaaattgtatcttgggtattctaagtctttgggctaatagccgcctatcagtgagtgcatatcatgtgagttcttttgtgattgggttacctcactcaggatgatatcctccagatccatccatttgcctaagaatttcataaatccattctttttaatagctgagtagtactccatcgtgtaaatgtaccacattttttgtatccattcctctgttgagggacatctgggttctttccagcttctggctattataaataaggctgctatgaacatagtggaacatgtgtccttattacatgttagagcatcttctggatatatgcccaggagagggattgcttgaattttggagaattatttgcaatccttgtcactctcctgtctgagacataatttgccaagctttccctcagtttgcatgctgtctattcactctgatgattgtttccttagctgtgtagaaacttaatatcaactctaacatcgaggtatttgatctttgaattgattttgagcagaatgagtactagagatctagtttcattcttttacatagcagtattcaggtttcccaatgctgtctgttgtatatactgccctttttccaatctatgttttgatacttctgttgaaatttaggtgagtgtagctgtgcacatttatttcttgcttcaatattctattccaatgatctccacttatccatgtttgttcctgttccactaccatgctgtttttgtccctatgaatcgctagtataatttgggatcagttattgagatacctcctagcattaccttttctgctgagtattgctttggccattccaggtcttttgtatttttttttcagttttaggtgtgtgcatgtgtacttatttgtgtgtgtgcatgcatggcctcctctctttctgtgtgtgtgtgtgtgtgtctgtctgtctgtctgtctgtctgtctgtctgtctctctgtgtgtgtatgtaattctgtaatgaagaatttcctttgaatattatagggattatgttgaatatatagattacattgggtaatagaactattttcacagtcatgattctcctaactcataagcatgggatttcatttttttttttaaattttattttcatggtccagtcagttttgctgtttaaaatttggtcattattgaaaatatttttttccatacagtatattctgattctgatttcccctccccatctcttcctagttcttcttcacctccctactcacccaaatctatgtcctttcttactcattagaaaacaaataggcatctaaaaattaataatgctgaaataagataaaattaaagcaatataagttgaataggacagtatcttcttcagttagtctctttttaattctctactctcttatttcctcaggacaattcctaagtattttgctttttgtaaagttattgtggatgatttcttcctcaacaatttaatctttagtaaatagagcttttaattttcatgttactttgtagcctgttaatttgtttaatgtgtttattagaaataaggactttctggtgtattcttctggacctttttaaggataggctcatgttacattttaaatagatatggtttgaagtttttctttcctattatctctttcagttcattttcttgtttactgctctagctaagattttgagtactataataaatgggttgagtctgattttgcctaaagtgcttttgaaggtttgttatatggtccctgtatttctagttcccttagggttttgttttttttttaattcatggaaggatgttgttatcagtgtttctctgcagttattggcataaaattgtgatttctaatcctgagtgtgtctatctactgtattatatttcttgaaccattctttcatgcctgaaatgaattgagtttggttatggtgcatgattttaatgtgttcttgagttctgtttacaagattttaagaagttttgcatcttgaactagagagactgctctgcaaggttaagaacactgactgcttttccacaggacccaggtttagttcccaaaacccatgtggcagctaacagtcatttgtaactctagttctaggggatctgataccttcttctggcctctgggcatcaggcatttatgtcatacacagacatacatacatacatacatgcaaggaaacatacattcgcataaaataaatgaaacatgaaaggttttttcaaggatttatttatttattttatgtatacgaatgcaccattgctctcttcagacacaccagaagagggcatcaaatcacattacagatggctgtgagcctccatgtggttgttgggaattgaattcaggacctctggaagagcactcgctactcttaagtgctgagccatctctccagcccaaaagttttttttttctttttctttttttagtttattaggcgaattgtccatagttttgttcttttactgtgtatttattcaatttggatgtatgggtaattactgccgtgaacagacaccatgaccaaggcaagtcttaaaaggacagcatttaattggggctggcttacaggttcagaggttcagtccattatcatcaagggggaaacagggcagcatccaggtaggcacagtgcaggaggaactgagagttctacatcttcatttgaaggctgcttgttgaatactcttttccaggcagctaagatgaggatcttaaagcccatgcccacaggtgacacactttttctaacaaggccacagccactccaacaaggccacacctccatatagtttcactccctgggctgaacatactcaaactactgcagtagtgttactttactttctattttatgaaacactgaggatctttggcattggcacttttagttgatctgaatggttctggctttctcttctgtcttgttgcttgttatggatctatttaaattgattgtattcccttgacttaattctgattgatcgtgtgtgtgtgtgtgtctgtgtgtgtgtatgaaaaaattttactcattttttctagatttttcgagttttcttccttgatgatactggatatcattggaattaacagtaaatttatccttttcatctctaatgtgtattaacttgagtcttctgttttgactagtttgcttagaccgttacaattttttatttaattttttcaaagaagtaagtctctaattggttgattttcaatattgtccttttagtccctgtttcagtaatttcttccctgacctcaattatttcttgttattagctgctttgtgattttctttgttcttgtttttttaagatatcattagactatttcagacttttgatttttttatgtaagtttttatagttagaattgccttagttgtatttgaagtagtatcgtatgttgtgctttaattttcatttgattcttggaattttaaaagtttctcctttatttcaactacccagtagtcagtcatgagtgtatttttcagtctccaagtacttgtgtaatttctcttgctattgatttctcttatagtctactatgatttaatgagatagaaaaaatcatttcagttctgtatttcttaagacgtagttgtggtcagaatcaagtctcttttagaaagcagcagcctatgggctgctgggaaggatgtgcattcagtttctgatggataaaatattctccagattatctgtaaagtccatttgctctttggtgtagtttaactttgcagtttctttgttgatttttagtctgaatggatatctaaagttgacattggaatgtcaaaatgatcactgttactatatcaacacctgtgtgactctatatgaacattaatgtttgtttttatgaaattcacaggtctaacattcagtgcatatgttttttgattgttacatattctttttttaagattcattttattttatgtatatgagtacactatagctgtcttcagacacatcaaaagagggcatcagattctaatacagatggttgcaaaccaccatgcggttgctgggacttgaactcaggacctccagaagagcagtcagtgctcttaaccgctgagccaattctccagcctaactattacatatttttaaagcattcatatatagctatattattaaactgttatcaaaaagttggattctactttgttagctactggaagagctatggcagcttgattttggctgatactcacttggtagattgacctctatctcttgaggctcactctgtggtatctctagcagtgatagatgtttcttggaaacaacaaaataattgtatctaatccagtcagccacattgcctttccttattggtaagttgaggtccctacttctaaggctacatctccctcatttagtcatacagactgacagaatgggattcctgtctatttttcacccacctgctattggtgtcattttttttccactgaaatctgtaagtagatttgatggtaatgagtgttatcactggagtaaaacttattccccttccctttttctatccctcttcccctcccccctccccgtgtgtgtgtgtgtgtgtgtgtgtgtgtgtgtgtgtgtgtgtgtgttagtgttagttaaactgtgaatggagtttactttttccttgggctcatcacctaccattttacctggaagttccctggattcttctttgtttatccgtgagtggaatggtaaatggtagtaatttagcagtacaatagtcatgtatgctagactttgaagttttgcttactcccatttttatttatttataactaattatagtttacataattatgttttgtttttaacagccttatttgtcctgcagagagattggatgttcagggagatataaatggggaagttttcggatacagttcttgttgtaggcagtttgagtaaggctggttagtataagaaaagctcatagtaattttgaaagtagtcagtacagctgaatagtctgtttactgatagtgcctttaattggtttgcgccattattttattatcctcaaagtttatatataagataatctaaaattacttattattaatcattgttttaattacatattcatgaattagtgttgtttgtttcacatgaagaattactgacttatcctaaagcccttatttatctttctgaggattcctcttagtttcatggaattttttaagtcattggaagccctttctgatattttatttgctaatttgtttgtctgtctgtttgcttgcttgcacgtcaacataggatttctttgtgtataggcctggctgtcttggagcttactccgtaggccaggctgccttcaaattcacagaggtccatccacctgcttctacctcccaagtgctgggattaaaggcgtgcaccactactcacttatgattttagatatgggatatatttgatgattattttttaaaaaatattttttttattcttaagcaacaaagctgttaaggaaaatgacaaagaaaaagtaaaagagaaagaaaaagagaaaaaggagaagactccagctacaactccagaggccagggcacttggtaaagatagtaaagaaaaaccgaaggaagagcggccaaataaagaagacaaagcaagagagacaaaggaaagaacacctaaatctgacaaagagaaagagaagttcaagaaggaagaaaaagctaaagatgagaaattcaagactaccgtccccatcgtagaatcaaaatcgactcaagaaagggaaagagagaaggagccatccagagaaagagatgtagcaaaggaaatgaagtcaaaggaaaatgttaaaggaggagaaaaaacaccagtttcagggtccttgaagtcacctgttccccgatcagatatctcggagcctgacaggggcaagtgtacctttttatatttggttactttttggacctaattatgcttgttggttatctctgtgtcttgttatggtagtgattttgttactgcaacaaatacttggtcttaaaagttgttaattttttgaagtgtttggaatgactagacatataccttattctgactatttctttttgtccaaacagaacaaaaacgccgcaaaattgatagtcatccttctccatcacattcctccacagtaaaggttagtatagcctgaggaaggcagcgtccgtattaggctcacctgtttggaataccaatgtcctgacttccttcaagtcttgtgccaagttttcactggagccactggaggttttatattgcattagaaaatgaaatttttctgtattggtggactgatttttcctattgaatatttttcttataaaaatgttaaaacttcaaggacctagcactaattttattgtgtttcaaagtgcaagagaaattttacccagaagtgcctcactgctttaagcagtcctttttggagtgcaatggtagctacaagcaaatgaatcttttcagcagaatgaagctatttttcggcataaatgttgaagattatatagcactgaagacttcctgaatgatacaggataaacaagatacctctgaatttatcaagcttcttgatgagcatcataccgatgtgccttctaagaaggaatcttgaaaggagttccattttaaagtctccttggtgatcagttctcctgtagttgtgtttattcagtgagcatgcagcttctgttgtatcttcccttggaggtttgtttatacccattgggttcccaacaagttgaaccttgcgttacgataagagcagatgtggcatccagtcctaccacccagcaaagagaaaccccaggcattcaactgcagcacaatatcgtgggtgtagccttcttgaagactcagggtagccattccttgctccatatttaattttaattctaaagtcatctaatttcatggaatctttgaatttgcagtacgttgaacttttaaaactgtaagttaattaattcttcatccagagcactgtggtggaatactatagttggtttctttttcttttaaaattttttttccttgtgagaggcataagattgaataatcatggtacttttgcagcaaaatattgattactgttttatagaatattttttcttctaatgccactgaattttctagccagaataaaatgtttatatttattggagttgtaaatgaataaaatttgaactcttttaattagagggtaactataaaaatattagttatttttttcccatggtaacctctactgttctcaacttttggtagagaaaaatgttttgcctttttatagcctcttaattatttaaagcataatatgaaatatgtggcatcaacttttatttttttttaattttcaatcagaacaaaattttaatttttttaaaatttaatacttatttttaactttacaattccattatatggttttgatttttgttttgattgctgatattcatattgatagtgatttcctggaatttatcctcacaagaaatagctggtttgtttccaggttacagatatacttcccaaagttcctctgggttctgagaactatgccagctcacctgtcatctccattcattttctacaggacagtctcatcgatctcaaggactcttcagcaaaggtttgagtcttttaaaatcatgcctaagtacaccagaaattgctaagttcctttatttagtaggggccaccatcctagtaaactttgcatgctaggattggtgagagaaagcactccgtttatatagaattacctttaaagattttgaccacaaacaaacacagatgacaaccggccacatagacagacacattgttatatgtgtgatatggcagtatttttatatatttttcttgctgtacgacgtatttttcttttatgatttagatttaggaaaaggagagttttgctggtttatttgggatgggtggtagatagactttcatagttccacagagcaaactttccagttttattgctttgtttatagataactcagaagaacaaaaaagtaatttgctgcattcatagaacttttaaaaactcaatccataaatttctttatatctccctctgctgaagtatcctttagtaggtatggcataataccaagagatagagtaaatatagaataataattctcctggaaggacccaacttgttggttatgtttatatgtcagtaataattctcacctttttacactattctcctgggtattctgattcttaaaaacagtgtgcagtttgtgtattttcttatggagttcatttcagtattatacttgaattgtctattgacattttgtcttactatgaaatctgtaccctctttactttggtttttctactttatgttttctacttatgctaattatgattcttatagattaaatggaattttgaaatgtctggattctgggcaaacatttactaattattagtggttaaaatagccttagtgcctgtgtcttaaaaatatgacattgtttttaagataaactcttatccgaaagtttatatactttaaaaaattgtactttttttctttttactatgctaaactactagtagtttattttaaagtaaaacctttttattggctattataaagatgtactgcagtatagtaggtctttgcagccagtttaggattgcatttggtagtcttaaccagtagcttgtgtgggttattttttatccatgggcttgtaatagttttaatttgttagtatttatttattaaggcatatgttgaaatggtttgaaacctgatgttaaggttaactagattttcttgttagtgatgaagattacgatttcttgcatttgttgtgaagattgttttgtcagttttccatgtctagatgatatatatttgtctcacctcatgtttataacagtattatgaattaaatagggcagatgatagtgtctttttgacaaatgaaagactgagctatccccagtggcatacaatttgtcattactgaaaatgtgagttaaatcttgctggcatatgcaatagtgtctgggtttggatatagctggcaaatacagaagtggatgctcacagtcatctataggatggaacacagggcccccaacggaggagctagagaaagcacccgaggagctgaaggggtctacaaccctataggtggaacaacaatatgaactaaccagtacccccagagctcttctctagctgcatatgtatcagaagatggcctagttggccatcattgggaagagaggcccctaggtcttgcaaactttatatgccccagtacaggggaacaccagggccaagaagtgggagtgggtgggtaggggagcagggctgggggagggcataggggactttcgggatagcatttgaaatgtaaataaagaaaatatctaatttaaaaaagagagaaagaaaacacctccataaaatctggctataaggcattttttaaaattagtgattgatgggggaaggcccagcccattgtgggtagggccatcaaaaaaaaaaaaaaaagaaaaaaaaaaagaaaatgtgagttaaaattaaggtttgttggttcttaacattcaatttaataatagttgctaaagttttcttagctcctttagtgtgcttgtattactttttaaatgtggtgtttcaggtcaattttccaacatttttgtacaagtttttttgtgggcacttgaaattcaatagattaatccacatggaatcagaaagtttaaaaatctcttttctcttctcttttcttctcttctcttctctctcttctctctctctcatacataaacacacaattaaagactatgagattcatttcatttttcagatccttaccttggcatgggatcttagagtaaggtttagccactcaaatacctttaatgatccaaagtagtatttttctatagtagctgattttataattttaaatatatagaaaatctactagcatttgaatgacttgggttaaagtttcttggaccttgagcaagttatatagcctaactgtttctggggcagcttttacttcctagaggttttattgtaagatatgtgtctgtctgtcttttatgttaccttgtttcttatacatacaaaattgtttccttgattttagtttgatttttttaaaaaagttatgctttgctcccccaattttctttcttaataattcttggatatattttactttccaattcatagtaaagtaatgcatattttaatttttaatgagattaaaagatgactaacctaacataggattcatatattttgtcagttccctttccacacccatttctgcctcacatagttctacttctggtcagttgtgtttgggatagcagtactagctatatatgatgaagagagtactaaagacatgctactatgccaactaaggcttgatttggagagttggctagattcctttattagatattaatggtctcaatctaaagaaataaaatcaagccagtaacaaaaatcctacagtgttatatatagattgtcctgtcatatcattaaccttatttggccagtaatgtgttaaacatttattatagacgtatataaaaatggaaaaggcatctagttggagatgtactagaaatgattgtgggcagaaataaataggttgagattactaagcaaaccccgttaaggagtggcatatgaataacaatagaatacgagtatactggaaagtgaatcgcagagctgagagatagtttagggtgctgatggctctcaagctattttttttaaacctgagaattttaagataaaataattattctagtaaggtaaaaaagatggtggccacagaactttaggttgcggtatgctaggatataattgtgatgattatgcagcatgcttagaatgcttaaacaaagaagtatgaattctactcagtaggtgatgcggtaaaaggtgctgtcacaattattagaaagacagggaggaggaaataaattgctttatttctaaacctagaattggattgtgtatcagttaactatttgacattgaatgccaatagtgaaatatttcagtattaatgccagaaatcctagagaagtttcttaattccttacagtacagaattcaagtagacatggaaaaatgtcttttttggtgtgtgtgtgtgggtactctagtaataggagaagtgaaacagtactttacgggtattgttgagtgttaaataaattattgaatttatcttatctagtccataaatattaaaatatgggaaaagatgtaataaatttcacaattagaaaaattttaagtcatttaagtcacaattagaaaaattttaagtcatttaagtcacacccagtaaaagtatcttttagttagtacttagactatagattattctctctttttcttttttggtttttcgagacagggtttctctgtacagccctggctgtcttggaattcactttgtagaccaggatggcctcaaactcagaaatccaactgcctctgcctcccgagtgctgggattaaaggtgtgcgccaccacgcccagctcattcttcagcttttaaacatagattattttaaagcctccccccccaaaagaatccactctgttgctttgataacatttcttaagcaatcgaattgaaaatgtttggtggcgtttaaaaataagtgtttaaacttcaaattgatggttctttttcttccatttcttagattatcataggattccttactgtaaacttattttaccttgcattcactgttctgtttcttcctagggtatatctagaattaggtagctacataatgaattctgtccattattcttttaatgtatcaaatgaaacatagacttacttgtatcacagttctttttttttccattttttattaggtatttagctcatttacatttccaatgctataccaaaagtcccccatacccacccacccccactcccctacccacccactctccctttttggccctggcgttcccctgtactggggcatataaaatttgcgtgtccaatgggcctctctttccagtgatggccgactaggccatcttttgtgtatcacagttctaaatgccataaagttaggcatctgattattttctgactcctttctaaacattctcttttatagtggatttctatatttccaactttcagaagcaggatttttctctcatggaattagaatagccttaatgtttggctattttatcactaatagaccttcttacagagagtatttgttctgtcacttttcagtcttccaagtctagtcgccatcaggagatggtgtcctgggctgtttagaagcagtgagatagaattcacagttgtgattatttgatagagctgtgaaagccgagagtatgcatcagtttttatattgtcaaactgtttgagataatcactgcctgctttatacctatgcaaaatggatgtagtagcaaaatcatggctaggttttatttataacttttttgtccattgtcactgactgcttgtgagacttttaaataatcttgactgcataggatttgtctttttcagcagaggcagtgtagtcttttacatatgaactcctatatactggagtgacaaggagaatgatagtttgtgaatttactggaaatgttacttgaggcagtaatgaactgagttaaaatgggaatccttataaggcctaggattaaaacctttgtaaatgtgttatattcttttactttagcttctataaaacaagtagataactagttttgactttatatataattacctgttatcttttgtttagtaaacaaaaataccaaaggctgtcaatactggaaaactaataatctttagtaatattgccttaattttaacagctctacattaaccataaccctccaccactgtccaagagtaaggagagagaaatggacaagaaagatttggacaagtcaagggaaagatccagagaaagagagaaaaaagatgaaaaggacaggaaagaacggaaaagggtttgtaatttttaaaaattagcttggaaagctttattttgtgtatagtaatatgtttttctgcttttagaaaatactgctttattccacagcagtctgtttcaagttttagctggtattttcttcttaaagtgtattcgtatcttctacagtaaataaagaacttcagtgtagtaatcatgccattttaccaagtacgtggtactgcaaatatcctccagtgctagttagtgatgtctttcttatatgaaagtaatacttcaaaacaaaataaaaactataacccttgatcaatgtagttcacaattcttggttctaggatcattcaaacaatgaccgcgaagtgccaccggacataacaaagaggcggaaagaggagaatggaacaagtaggtagacttactaataccttggaaacagtcatcagagtgaactggaaaaacctttcattattctcttttgtaattttagtgggggtttcaaaacacaaaagtgagagtccatgtgagtctcaatatccaaatgagaaagacaaagagaaaaataagtcaaaatcttcaggcaaagaaaaaagcagtagtgattcgtttaagtctgagaagatggataaaatctcatctggtggcaaaaaggtaaattaggaatgcaaaggaactgtatacttttcagaaaagatgtattttattattcttggaggctgtcatagatgagtactttatttacatcatttccacctcaaactccggattctgttttcctgtgtcttcccccaacttcctctaaacttcatgacctcgttatgattattactattacacctatctatgtgtctggaagtatcacctgctgagtccatttagtgctgctcatgtgtatatgtgttaggactgacaatttgggattggagaaccattcagagggcttgtccttagagaaggctggctctcttcctttcaaagcagccattaattgcatgtggctcctcatcttggggtagggccttgtgaggaaaatacttacccctataaatttagtgcttcattgtgtatgtgtgtatattcttgccagataataatttgttaattttggaatggcaacaggaggattgggagggaacaggttccctggttagaaaatttgagctagatgtgctctaaattactgtgaagttagaattagtatacttttgaaagtccttttctctccctttcactcatagtgcttcagttcctttttctttccttttcactcatagcacttcagttcctttttctctccttttcactcatagcacttcagttccttttttttgggggggggggttgtggggaggttgtttctcagtgtagccttggctgtcctggaactctctctgtagaccaggctggtcttgaactcagagatcctcctagctctgccttcccaagtgctgggattaaaggtgtgcactaccaccaccaccaccaccaccaccaccaccaccaccaccaccaccaccaccaccaccactaccaccactaccaccatccggctcaccactttagttctttatgttaacctctatccacagttctttgtttttagtttcttttattcttgaagtatatctatatatgtataaagtacattctgttatatacttaggattgatattcaaacctcaagcatgctccattaaaatagttgataagccactaagttgtaaactgtttataaagcattattataaatgttacaaatttgtagtgtgttcataagttttaaaaagcagttttagaaaagtaaatggtagataatttaattttgtatgcttccaaagataggctgttcctttttcagttgagataagtttacacaggataacagaatcatgcaattaaatcaatggtgcttaacttgtgggttgcagaggcccttttgcaaacccttatctccaaaaatatgtaatttttaaagatttacttattttatgtatatgagtacactgtagttgtcttcagacacaccagaagaaggcatcagatcagatggctgcaagccacaatgtggttactgggaattgacctcaggacctccgtaagagcaatcagtgctcttaactattgagccatctctccagcccctccaaaaatatttatattactacgtataatagtagcaaagttataattataaaataacaaaaatcatcttatagttggggtcaccacaacatgaagaactatattaaagggtcacaacattaggaaggttgacaaccactgaattaagtggtatgcatatttgcaatattgtacatttggtgtttgcttccaaaacattttaattgtcccaaaggggaagtgtagactcatgatacatttattccttactttgccttccccagtccttggcaaccactaatctttctgtctctgtggatttacctatttttagtgtttcatataagtagaattataaaataatacagtcttttgtttctgccttcttagaatgattttgagactgttcttccatattatagtatctaccattacttaatatcttatgaccaaagaatactccattatatgaagctatcacatttgtttaatcatttgttagttggtggattttttgttatgttttgagacagcgcctcccttagtagcccaagctggcttggagcttcctcagtacttcagcctaccctcaaacttgcagtctgtcttcctgccccagcgtctctagtgctaagattacaggggtaagccaccacaaccagccaattgttggatttttagattgtttccgatttttggttattatgaataatattatgactgtactgatatgaagtaattcctttgactaccttcaattttcttggatgtacctaggaatagaatttttaggttattagataattttgtttagcctttttgaattgctgctaaacttttcacagtggctatatagtttgcatttccactagcaatacatcagggtgtgcaatttctatacatcgttgtcaacactggctcctttgcatgttagtttattcatagctatcctactggatatacgtggtaactcattgtggttttaatttgtatttcttcagtgactaatggtaccagatgtctgtcgttccatgtctttatatatcttctttggagaaatctcttcacatcgttttcaaaatgagtcttttatgacattcacttttaagatttctttagatattttggatatgtgactgctatacattttttgcaaatatcatttcctgtttcataagctgtcacacttccctatggtttatgtgtgttttcacttttggaggagtgagttgaatattcttttcttttttttttttttgttacatgtggttttgaagtcatattaagcaagtttttgaagaaaaattatagctggtggttgataaaagggaatttcaagctgctatttaaaaatgtatttgatttttcctttcccaactaatttcatcattcctcataggaatccaggcatgataaagaaaagatagaaaagaaagaaaaacgggatagttcaggaggaaaggaagagaagaaacaatatccttttcatttttatatttcactcgctgtagtagaagaatttggtactattcatgtttagaatgaaacctttcttctgtgtgatctaaatatgcaggggcttattagctttaaagtgatatctgtagttaactgtcagtttataatctgaaaacaggaggtttgatcttcatgacttttaaaaaaaatgattctgtagtgatggagatgttttatgacaaaagttgtataggctcccttttgtattgttaccaagaggaaaaagagaaacagagaatcccttggttgggggaggatggtgagaagtgcagaatgatgggacacataagcagagctctcagttcttgagcttagtaggttgatcagagccaattaggcttagaaacttaaggggtcgtagcaaaagagaggacactattcttcctgccccaagcttgttttcccttaatttgttatctactcataagtcctctgacaagcacagataatgatcaatttcaaccaaggtgagtatattctcccctccttttcatttagagatacacctaaaggagatctggaaatggtaaagggacgcgatccattttgcaggatatagctactccaatttttacctgactataacacagtgacgttttgtgtatagatataaaatttgcagttattttaaagctcttttcactctaagcttgctgattagttaatcttaaaccatcaagatgtatttaaggaaacctggctttctcattgccacctagtcccatcgtttctggaaaattaattatgttttaaaagcacctgtagcccaagaagtggtggtggtatttatactttacaggaaaagaaaggaaaattctcaaaggttgaagcaggtcacagaggcattagaaaacagagttgacactaagggcagaatttcagtggtttttgttctttgtgcctttctgccactgctcacatttatttataaagtcagaaattacgttctgtacttttagctagattttaaataggcaaacttgttttcaaggtaatgtatttgttttctgtgatgcataaaatgctttaaatatcttatataaatcatatgaccaccatagtggacagactatgcatattct

SEQ ID NO: 710 - DNA, 98712 bp, mus musculus
tgaccccgcgctcgggagctacacatccgggccactgttactagcgaggggaagatggcggccgcggctgtggtggttcccgcagagtggataaagaactgggagaaatcagggagaggcgaattgtgagtgtttctgaccgagggaaggcgccgggccgccctgaggtcggggcgctgggcgcagtcggaagtggggtacaggggccggggggcagcggcgccccctcccccacccgcacccgggcggcggatgaggatggttggttggtccggagtttccacttggctgaggagcggagccgggagccgccactatcgccgccgccgccgctgagcgtcttgccttccctccgacctccccgaaagccccgtggtccccgggagccccgcttcctttaggtctctccgcagaacttccgtctcgtcccctcaggtccccctgggctcctgccctgtcgcttttttgtctgtctggctcatcgtcttaactcagctcgctgggctcggctccttttctctccgtggcttcgcagccggagctgtgtgggtccgccacttgccatgtctctcactgtcccgttttatcttcttatttttatttgtcccccccccccccgggatctaagacgactcccgcactttggttcccggcctctcctgtgcccgaagtcttaggagggcgaactgtcccgaactctctgctcctcgccgctggtggcagaggagcccggggcgtcggggacagccaggcatggcacctctgctttctcagggagcggcagcttgcgctgccctggccctgcggtactcgggaaagtgtggcagggattgccgcttctttttgccaagtccctgccggcgtgtcacctcgccgtggtttcgggatgggattcaacttttcctggtagaaggtttagggaactccattttggcctgggactgcagcgagtgctcgccctcctcgaggcttttctagtactttaggatgatctctgtgtcctttaagtcataaacttactttgtaccgtcaccggtaatttcctacagtagcggctttcgcgcctcccagtagccaccccacccccgactccccgtttaagttgacagaattaatcactgattaaaaaaaaaaaagttgtaatttcttcttctgagtcgctctggaagcttagcagtcaatcctatgtgagattaactctctttagctgcttgagttgtctccctccacactcccacactcatccagtatcaggttcccagttgctcacgggaagataggaatctttaaaactttgttacttcaaagaaacccggtacaccaagctcttgtgacttgacttactcccacatccctttgctgttctgtgaaacgttaacagcgtgagtcctagaattggattgtctgagtaagtggctagcttagcccacttaaccagctgagtgaccttggataaattcgtaaccatttggggccgtttccccttgagtaaattgggaataagaagcgttctactcgaaggattgttgagaagagttaatgtctataaagcacttgggttatagtaagtgcgcaagtgatagctattaaaagtaatattattccagcttttagaaatttaaagttctcgggacagctctttgcttggcgattagttggcctctgacatcctgcatatttacttttgtatgctaatgagttgagaggcccttggagaacggggatgtcatctcatttttttttttttttttggtaggacatgtcctccagtatatacttagagttccttcgagttttgttaactcagaggtctgtctcacatctaaaagaagcattcatgtttactttttatgtgctgtttaaccagctacctgtttgtcgagtgctgagaaggcaggatgggaagcagctcgagggaacagggccagattggagggagagcctccgcagacagttcagtccgtccttatttagcatctaaagcggattcatttgtgaactgtcgtgtttgtgggtttctcagcttccttcttctggatggatttcactgtgtgtatggagggtagcatgtgctccatcagtgagctacatccacaggcctagctgcttttgtttttgttttgttttgtttttttttaacagtttaatgtttttacttccactttagaataggaggaggagccctgcctaacttctgactggcaataggtggagaaaaactaagtggtgtatgaagccaagaatataaagtgggattttgagtttatatgtgtttacatgatccatgctacctagtgttaaaagagctacttaaaaactgtacttaggattttcatgtatttattgtatagcttgtggactgtgggtttgaagtacagtagattcaaattagtgtgacagtttaatgattatataaatataatttctgtaagagaacttatcttaaaaaaaaaaagccaggaggcagaggcagggggatttctgagttcgaggccagcctggtctacaaagtgagttccaggacagccagggctatacagagaaaccctgtcttgaaaaaccaaaaaaaaaaaaaaaaaaaaaaaaaaagagagagagagagagagagagagagaacgtatcttttttttgagacaattaccttgtagctcatactgagagagagagagagagagagagagagagagagaacgtatcttttttttgagacaattaccttgtagctcatactgaccttgaatttattatcatcttacgcatgtcccactacattagctgagaatttaaagttggatggcacagcttgatgtggtgtctcacacttgtaatcctagcacttgggaggataaggaaggagtcccgggagtttgaggtcagcagaggctacacagttaactttgttggaaacaaaacaataaaaggcaaaagaaacaaggcttgagagctgtctggggtaaggagttaggaacctttacttacttcagttcttaggacccacatctgatggcttatggtctcctgtaactctagttccaagggataaaacctctggtctcacaggcacctgtacacacacacacacacacacacacacacacacacacacacaccaaacacatacatacacacagctatacaactaaaacatatctaaataaccaaaaaactgaagctgtttaatctaacgaaatattctaaggtttgccttactggtgaatgaatctagaggctttgtacatattaagcaactactactacgaaactatatcttcagccctttacaaaattattatattagcatacagagtaatacattttattatggcattttcatacatgtgtcatagttttagtttgctggtttcctccctactgctttcctctgcccacttcttgctggcccttttttcctaactagacctgccattttcttttcgtcttttctctttttttgtcttctcttcttcttgtcttgtctcttctttgactctgtagccatggctggcctgggactcactttgtagagcagactggaaaatgctgggattaaaggcatacatacatacatacaccaccatggctgaccttcattacctactctttgttaattaattaatttatttggtttttcgagacaggaattttctgtgtagccctggctgccctggaactcactctagaccaggttggcctcaaactcagaaatccgcctgcctctgcctcccaagtgctgggattaaaggcgtgtgccaccattgccacctatttttaatctactcttttctttcacttgaattctctcctcctctctcattgtacctttctattttcatgacttacacatacgtatatgtacacttagaaatgtggtttttggcatgcttaaaataataatttcctgttgtatctgtaaatatattgattttattttcctttatgcctggtccattttgctgtcaccttcttttcttccttgtcttcttcttcctcctcctcctcttccttcccctccttcccctcttcttttattcttttgggttttcaagtcagggttgtctctgtgtagctctagctgtcctggtctgcctcccaagtgctgggattaaaggtatgtccccaccacaggcaggcttccttttttaaagacggtgtctcttgtatcctaagctggctttgaactgttgtataactgagaatgaccttaaatttgtgatcttccctctatttcccaagtgctggaaagttctaggaaggcgaaccacacccggtttattcactcccggggattgaacccagggcataagatatgctaaggcaagcactgtaccaactttttattcagtccgggggattgaacccagggcataagatatgctaaggcaagcactgttccaacagaattacatcctcagacctttaattttctgttttgagatagggtcttgttcagttgtctaggccagcattgaacatgaaaccatcccatccccattccattctctcaagttgctgggattgcaggactgcactgtcaggtcctgtcataatgaactattttaaacaatcactatttagatattgtaaacacatcatcatcctctactctgtttttattcatttgtcttcttttccttatgtacaaactttgtttaatagagcttaattttagaggttttaaaaatcatgttacatacattagcattttcatcttgttaaaacaaataatattgttatttggaaaaaatgtcttgaatatgaactagcaactggaaatgctaaaatgaggggtagagtgaatacatttggtttttcgagtatgccatatgtaaagttatttcttaggattttttccttttcatttaataattttaaatgtttttggtttttagagataaggtcttatgtagcccacccaggctgatctggaacttgctctgtactccagggtgaccttgaattcattatcttcctgctttagcctcctcactattgggatctcagtggctagctgattatttctttataaaacagcaacaagtgctttccagccctgaatttttttaagtatgtgttgtgttccatgagattcccaagtttgtattgtttgtagcatcgtagcagtatatagctattgtgagagttacagggtctgtagtgatagagaagcaacatgatggtgagaataagctcagtgataaagcagtttgcatagtgtagctggtctttgctattttctggcttcttctttttcttaccctttaaccccatggtttcaccccctaacactagttagtcgagaatcaaggagagatgggaagggaaagagaaggaggaagaggaggtggaagaggagatggaagaggaggtggaagaggaggaggaggaggagaaagagatccctgaatccagtttctttccgttgtttctttgaccaaaccccatcgaacttctgggtgggggtgtcccttgaatttatgtaccctttgtaaagttcccagaattccaaatgtcacacaatggcagaaattatctgcagctgccaaagctgtgtttcttctagagcacaaggcaaatattggtcacctgctgcagacagtctgaagcagccccacatcccttcatgtggggttaagccaaaagcacattcctataaaaagaaaccaaaagtccagaattctcaaaaatgtcactatagcatgctctgagttccccgtcttcagcacttaaaaaaaagaaagaaaagacaagaaacagaaaaagaaaaaatgaaagacaaaaaccacaaactgtatagggcattttataattttcaagcaagtaattttttttttagtgaaatattccttaatttttttattcctggtactactaccacaattttcagggcagtatatctgatgtaatgaaaagacagtgctaaggcagagacattaggaataaacatctaattaacattctactgcattaatcaatattaatcaacagtttctttccccccctaaactgtgcctctggcagtctaagcaagaaaggtttcctatttaagctgctactaggaacttttggctatagattatcattgcttctgtctcagacttttacttcctgtctcaaagtaacctgcagttcccctgacaactcctcatcagttaataattgtaggccttttcctagtgtctttaaaaagaacaaaacaaaagaaaaataaccccccaaaaccttcttttactgtgtccaccacaacaaggactttaaaaatatgtttcttttattttttgaaattataatattacatcattatcctttccctttttcccttcaaacccttccatatatcctcttgccttcttttaaatttatgactaacagagcttttaatgacaactatgtactgtgctccatgaaaaccagttgtctattatcagatcatcttaactttgaggaataagctttgttaggtaatatttcacctatcaaaacagtccatccctcatatacctctacactattggtttctagagtatatgtataaatgtcacttatgtttttaacatttaaatgtgtgtgtgtacttatgaatgctaggacgaaggacagaagacagttcttgataattgttatcttttttttttccttccaccatgtgagaccaggggattgaatttaggtcatcaggcccaattggcagcaagcatctttacccactaatacacttctctggcccaccaaatatatttttagatgataaattatgtaattgatagggctggagaaatggctcagggtaagaacatgtactgcttttccttaggaacagagttttattcccattgtctatgttggggtgactcctaaccagttacaaaaagtaattcttaactgcccaggaatccatcccctctggcatccccagacacctatacatgacatgtacacactcaaagacacacaaacacataattaaagctaatcaaagtcaatctttaggtgctggagagctagcttagcagttaagaacacgtgctgctcttagacctgggtttaactgccccaaactaggtctaggagatatgtctcccaccctcttttaattttgtgttcacatggtgcatatacatacactttaaacacacatacatataccaaaaaattgaacaaatctttaaaaggttgtaaaacttgtatcatgagttttttccacaagaggtataaaaacagtagagggctcctgaaggttttaattgttttattgatttattcagtaatttgtaagtattgttcaagctggcctagaatgtctggtaattctcctacttcagtgtgcttggtctccagcccctgaaccttgtttttttgttttttttgttttttttttttgagacaggatgtccaagctggtcttgaactggctgtgtagctgaggatgatcttgaatttctaatctcacgccttcacttctcaaggacaaggcttccatacagactgatgatatcacacctagtttatgtgccactggggattaaacataaggcacagaatacattggcaagcactctacccactgaactacatctctggtcctgaagccttgcctaatttgatttcatattttaagttgtattcatgaattaagtgcaaatcttggtctgtttttctgttaaaagaaattcattcttcagaacatgttgatgcaatgttaggaagttattaagttactactttgtttgctaagttattttataatgccgaaatagagactttgccattaatgaaactgctttttcctacttaacaagggtaaagcttttgttattttgtttttttgtgacctttcttgttttcttcataagttcatgtttctacaagataaaatggttttgtcctcgtatttatttatttatttacttattctttttggttttctgagacaaggtttctctatgtatccctggctgtcctggaactcactgtagaccaggctggcctcgaactcagagatctgcctgtcgctgcctcccgagtgctgggattaaaggtgtgcgccaccacgcccggctccctcgtatttatttttaagggtagtatttttgttataacattgagaaaagagacaagtaagtactttgcttaaactatttaacctttcttgctattttgtttttaaagacaagtagaagcacaggtgagtatcagtcttttatatgtgaaacaagcttgcagctgtgagcacaactacttaggtcttgtttgtgtttcctttttgctgaaaatagggataagtaagatggaaagctaaatattcatgttaaaaagactcataacatccttctgaaatcattaaaagaacataactcattcattcacattttcacagatctttgatactggatttctgtgttctcagggagttgaggcagcatttccataatagcacaaaactatttgacaagaggaaaaactggtcaacttaaatattgagggaataaattaatactgatgtttgtgctgagacagaatatttaaatatttttaaggccatattacaatgggcaagtatttgaggtccttttgtctgttatctttctgtaatgtaggttagtttatcagaagtgtttgacagattggatagtgaccaattacttttaaggatacttgtgggcctactatttgtggacatagttaaactgatacttaaaaacaaaacaaaacaaaacaactttttgagacagggtactcctatatccaggtctgccttaatatttccatcttcctgcctcaggttgtaagtgtttatttttgttttaagtacaaatatctattatgcaagtgacttgtctgaatatgataacccattaatgattttgtacacaattttagcaaatctttgagatgatgacaatatttattatctgcaggctaataaatgtgcttatggcttagtgactcacaatataaactgacatttcagttatttcttttttttcttttttttaaagatttatttattattatatgtaagtacactgtagttgtcttcagacacaccagaagagggagtcagatctcattacagatggttgtgagccaccatgtggttgctgggatttgaactcaggacctttggaagagcagtctggtgctcttacctgctgagccatctcaccagccccccagttatttcttagttatgtaatgatgactaccataggtaggagttcagaacactgacacagcctctcttcagtcattggaaggcttattgaaaaagacatgtgttaccattgctgaaagtagtggaagatgaagctggcagaaatgcaagggaacaaaggcatttgtaataatgaagaataaaaagaaaattctacactctctccctttgagacaggattttattctgtattccatgttggtttagaacttgtggtaaccctgccttagtatttcaagagtttgggatttcaattgcatgaatttcgacagttccttccaattccattctttttctccctccctgctacccatccttcaaggtatcatacatcccaggtacaaagcttgatatagttcaggttgatcttgatttctgatctttctgctactgtatcccaagctttggaattacagtgtatgccaccatatcaggtttgtgtgctcctaggaatcaaatccaaggcttatgtatgctcggtgatcactgagccatatcctgaacccacagtgagtatttagtacatgtatacaaagctaagtatacccaatatgtggaaggtggaggcagcaggatcaggagttcagtgccagtttgaactgcatagtgagtttgaggtcatctttggttatgtgaactttgcttcaaaaaccaaaacctcaaacccctccaacaataatacatgtatacagtgtgtaatcactagaccagggtaattgccatatctattacctcacattagccatgcgcaacctttctaatgctgtgaccctttaatgcagttcctcttgttgtggtgacccctagccataacattgtttcattactatttcataactaattttcctgttgttatgaattataatataagtatctgatatgcaggatatctaatatactacccccaaaggggtttcagcccacaggttaagaattgctgcatcaaatatttatcttttgtgctgagaatacttgaaaatctctctactggcaacttttttgagacaggtctttttctactgaaccatcttgctcgccctgtctagtagaatacattgtttaataggtggtgggtgtttaatagtttataatggagattttcaatttttatatagatttagtaactgtttttacattggccttttattcttaatttggaacataattgtgtaacttggttaggtgtaacttgagatagtttgtggtttgcctgggctacagagtgagttcaaggctagattgaacttgtctagactgtccaaaggaaaacaatagaagagggataagggtctatcttattgatagagtgcttgcctagcttgtgcaaggctgtgggttcaactgcaggagcaaaacagcaaagaaaataataatttataaatgaattatggaccagaagatgtttattattttttttgccaacaaatggagtatcaaaatatgataccgaggcaaggtgtagggatgtgggtaacctatagcatagatactctctgttagtgatgatcttgtggcatcatattagcataagatagaatagagaaacaaaatctataagcttttttcccccagtgctgaggattgaactctaggctttgcatgttcaacccactcaaaagttggacaggagtgaaaggtgctgacaggagttggaggtgagaaagggtagagtggaattgatgtaaattcagtactcatgaaattgtcaccacgcccagcttttttttttaattgttattttggttttatgatttttttgttttttgtttgtttgctttttgtttttgttttttttttcgagacagggtttctctgtatagccctggctgtcctcccgagtgctgggattaaaggcgtgcaccaccacgcccagcttccacagttgttttacaacatatagtggccatttagaaaaagtctttcactgaattatgcaactcttccaaatattgaaaaacttcattgtatggtatcagatacactttccttagtgtctccaccaaagatgatcagggaaacctctatgacagtagtcatccccatagtggcagaaacgaatttttcaaaatgattttatcaaatactgttttccttgaagtgacaaacttggttcattgtagtcataacttgttagttgtttctcaagtggaaaaatggtgttctataaaagcaagatagttaagtctacagttaaaaaacactgttataggcttgttggtgactacctataatcccagtactttgggtggttgaggtaagagaattacattgaattagaggctagtcaaagctacagagtatatcccaaccataaataagaagaccctgtttaaaaaatacagatttacaggtagttttcatgtaggcaactgttaataattaaatattgggtagggattgtttattcaaatttctcattttatggggcattaaaatgacattttaaaaaaatgacagcactggatatggtgttgcatacttggaatctcagtgcttgtggcaccgaggtaggaggatcaagtgtgccaggctagcctgggctgcacagaaagattctgtgtctgccaaaccaaaaagccaggccagtactctggaggcaaaatctctgggatgtatagtaagactgtctcaaaaagccaaaccgaaccaaaccaaaccaaatgacaacaaaacccccaaccaactaacccccccctcaaccccaaatatttcagagctcagacattttttttttttttggttctggagattgaacccagagccttatgcatgctaagaagtggattaccactaggctataccccagccctgtgctctggatttacatatattaataattaatacattttttggtgctagggattttattcataaacaacattttttagactctgttgcagatgtgctgaaagatgataacctagatattaaggttgattttttttttttgtctcacatggctactaaggatctgagtgagaaaatccagtagcagttataaatacatttggtgtacaggtaaaattggaggtagatagacttagaagtgggtaagatcacccagtgtgtgtgggaataaagtggtgctgctaagagcaaaagcaatcacatatgaggacaaatgcacttgcaagcataagagatgattccactgaaaaggaaagggagggagagaagaggatttggacatccctaagctgaaactggaaatgctccaatgtctgaaacttcttgagtactgagataccactagtagaaacttccattactgacaggctgaaagaacacagcttaggaacatggtttatttagtgtgtccaacgaaaacaaggtcctgttagtccctttaagctacaataacactttttctgagcatgtccaggttctcacttgcaagtctgctttctaagtaatagaatgtattgtcactgtacagtaaactgttgagtgcataaagttaaaaatatataagattattggtagggggttgtagaaatggctcagcagttgatagcacttaactgctctttcagaggatctgagttcaggtcctgggacctatgttgggcagctcacagctgcctgcctgtaaatccagctcgagggaatctgaaaccttgtgccctccacagacacctgaacatggtatacactaatacaaatatacacatatacatgaaaacaaatcttattatgtgtaaggtatatgtgaaacaaaatacattttgtgttatgttttagtcctcagacattttaggtacatacaaatattttgaacagaaatacgaaaaaattaaattctggagtagttttcattgtaagcattgtagataagggacattcctccctacagtgtattaatttgcatcctgtgggctgccccttttggtattttgattgttttgtttttattttgggttgcacaaacattttctagtttgcagtttagtagtcaccaattctttaccaatcttgtttcaactatagttccctttaattattttattgttttatattactttgtagcaggtagcatgttatctatagtgttatattgaagatgagaatgtagtatttctttgacattctgattttattttctctgggtggtgtattatttcatctgtagctgggacataatgcttttagtctgctaccatggtgtgaaaagccactgacagatggtggatttttttttattaggtatcttaaaatgaagatgttctaattctgtcattttattggcatatattattgtacaaaataatgggtctcattatgatcttttcatttctgtgtacaatttactgtggtcatatccaatcctattcattccctcttctctctgcctgcccatcgcggtgctccgtttatgttttagccattgtcaaaaaaagaaaaaaagaaaaaaaagagaaatctagatttttcattcaccattccctctgttggctgaaatagttcaaaatggagacatttgattttatagagggtatcaaattcctatggtagcagaggctgctgattctcctttccttacctcttaagtcctaggattacagtcattcaccactatgtcaagtagtgatgaatttcttacttacttatttcttacttactattgagttactcagtgtttataatgagaggcagaaacattttatgtaagagatgaatcgccaatatttagaaagatgggtcgattgatctcgttctgatgtgttagaaggttttgtgtcatgatcataggtatttaaatacatctggggcatttctatatactttttaggagataaaacttgttccttaggaatcaactgtttttatgattgaaaattgatagtgtttttgttttaaattctagtttacatttatgccggattctcagtgaaaataaaagccatgacagttcgacctacagaggtatgatttttttttttaaaaagtatcatagctatcatttttggtttgtttaaagttataaatcttgatttgattttatataagagtgcatgtaattaagaccttatagtcagtagtaaaactgtagttacagtaagacatcttggatatacacattttgtctgtttgacttttataatagttgtatatttgtttaaatttctgtagttagctgtaccaatcataaatgagagagaaagctatcctggaaaaaaacctattttggtcatagttgcactagaaaatttccaccaaccaagttcagtgtttttgctcaagctggttgtgttcaggtggtatctggggagcttgttaaaggcagttgtcatggaaaatataagcaaaggagtgtttgctgaattcacagataggatatactaagtaaaaatgctccataattaagaaggatgtagattttacttttataggattttaccatttagctttcattaatttaaaactaggaacatggatttggcaaaagacaggccagaaagcaattgtgtctttatttataatgtttttacttatagctttcattggagataatattgtacgttttggtatgaaatcagtatttttataattaatagtttattttaacaaaataaatatataacaattattgtagagacatggcattgtgaatagatgattaagaacagtgtttttccagccaggcgtggtgccacacgcctttaatcccggcacttgggaggcagagacaggcggatttctgagttcgaggccagcctggtctacagagtgagttccaggacagccagagaaaccctgtcttgaaaaaccaaaaaaaaaaaaaaaaaaaaaaaaaaaaaaaaaagaaaaagaaaaagaaaaagaaaaaaaagtgtttttcctatagaaaaacttattttggttttaccaaaagttgagtattaccttaatttaagagaatatatttattagatggaacatttggagggttaaggggaaagtatttttaacaaatgaaataccaagttttggtttctgttattttaggaagctctgttttaagacttcacatctcagctgggtttggtggcacattcctgtaatcctagaactttggatgctgagatgaggattgtgatttcaaagccagcctgggctatgaagcgagttctaggccaatctgagctgtatagtagaaccctgtctcaaaaacaaccaatcaaatagcaaacagaaaatcaaaatgtcttttaataggtctatcatgacacccacaaatactagatttttaccttgtttataaagtaatataattgggctgtataaatgtatagctcagcagtagagcactggccaggcaaattggaagccctgttttttgtttctagtattctagtaaaatctgtatggtcactcataatgactttcaagtgtgtgtgtgtgtgtgtgtgtgtgtgtgtgtgtgtgtgtcacaaacacatatttgttttgttttgcctaagtatagttgactgctggaaatttaggaaagtataaaagtgtatatgtgtataaaattcttctctcatattgttaagttcctctgcctccgttcctcccaattcaccctcctaccttccctctccccgagatctactcctcctctgtctcctttcaaggaaaaatcaaaacaaaacaaaactatcagattcccagggatatctactgaacatgaacatggcctaacaagttacagtaggactgtgtataatgtataaaccttcatatcatagttggaagtggcagtccagtaggaggaaaaggatcctaagcacaggcaaaagagtcagagacatattctactcccactgttgggagtcccataagaataccaagatacataaccataatgtatatgcagcggacctagctcatcagacccatatagggtctgtgttgttgcttcagtctttctgtgagccccttatgagccctgcttaggtgattctgtgggttgtgttcttgtatcctcattccctctggttcctacaatccttcttctgcaggatttcctgagctctgcctaatatttgtctgggggtctttgtttctgttcccatgagttgctggatgacagttgggctaggcatcaatctatgagtatagcaaaataccattaggaatcatttcattgatttttctttttctgtttcttccaagttgtgccagtatccctgtctagttgctatccttaaaactgcttttcctaaaatgttagcactaatgtgaagtatttactaaaattttttcatgtatgagggttgaatgtttccctgcacattgtgaatgtaagtgtaaagttttccgactctagctggcttggtagttttaaagcatcattttcttagggtttctgttgctgtaacaaaactccatgactaaaagtaatttggggaggaaaagatttatttcattttatagcttgcagtctatcattgatggaagtcagaacaggaactccagacaggaagatggaagcagaagctgatgttgaagtcgtgtaggagtgctgcttagctaggcctacccctccctccctgcatacctgggatcaccagctcaagggtcacagtgcccacagcgaactgggcccttctatagcagccatcaaaaatcagtcatgaaactgtaccacaggcttgcccacaggccagtctgttaggggactttttctcagttgaggtttggtcttcacaagtgattctagttcttgtcaaattagcataaaactagctagcacaattgaccccttgtcaggttgacacacaaatgttagaccctaacatttctttttgttcatcctcctattaatgttaatattacaatataaaatattccaactttaaaagtctcagtctttaaagattcaaacactttaaaagttcagtctctttaaaacagctaaagtctcagagtttaagcatctgtaaaatattcaaattctccaaaatatccagtctccaaaatatcaagtccttctaaaaattccagtcactttaaaaattcagtctctcaactatgtgttcctggtaaaacaaaaaagttccatagtttttgactccaagaggaaataaccagggcacagtcaaagcaagcaaaagcaaagttcagcagtggacagtgttcagtggttgatgtctgggacctactctttatcatctgggcatcaaagggctagaattagcactccttgctctgccagccacagctagtttcctaggctctggatggctccactccatagcttcgctgtccttggcattcatctggcttctccaaaatgctggggtctcctgctataactaggttgcatcttcaccactgtcctttcttgagttctcttcagggactctgattctgccacaaggcatgaagccttcttgtttccatgactgcttcattcctggggcttctgtttcagttgaggctatacattcacccatggcctgtcttggtctcgaataatgtcaagcctcagctgctctccatgtcctcttcagtcctgggatttacactgctgcggaggccagacttttaccaatggcttctcctggcctctgagtgttgctcttcataattctctaatgcagcgcttctcaagctgtgggtcaccacctcttggtggctcaaacaaccctttcacaggggtcacatatcaggtatcctacatatcagatattttacattatgattcataatagtagcaaaactacagttatgaagtagcaataaaaataatgttctgattgggtcatcacaacatgaagaactgttttaaggggacttagtcttagcattaggaaggttgagaaccactactctaatgcctataaaatcattagtaaactcttcaaaattacttagttctgccagcatgaggtataatcttgacccttcctggaccacagcttttgtttgctaactccaaggaaatatttcccagattttgcctcactgatgctagtctcttcctcctcttcttcctcctcttcttttgaggctgcaacattttttccattttttgttaatttttaaaaattatttgtttcacttttattttatgtgcattggtgtttgaatatgtgtgaaggtgtcagatcttctggaactggaagtatagacagttgtgaactgtcgtgtgagtgctgggattgaatccggggcctttttgccctttctcacttctccagctgctgtgacagttttcattgagagcaatcaggcttttttatacctttatcagaaagagaatataatggcagttgccaggatcaatacagttgtagttgccaggatataatgtgtgcaagctattcagagtacacaagattgtctaagaccaagtcaagcttacatacttccttgacttctgagggaatatacagagaaccataaagtggcctgaacccttcactgtctgagggagtgtattagtctttcaggaactgcacaacatattgtgctccatgagccatggactctaacctgaaaacctgtgaggcatatgcctcagggcagctaggccagtcaaagtctatggtttccctccctgcaagtcagcccaattagagtggataatagtggatctttgctttattaaaggagttgcaaaaaagaaaaatgtccatggctcccacatcccacttgaaaccactcaagccagactgtattgtgtgcaggaagaaagggagtctcatgtctcacatattcttagcttcaagagtatttgatagtatgaaaatagtaggcatcatagaattcttagatgtgggtacttatttttctgttgaaagaggaaatatataagaagataggtgtattagtcagggttctctagagtcacagaacttatggataatttctaaatagtaaaggaatttattgatgacttacagtcggcagcccaattcccaacaatggttcagtcgcagctgtgaatggaagtccaaggatctagcagttactcagtctcacgcagcaagcaggcgaaggagcaagagcaagagctagactcccttcttccaatgtccttatattgtctccagcagaaggtggagcccagattaaaggtgtgttccaccacacctttaatcccagatgaaaggcgtagcccagattaagggtgtgttccttaaactcggagattcaatcttctggaatccatagccactatggctcaagatcttcaaaccaagatccagataaggatctccaagcctccagataagggtcactggtgagccttccaattccggattgtagttcattccaaatattgtcaagttgacaaccaggaatagccactacaatccaccccttgtcaacttgacacaaataatatctcatgttcacatgaaacaataacaaggttgtaaatatgcctaacatgatataactatccctcgtacaatcgctaacgcattagtaaatttacaatgggcattcatattactttataatcctcgtttctgcaactggttacgtggccttaattggtatttataactaccttcctctactacccattctgtatttccttctccttcagccagcacctcagcaggtcttggctcttttcctggaggattgacccataccttcattcctgatgggtctgcgtcctttgtcatcctgcttggattaggctgttgtagtttcccattgactttaatcacaggacatggtagtactaagagacgccctaagggatctcctacactccagacataatcttgcttaccaccattgtgaagaggtaatccaatttccccatggtaatctggatctatcacccctcctaacactgttattccttttttagcctgttggtttaagggcattagaagcccaaaatgaccagggggaagtctgagcttccagttcaatggaatgtttgttgtagctcctggtaggagcactcccttctctggagccaaaacttctaggccagcagaacctagagttatggggacaggaagcaaaaattttcctagagggtcactaggagtgatagtaagtggaactattccgttttccaccccttgattcctggacccatgaatcctggctatgggtgaaactgtaccatatatcgagcgctgattcaaagcatatactgccttctgaagaactctgccccagccttccaagctgttaccacctaattggcgctgtaactgcatcttcaaaaggccattccatctttctatcagcccagctgcttcaggatggtggggaacgtggtaagaccagtgaattccatgatcgtgggcccactgtcgtacttctctggctgtgaaatgagttccttggtcagaagcaatactgtgtggaataccatgacgatagataaggcattctgtcaatccatgaatggtggttttagcagaggcattacgtgcaggaaaagcaaatccataaccagaataagtatctactccagtaagaacaaaacgctgtcctttccatgaaggaagtggtccaatgtagtcaacctgccaccaggttgctggctggtcacctcgaggaatggtgccatatctgggacttagtgttggtttctgctgttggcagatctggcaatcagcagcagctgtagccaggtcagctttggtgagtggaagcccgtgttgctgagcccaagcataacctccatctcgaccaccatggccactttgttcatgtgcccattgagcaatgacagggatggctggggagagaggctgactgtccacagaacgggtcatcttatccacttgattattgaactcctcctcggctgaagtcaccttttggtgagcatttacatgggacacaaatatcttcacatcctttgcccatttggagagatctatccacatacttcttccccagatgtctttctcaccaattttccaattgtgatctttccaagtgcctgaccatccagccaatccattggctacagcccatgagtcagtgaataatcgtacatctggccatttcttcttgcaaacaaactgtaataccatgtgtactgcccgaagttctgcccactgtgaagatttcccttcacctgtgtctttcagggttgtcccagaaaggggttgtaatgctgcagctgtccacttctgggtggtgcctgcataacgtgcagagccatcagtaaaccaggctctagtcttctcctcttcggtcagttgatcatagggaacaccccatgaggctataggtgcatgcttggcagcagatggcattgtaacaggagtagaaaccataggcatttgagcaacttcttcatgtaacttgcttgtgccttcaggacctgctctggcccgatcacgtatataccacttccatttgataatagactgctgctgtgcacgtcccactttatgacttgcagggtctgatagtacccagctcatgatgggtagttcaggtcgcatagtgacttggtgtcctattgtcagacgttcagtttccactaaggcccaatagcaggccaagagctgtttttcaaagggagaatagttgtctgcagatgatggtagagctttgctccaaaatcccaaaggccttttctgtgattcacctacaggggcctgccagaggctccaaacagcatctctatcagccacagacacctcaagtaccatcggatctgctgggtcatatggtccaagtggtagagcagcctgcacagcagcctggacctgttgaagggccttctcctgttccaggccccacacaaagctagcagctttccgagtcacttggtaaataggcctaagtaacacacccaagtgagggatgtgttgtctccagaatccaaatagacccactaaacgttgtgcttctttcttggttgtaggaggggccaggtgcaataacttatctttcaccttagaaggaatatctctgcatgccccacaccactggactcctaagaatttcactgaggtagatggtccttgaattttggttggatttatttcccatcctctgatacgcatatgtgttaccaatgagtccaaagtggttgctacttcctgctcacttggtccaatcagcataatgtcatcaatatagtgcaccaatgtgatattttgtggaagatccaaacgatcaagatcccttctaactaaattatgacacagggcaggagagttaatatatccttgaggcaaaactgtgaaggtatactgttggccttgccaactgaaagcaaattgcttctggtggtccttatggacaggtactgagaagaaggcatttgccagatcaatagccgcataccaggtgccaggagatgtgttaatttgctcaagtaacgaaactacatctggtacagcagctgcaattggagttactacctgatttagttttcgataatcaactgtcattctccatgatccatctgttttctgcactggccagataggagagttaaatggagatgtggtgggaaccaccacccctgcatctttcaagtccttgatagtggcagtaatttctgcaattcctccaggaatacgatactgtttttgattcactattttctttggcagaggcaactctaaaggcttccatttggcctttcccaccataatagccctcactctacagttcagggaaccaatatgagaattctgccaatttctgagtatatctatcccaattatacattctggaactggggaaatcaccacaggatgtgtccggggacctactggacctactgtgagtcggacatcagtcaaaactccattaatcacctgccctccataagcccctactttaactggagggccacaatgtttcttgggatcccctgggatcagtgtcaactcagaaccagtatccagcagaccccgaaaagtctgattatttccttttccccagtgtacagttacccttgtaaaaggccgtaggtccctctggggaagaactggagaaagggtaacagcaaaacctttgagtgtcttatcaagatccttcctcagaggaacctggccaccccttcattcaaggggttccggatctgcaaactgtctcaagtctggaaattgattcactggccgagattgctgtttaccacgatctaatgtagcctttctttcatttgtttgagaatttttctgcttatacagatcaaacaaatatgcagtaggcttcctatgtatttcattcctggaaacaccatgattggttagccagtaccaaaggtccaaccgagtcatgccattataaatttcacctctcctgtgctgaccattactgggtatgttattataaacattcttttgtctacgctgtccattataataactaggatcaccttgtctctggcgattcaatgctgccacctggcccttgttacctcgggatccaactaaacccagtgaatttaattcatctaattgagcagaagcatctccaatgctaagatctggcacaaggaaaagggaaagaacaaaacccttcaaatgtgctggtgcccctctcaccaatttgcgtcttatagagctggtgaaaggcatatcttctggaccttcccattgtggacaattatgctttacacaatatatccactctagcattgcaatttccctaagtcttaaaatcccttcatcaacactaagccacggaatatcaggcatctccaagtcatttccagtaggccatcttttgataaacacctcagccaaccattcaaacaaacttttgacaccttttttaactatgcgagcttccgtattaaacctagaatctctactcagaggacccatgtcaataaactcagcctgctctagttttatgttccttccacccttatcccacacccttaaaatccattcccacacatattcaccaggtttctgcttgaatgaattagcaaactcattaagctccttagtagtgtagcgaatttcctcatggactatactttctacctcccctctaggagcctgttttgctttgagtctggttacaggtctagaagaaactattggtgggccatgagcagactctgcaaaattaatttcctcatgtggggaaggcattatttcaagaggtggggctgagggtactacttcctcaggtggggcaaacccttgagaatctgaggattcaaaattctcagcttcaacatggtcttcccacacatccccgtcccatgttgtaggatcccattctttgccaattagagcccttactttaactgtcgacacactctgaggctgagacttgaattttctctgtagttcagccaaccttacaatgagagtttctgtttgattttctgcaacttgagctctattgctacaagagagaagattctcctcaaggacacacttagcaacttttagatcgtttacttgtgtctggagcctttcgattttatcacacaactccttcctttcattcatcattttttccacagatactaagagcagccagccagtaaaatcatttttcgattttttccccatcttgtagaaagctttgtgcactgaatcacctaattcattaagaaaatcaagggcattagcttctttaagttcggaatatagtttcaaccatgggtcttcaaaattctctgagctcccaggagggagagaatctggagaggtttcaatatttgaaagtgctggtggatcaacaagccaattccagtattttaaaagattcatccttgtacttctgttactctagaaccactcctggtaccaacttctgtattagtcagggttctctagagtcacagaacttatggataatttctaaatagtaaaggaatttattgatgacttacagtcggcagcccaattcccaacaatggttcagtcgcagctgtgaatggaagtccaaggatctagcagttactcagtctcacgcagcaagcaggcgaaggagcaagagcaagagctagactcccttcttccaatgtccttatattgtctccagcagaaggtggagcccagattaaaggtgtgttccaccacacctttaatcccagatgaaaggcgtagcccagattaagggtgtgttccttaaactcggagattcaatcttctggaatccatagccactatggctcaagatcttcaaaccaagatccagataaggatctccaagcctccagataagggtcactggtgagccttccaattccggattgtagttcattccaaatattgtcaagttgacaaccaggaatagccactacaatagggctaactaatttcaacacttagcccacaacaatcaataaatccatttttttgtttgaattccattcatgtctctgttccttacttttactttgcctttcttacatttaaaaaaaactattgattctttgtgaatgacacattgtataccctaatcctattctcccagtccctccatagctggcctctacccttgcaacctcccctccaaaacaaagcaaaaactaaaaaataaaaattaaacgaacaaactcccaacatcttagtgtgaaaggtgtggtatgtcacactgtgtcacacagtatacctttttgcccaaacagctttacttgtaaacgttctttgcaatgattcattcgtctggttcaaggcctctggcttctgctaccccatcaatactggattctcaccaggattgttgccctgagtcatggagattttgtagctttgcttctgtaggacgggctccttcacatactccagcagctcatagatgggatagatggtgggctgggccaactcaaggctctggatctgggtctggctggtagctgagttggtcagcccactagctctcatgtccaagccactaggccagctctcccgtgtttgcctagatgaggggtggaactagctctcctgagtgccagagcttggtgaggggcagaactagctttcctatactggtctcttcttccttctcctcctcctccccttcctcctcctcctcctcctcctcctcctcctcctcctcctcctcctcctcctcctcctcctcctcttcttcttcttcttcttcttcttcttcttcttcttcttcttcttcttttgtggtttttcgagatagggtttctctgtgtatccctggctgtcctggaactcactttgtagaccaggctggcctcgaactcagaaatccacctgcttctgtctccagagtgctgggattaaaggcgtgtgccaccactgcccagcttactggtctctttttaatcaccacatatttctctgctctagccaacaagcatcaattgccatgggctctgggctcttgttaatcaccagttatctcttccactctagctgacctacagatgattaacacaaaatattacacaaatggccctggtcgagtctttgcttccctttgaaacatcaaacacccaaccactattatctgcattgctttcagcattcttatcatctaagctccctgatctctgaactctaagtgtctttttcagctcagattgtaaatgtcgaaacacatggtcaagtctgtcatagcaatacctcatgatctgataacaatttctgtctatttctgtctttagggtttctattaataaaataccatgaaaccaaagcaacttgtgtttaccatttccttaaatataatagaggttcatgatcatttataaatatttactcagaaaagctgcaaattagaatctttcttggctactcggtggtctataatttggctcattttatatttcatttgttcaacaaaatgacctgggtcacttttctctattttaatcttttgtggttaagattagaatccacagagttccagtgaacagtatataacatactccaagaccacaattaatgaaaaccagctgttttgttcttgtaagtgattgcttaaaaaagtcatgtggataatttaaaataaataatattgtgtattttgtaagaaattttgttaacgtaagtgaaaaataaaattgacctcatttctattgtagcaacaaatgtttttctttgtttatatggcttatttacttttaaacacagtgagggcatagcagaatacttaaaataataagttcttcatgaagaattgatgtcatatttgtttagaaaatgaatttatggacacatttatttcactgctaaataatatctttattgtttaaaagaagatagacagtatattttgattttattttgtttctgctttatgattagtacttacatcgggattttttttttctttttccaattttttttattagatattttttcatttacatttcaaatgctatcccaaaagtcccctataccctcccccccaccctgcttcctctacccacccactcccacttcttggccctggctttcccctgtactgggacatataaaatttgctagaccaaggggcctctcttcccaatgatggccgactaggccatcctagagacacgagttctaggggtactgattagttcatattgttgttccacctatagggttgcagaccccttcagctcttgggtactttctctagctcctacatcggggggccctgtgttccatcctatagatgactgtgagaatccacttctgtgtttgcctggcaaaaacactggcaaagcctcacaggatgttccaactggtaataaggacacatgatccactatgttcataggagccctatttataatagccagaagctggaaagaacccagatgtccctcaacagaggaatggatacagaaaatgtggtacatttacacaatggagtactactcagctattacaaacagtgaatttatgaaattcttgggcaaatggatgtatctggaggatatcatcctgagtgaggtaacctagtcacaatagaagtcacttgatatgcactcactgataagtggacattagcccagaaacctagaatacccaagatacaacttctaaaacacaagagaatcaagaaggaagaccaacgcttggatacttcattcctccctagaatagggaataaaatatccatggaaggagttgcagagacaaagtttagagctaagatgaaaggatggaccattcagagactgctccacccgggggtccatgtcataatgagccaccaaacgcagacactattgcatatgacagcaagattttgctgaaaggaacctgatatagctgtttccagtgaggattttttttttaattttattttccataaaaggggattataactaggctttattttagtttctttgagggtgaaatggtgtggggcaggatctcatgtagtcaggttggcctgcaatttgctgtgtagatgagatggctttaaactcctgctcttcctgcccctgctttctgaattcgtgctgggactatggactggctgtacaccaccatacgtggtatttctatgttttagaggaagtttcctttgagtacttttctatttcgtcatcctggggattgaactcaggatctcagcaatgctagggaatcactctatgttgagctacatttctctagctcctaggctttattttatatttgtgttttaggttttttttgagaatgtgtcatgtagcccatgctgatctggaacttgatatctggaatttgagattgactgcagatctgtctacctctatctcctaagtgcttggtttacaggctactatgcccagttttatgtcatgtaggaaatagaatacagagctttttgcatggtaggcaagaccttgacaaactgattcatgtcagtaaccctctattaatggtttttagcactccttgtttttcaactttagtgattggaaggagaaaaattattatacagaaataaaaaatgactcgaaggtgttcagtcaacttctaactccccagtcaataaaagactttttgttgaggaaatgaggcggtgataatagcatggttacttgtagttgacaattcttataaaatagcaatttttgtttgtacatatatatatttatatatatctttatttttttgaattctgatataaattgaagagaaaaagaagtttagattttgggagaaatttcctaccatatttaactctactccttaggtcttattgtagcctcaggattgaattgagtgtactctgaatacatttaggcaaatctgtgaaggtggctagtggggagatggttaattttgtttatatcttgttggggtacagtgtactcatttaaaatatttctgaaaagacactggcaaaatgccctaaaatgtgttagtgggtcaggtgtgctagtacatgtcctgtaaattcagtacctgggatcttgaggcaggattgtccttcacaagttaatgagacattgtctaacattaaaagtggctggtgatgtagcttattgatagagcacttgcttagcacacattaagctccagcactaccagaagaaaaggaagtattgaagaggaataaaaaatattaaatgatgtccatagtaaatgtgtgaatatgtgaaatttgtagccatggaaaaaagagaagggaatgcttaacctctagttgtattacagtggagaacgaatggttaacttttcccaaacccattaatgttgttttttgtagaagtaaaaagatatgctcctacagtaaacttatattagatatatatatcttgttaccgatgttttgtaattatgagaaataaagaatagatttttcagagtttgcctttcttgttaaagatactatctttacactgtgtcttttatgttcaacagattttcaacaagctctgtatgagttgtcataccatgtcattaaagggaatttaaagcacgaacaggcatctagtgttcttaatgacattagcgtaagtatatctatttcaaacagtaattgtttcgtatctcctcatttttgctacaaagctctttgacgtgtataacatgtactttgtcaaaataatagttttaaaggtaatattggtaagccatttttgctctacaaaaatcgacattttagtctttccttctgtttgtaaggaagaaaaggttataaaaactggcttgagcaaaacaaaagtactggaatgacgtcaaagccttaactaatattttgactctagaaataaagtattttcttcaaataatgatactttttggtaattatgactataattttattttatgaattaaattattttaaattgcagttgcataatcctgacattaatttgtttgtatctacttcctacttacttttagaaaataacagctagattttttttttaaaccttcaagtggccagtttggttttacttacatttattggaggatttaggctagattcagagcaaatactttcgaatgtagattcaatgtagattgctaatgactcaggctgtttgataatttgaactggaagagggactgttaattgttagggtgtttattgtaaactcataatttcaagtggtgtgctagtctgttgtgagactggtctttagatttgtgtaaattatttgtccaacttttctaataactattgagatggtattcgggaacttatgtgaattttctgtatgtttatgtttctgtagttctttcctgtgggagtttggaatgtgcttcatatgatttttgtgcttttcttgggtagttttaatggaagttttaagtttagctgttgtgatactccacccctcccgaagtacatttgagcaggacgaattttaatatatatttctcttccttcctgaaactgtctccagttaacataaagtggtatatttctttggaaaaaacccttgcatctttctacttctgttctttaattaatctgagtatttgcattcataacccttgaacaactgagagccactaagataatttcattctgtaaattgagagttgatataattttagtctgtatgcagaattgactacaattatttttccatttatgaaaatagtctaaataaacattatctatactgtgtttttagaagttagtgtgtcctatattttgaatactttattatatgtatatacttctaccctgcattgcctttgtcatggcttttccatactaatatatatttgtccagtatcttaatcacacatatggatttatatgactcctagcagctgccagctttttttctttgaatttctttcttatagtctctgaaaatagatgaattttagggttgctatagtaccagaaaactactaattacagtaactgaactgtgatccttactaatgggaaatggctctaaaattgatcatggaagtagcaagccaagaaataattgtggactaatgctggtgctttcatccagaaacaagattttgggtcagccccccccccaaaactataaacaaagagtgaataaacaaaataaaaagaaaaattgataattatgtcatcttcacagaatcttgaattatagaataattgcttttaattgatataaattttagatttctgatcttctgacatatgattttttttttgagatagggtcttactatgtatatgtagccctggctaacaaggggtttgcagacatactgacatactgcagacatgactgacagaagcctgcttgcctgcctgcctctgcctgtctgtactgggattaaaggcctgtacacatgcagcccaagtcctttcttctaactgatcgacattcttatacttatgaaccttaccttggagaattctaatgtagacatgctggactttagttgacttctacttgattgatgagaattgttttgaaataataacactttttccgtgctattctggaactgattgtaaatctttaatgtaggaattccgtgaggatatgccttctatccttgctgacgtgttctgcatattaggtaggtgggaaatgtttattttgcatgtaacaattttgtgataagatcaggttaaatgcttttttttttttacaaacgtgcagattttctgcaaatcttcaatcatttttaactttacacagaatatagttttgtaaatcaaatataattactttataaattttataatttaatttaacagtatacttttttgattgataatgtatatttatgtaagtttgagctaaatgggctaatttcaagtaaaaaaaaagtcaagttttctcacatttgcctgcatttctgcaattatagtaactacatcatgtcattcaatgagatttctctgaatctcaaacgttcccttttaagtcttaattttaaaatgagtaagattagtcaaagtcattaaaagtacattggttttgaggataaaaagtttgtgttgtatttatccagaattcatataagaattcatataagacttttttctcaaaaaggaataattctttgatttccaattaaaggtagtgtctctgaggaaaacatggatttacaaataatatgttttgaaaatttatttgtctaatcttagctattgattaaataactgagcatggcttccccatcagttttgttctttctgtaattttgagtccaaacatataacattgctagacatatattacctttaaagcaagccttatcttcaagggtttgccaagttggagttacttcagtttattacttttaattcccaggatttggtgagttaattaaatggctcactgagtatttagagtttgttcttagctaatatgaattcctttggtttttgagaatgtttcaagtttcagaacagtggcaattttaggaacaggttaaaatatatttgagcgagtgataaatgtgaaagaaaggtcactaatgagtcagccatgtgtcctgttttttccccctcctggaaaaatcattaataggtaaataaaattaataatgaaataaataaataaataaaatcagtaataattttttacacccaactgtcctggtttgaatgataaagtacatcttcactgtatttaactgattggtttatacaaaatgaaaaaagatacttaatatttgaaaatgatgctaacaaatatttaatacacaacaaattccaatgtaaacacaattgtctttttccacaaattatatatttaggaaaccaatttctaggagctatttttttattttatttttattaggtattttcctcatttacatttccagtgctatcccaaaagtcccccataccccctcccccactcccactttttggccctggcgttaggagctatttttgaaagatgttgtccttagtagtgttgtctttctttagtactcatcagttactagccttttcgctctcttcgattcttcaaatctagtagtttttaaaaagttgacttattttattaaaataatacctttccttcatttttttagccaagtgactctttctacaggtcattgcatattattgtaacatagattcatgatggtgatatatagttactttgggggaaatttattccatactacccaacccatttttacaggcatgatttgaatcccatacttgattaagaatatccttcatctgccccctcgtgcacactcactctaggcaggaaaaaatgatacaaggatgactccagaacaagtagagaaattaggattaagaatgtgatctagggctctagagatggcctagagcttaaaagagtagatagaggctgctctttcagaggtctaagttcaaattcccagcaaccaaagggtggcttgcaatcatctacaatgagatctgatgccctcttctgatgtgcaggcatccctccagacagaacactgtagacatactaaaaaaataaatcctaaaaaaacaaaaaggaatgtgatctagctggctgggaaggctcagtagttagtaacacttgttgctcttacagagaacagagatttagttcccagcacccacatggcagctcctcatccttaggtccagttgtagaggatcttaacctccataggtaccatgcttaactgtgtatttgtacatatacatacacacagttaaaactcgtgcatataacgtttgcaagaccagtgggcctctcttcccaatgatggctgactaggccatcttttgatacatatgcagctagagacacaagctctggggggtactggttagttcatattgttgtttcacctatagggttgcagaccccttcagctccttgagtgctttctctagcttttccattgagtgccctgtgttccatcctatagatgatggtgagcatccactcctgtatttgccaggcactggcatagcctcacacgggacagctatatcagggtcccttcagcaaaatcttgctggcatatgcaatagtgtctgcgtttggtggctgattatgggatggatccctgagtggggcagtctctggatggtccatccttttgtctcagctcgaaactttgtctctgcaactccttccataggtgttttgttcccaattctaagaaggggcaaagtgtccacactttggtcttcattcttcttgagtttcatgtgttttgcaaattatatcttgtatcttgggtattctaagtttctgggctaatgtccacttatcagtgagtacatatcaaaggggaacgccagggccaagaagtgggagtgggtgggtaggggagtgggggggagggtatgggggacttttggaatagcattggaaatgtaaatgaagaaaatacctaattaaaaaaattgaatctataaaaaaactcatgcacataaaattaatctttaaaaagaatgagagttatgtgtaataatgatgatgatactaataataatatggcataggtgctatttttggaacacctttcatattttaggcatcatgttaaagtttttcatcttataacatcttatatcttaatcttataacaactatatggtaggtatgcagataggcaaaatgaggtttagtgagagggagcctgagtaacttgagaggctgattctgaagtaacatgatgcactgatgagaccttggaggtgggccagttggctgatgatgtagaagacaggaggaggaggaagctgagggctttttagataatcataggggaaattaaaaaagaacgtactaagtgctaattaaggatactggacggaataaggtatgatgaaacatttatttgaatgctgttttgagtaagaaggaaaataataatgaaaatagaggaagtataattgggataactactaaactgtgtgttgagacaggttaactaacagatttcctgaggtcctgttcagtattactaccataatcacaagctgagagaatagtaccttaatcaggtcaggtagctacgaggacttgagcaccatgtgcctgaacttaaggaccttagtgatgtcatcttaacaactaactcagagataactgggaacccctggaaaaattaatgagatcagttaagtctttgagaaaacaccgctaaacgtagagattaactgggcttgggggtatatgcttctagtcccagcactctggaggcagatgtaggtagatctttatgagcttgaggtcatcggcctggtccacatagcaaggtccagacttgccagggatgcattatgaagccccatgccaggaaaaaaaaaagttgagattgtattgtaagttacattgcataaatcataccctaaattttctgtttaagtctttcctgtgtgctgtagtgtatagaacccatgatctcacagattctaagcaagtacttgtaccactaagccacacccttatcccctaaaattttcttaatgtacttgtgctaactttgtgctacagttgctaggatatgggtaaatggcagttgtcaagaaggaatagtgaagggtcaggaaaacatttgatgttataaatttccttctcttttgatttttcatgttgacagtagaatgtaaactaaagtaaaactatggtaaagttgcattatttcggaagatctacttagaggtactagttattacttcaataagactaatgacatttattgtacagtctaaattaccagttgactttaaaaataagtaattctaagcacttggtaggtagaagcaagaggatcagaaatttaaggtcatcttggctatttagtgatttgactgcaagagactctgtctcagggaaaaaaatcagttaaagcaacaatctgaggtcaacctttgtgtaattctgcttatcttatttgaaaattttgatgtttggcattttgcattaattgttttattttatccacacctcagatctaagcttggatacgttttctgaacaatttttaaaacggagggaagtctgtatttttacacatttcagtagaaataaaatgccagtgttgagtatttttatttagtgactagaattagtcaaaacaggattttaaatataccttttaatactgacttttcatagacttggtgacattagacttctcaacttcattgataagtgactcttaaggttaggaaacattttttttttggtgccagccctggggaaactgagaaaagagaattgctgttgatttaaaggtcagcctgaagttcattgcaggttgaagacaagcctgtgctacataatgagaccgttttgttaaaaacaacaacaacaacaacaaccctccccaacaacaacaacaacaatacccccctccccaagacagagagctgacttagtggataaagccttttgctaaggcatgaggatcagagtttgaatcctcagcacacacaagaaagcagggtaagggccatgtggctgtacacatacagctctagtcccagcactagggaggtagaggcaggtggatctttgagttagaggtcatttgtattacgtagtgagactttgtcttaaaagggggaaggggtcactatggtggcttgcctgtgtgagaaacggacataatctttggcaagctggctagttatgttagctaaattggcaaactttgagttcagtgagagagactcttcctcaataaagtggagaacaattgaggtagacactcgacatcaatcatcctatggcctccatacacgccaatgttaacaccacactcctgagtatgcacagagcacatatatacccactcaaaaaggggttgggagacaaaacaaccaaccatcagaatggccctttttgctgttgttgttacaatacagaatcttcctatttagtccaggctggtcttgaactcatgatccttctgcttcagccttctgagggctgtgattacatttgtgtaccacaaagcccaactaatgtggaagaggttttttcttgtttcctagttcaacttggccattatggaatgagtctctatttggcacctctgacgagtggtcatttaaactttgttagaattttttcctttttgaaaatagtatttttatttctgaaattgttttcagtgtttcttgtgatacaaacttatttatggatgcatgctataggctacagggtcagtcatcagtattaagagaaattaaggttttatgagtgtatgaaagatatattattacagtttatattttttccagattcagtaagagttatttttaatcaattatatttatttttgagacaaggtatttctttgttcctggtctgacctggagctcatactgtagactaggttggtctgtagcttcggagccttacgccccctgctcctgggtgctgagactgcttacaggtgtgtactaccgtacctgacacagaaagcggcatttttaactaagttttaaagaagacgaatcttttagtaggggagagtatagaaaaatgaaatttgtatctctttccttcccattctagatattgaaacaaattgtttagaagaaaaaagcaagagagactattttacacagttggtattagcatgtttggtaagttttcagatgtatttccccttctcaaatttgcattgaataagtataatcatagttgataattttaaatgaaggatgatactgacattcatttgacttaatgataaggtgagatttagatcttgaaatggaatgttttgtgaaattaggtattcaatttctgtaaaataatcataattttaaattatttaatctattacctataaaaacccttagtgatatttctgacccagtcagttcctaatgtagaaattttaagcaactatgaactaagtagaatttgttgtagtttgttcttaaactgatttttttgtaaactttatttgttagggataaaatgatggaggcagtttaagaagaataactataagttgtgctgtggatgcggtttagttgataaacttgcatacacgaaaccctggttctacccctagtaccctataaacccggcatggggacacttgcttgtagttggaggtggaaacaggatcagaagttcaagatcattcttaactacaatgagttcaaagacagcctggggttcatgagacactgtctttaaacaaacagcaacaacccttccccataaaaatagaagtcacaattgtctagtaagccacttcatgttcgtaaaattagagccaaggaaaagtaccattactaggatgtagaagaacgtccttgtctttgttatattacagtttggtttactgtagaaaatgtagaatgctgaagtactttgttaagtgaaaactgagttaagataggctcaatgtaaggaaatttttttttctcgaggcagggtttctctgtgtagccctggctgtgctgaaactcaactcactctgtagatcaggctggcctcaaactcagaaatccacctgcctctgcctcccaagtgctgggattaaaggcgtgtgccaccactgcgctcaatgtaaggaaatttaatctgtagttttactctaagctgtgtatagcaaacatgtaattttaaagtaatttttgaaagagctatataatttacttttcagtatttggagggtcattttgttgaattgaaattttaggcttataaagagacacagttttatattcttacattggaaagattattttgaatatatttaagagtgtgtgtacatagttggaatgctaaagaataaatggtctttaatattttttaatgcagtatttagtttcagacacagttttgaaggaacgattggatccagaaactttggaatcattagggcttatcaaacagtcacagcagttcaaccaaaagtcagttaaaatcaagacaaaactcttgtaagtatatgtggcttatgttacagatcaagtagctgaatgtatagttctcattttaaatcatagcagtttctaaaggctccttgaaggtttttttttttgaaattaactttatccttttaatgatatttctgatttcagttataagcagcaaaaattcaatttattaagagaagaaaatgaaggttatgccaagctgattgctgaactgggacaagatttatctggaaatattactagtgatttaatattagaaaatatcaaatctttaatcggtaagccatacctgtgtctatataatatgtgttattaagacaagctttaattttaacttttagaagatatccataaagaaaaaataaatcaccctcagttgtatggtgagtttgtggacaacaggaaaaaaaccaaagaactctacacctgggattatataacttttaatttgagtattttataaatatttataaaatttatcatgatctttatgaaaaatggttttgtcattgttgcctgtatgattattctaatgttctctctaattcttctgtctgtaaattttaactatatctcagacattttcatagagggtaaaaataaaactttaataaatgtttacagaaacttgataaatagtttttttgaacttgattttataaatacagtttgtgactttgataacacattttacctttatttctgaaagtagcagaagttgcaaaaatatagcagaaaatattttctctttagttttaaaatagcatttctgtcacattacttttgtcttgagcatttgaagagagtagctgacaatggacaggaggaatgaatagggcaagcctggttttctaagattggcaagaattcctggtattatatagtaggtagtgttctaatgagggaatattttggagttgtgtaaagtcatagtttttgtgatttccaggagaaatattatttcctacctcattgattacaatgtagctgccatttaccctcaattgcttcttgttgttgtttttctttcttaatcattccatttgtttacatctcaaatgatatcaggggatatcccttcctggttgctttatttgaatgcctacacaaagcattaggagaagggaataaggaacataagtttggctgaatccttattcccttctcctaatgctttgtgtaggcattcaaataaagctgggtttacttcattcttccttatttggcttggcatttggtgactgcaagtgcacaagctaaggctacattcagtttaaatttacctttttctttgaagtcaggttttggtagctgatctagtttcttttgtacttttgtcctatggtgattgaacatcaggtgagtgagcctctagccctgaaggagtcttgctgtcttctatggccttgactatgtcagtgacctgtttttaaaactcctctagtacagatttcttttctttccagaacaggctgtgcatttttccctgcagattttaccctcttttatctagcttgtgaagcttgtcagtactgtcatactgtactgttttttcttccttgtactgtgtcatgtccttacttaagatagtgttctctcgctcttgagatctcatgttatggagagcctcccagcatttgctttcattttgtctccttttatgtgcacaactcctttttctctttttcttttcttcttcttctttttttttttaattcctttctggattcttaccttttttatgcctttgttattttaggagcattacaaagacttttcttaaaggtatgctttgatgtaacaggaaattgtatactcctctctccttcaactttgctctcctagaaaagtttattatctctgttgaccaacgtgatggcatcttcactttaggctcatgatccacgtggatgatctataattaaaacaacttgatttcttggtctgcgtttattttaacccatctggcatcctgtaaagtgtggtagaccagatagactcagattgcatcttcttaaggctttcctggctatcattttcagcactccttagttttctcaggttatttttcttgttaacacttaatgctgtattgagtatagttgattctctgtttctacaaggttgaaaatattcatggaagaatctgttatgagtatgttgtattagttataataactaatctttctgtgttatgaagtatgcaagatcatatatatcaattatatgcacatcttgttccattttatataagaggctgtagcatctgttgattttggcatccttaaggcagtcttggaacaaacttagacactgagttttatgtctctaccatcagctcagtgaggacaatgttttttgtttgctttgtttagtacccaattcttaagggttggttggtgctaaataaataactaaatggaaagttaatgaatattctgcccatttctagtgtctgtagtgatttttagtctctcttttctgacatggaggcatttagaaagcttaactccctgactctgtttctttctggctaagtaaccttttgttccctctggttggttgagaaaggaacattttatgttgaaattgaggataagaatttaatttcatttaatgttttttaacattcaaattaattgtgtgcactatgagtacaactccatttaggtctgaccaaatgcttcagctttacagcatcctggtttctacgacatctttggctaggtttcttcatgttcatttccactattgtctcttaatgtgtaatctagggaggtaatacttcatataaaactatcttagctctgatgttcattagccgttgtgagaaactgattcctagtttggaaggtttgcaggctgggtacagttatattcagatgcactgatctggagaaatcctcacttacaccctttaagattctggcagatgaaagtctatgtaactgtttagcctgtgttgtgtattagtatgcaagtaagtacagaagcagagttgctaggattatgtggtgatggttgctagctaaagtgtgacagtaaatgggaataacttactaagtagggatgaaaaatgattactagactactaagaaataggtcctttcaagggaattttaaatcaaggtggcagatataatgtatattttaaacatcaaagaaaaatagaggtgggctcgttttttctgaactaaactattaacgtatacccgtctgtcctaaaaaaacaaaaaacaaaaaaacattttcaataccttaaatatgtacaataaaatatgattgcaatagtttcatctaagttagtattcaacaacatttcttctttcatttttctttctgttttgttttatctttgagacagggtcttgcacatcattcaatcttgcctgaaacgttgattctcttgcctcaaattcttgattttttttgcagtctttttaattgttgtagttcatacatattttactttactaatctctcatttgatacttagttggcaaagccctcccacccccctcccccaccccgttccctgttctgtagactgtcttttcactctggtgatcatttaatttgctgtgcagaatcttctaaatttcatgtaattttgtctgtcaattctaggaatcatttcctgttccattggagtcctttacagaaagtccttgtttatgcctaaatcatgaggtattttcctgtagcatttcaagtttcaggccttatgttaaagttattgatccattggaattatttttgtggaggagagagatgtgggtctacattcttttccacattgatatatactgtttcccaggcactatttgttggaaaggctatctctttttcaatatatgtttctggctaccttgtcaaaaattacatagctgtttttttatttctggatcatctagtttatttgtttgtatacagtatttgtcaatgtggttctatggtgtaatttgagatcaggtactatgttgtcaccagcattagtttttatgctaaggattggtttgtacttgagaccttttgtgcttttataatgaagttttaatttttgttgtgagacagagtcttcctatgtcttcctgctgcttattacttgctctgtagatcaggccagcctcagtctcaaagagattggcttgcctctgcctcctgtgtgctgggattaatggtgtgtatcactatgcctggtcatgtgtggtcttactctaatgtgttcttgaatttggtttgtatatgtgtcttgttggacagattttccacctatgtttttcagggaaattgatctgttcctttcatttgttgttgggatctgacctggcatttctattaggttagtgttgattttgtaggatgacttggctatcttttcttccctttaggttttgtggaacagtttcaggagtatcagtattagtgtttctttaaataattggtaatgtctgggagttatttttttcagttgtggcttttcttttctgggaggtgctcttttgtttcttgctcattgctgttacggatctatttaaattgtttttagcttcttgatttaattttgatggatcttatgtgtttaggaatttttcttttagaatttcaagtgttaaatataagttttgagagtattctataatgctcatctgaattttactggaatttgctgtaaaattctccttttcctttctattttactgatctgggccttttctttcttcggcttgttttattagggtgttaatcatactcatttcaaaacactattttcttgttttgttgattctgtatttatctccatttgattaatttctgcccccatctttagtttttttttttttccacctactgtgtttgggggttgtcttgttcttgttttttttttttttctccctacagcattgggagtatatcataagggtatttatttgaaagctcactgatttaaaaaatgtaaatatctagttacaatcttttctcttaaaactgcttgaggtatagctcatagcttctgataaagttgtgcttctacttttcactttgaaatttttattgaactttttatttttttcttatttcttcagcggctcattttagttatacaagagtatattgttcattttccaatccaagtatttgtgatttgtgtaatttcttttgctatcaggtgcttgttttgttccactatgatctgaataaagaacttacttcagttcttttgtgtgtgtgaagacttgttttatgttgtatttctagcaggcttcattgattgcttataagaatgtgtattctgtttgatagaatattttgcagatacctgctaactccacttgatctatggtgtagtttaactgacatatttctattagagaaaacagaacaaaaagaagcaaccaaacaatggcacctgccttggttgtttattgctctagttctgtggcacctagcatttgcattcccattcttgtggtcccctattttcaggcacccagtatagcccagttttaagcaaaaggtaaattctgaagatgatgctgggtcactgcactcttgagtcacttctgcctattgctgtggaggaatctgctattttgtggaggaatcactttcttcaaaaatctgcatccggatttgaggcttttgaggtctgtaggcttgtctcaaagtatgcctgccagtctcttttgagcagggtagcctatctcacctttttaatggggcttctgctttccttaacttcaccagggaaccatgtggctgtatctgtgtgtgtttgacttggcttcttttcaatgtgttacctgttttttccttgatagtttgtagctgtttagtgagagctgttgaatttccaaagctttctactttgttgttttggagcagtgtattctttttacacttctcatctctttacctgggtcatcagatgctgctttcagtctggtgtcttaccacagttttgtttgttgttatctaagcttgaagatttggtgtggaaagtaggatgagagtcttttccaatctcatgggttcttttagtcacattacagtgtgaccagagaaatactaaaaagaaaattaagtgtcaagccgaacaattctttgaaagatttgaggacattcaactccttagattacattattttgagagtgcttagtataacctgaatataaaatttattcattccagattcatattgtcactatatcagctttttagaaaaatctctttaaaagggaagtcagttggcttttttctgtcccctaaaccttttcttattatagtcacagtactacaaaccaccaccaccactaattaataacaacaacaacaacaacaacaacaatgaatgttttctctgtgtatccctgactgtcctggaactagctctgtagactaggctggccttgaacttagagatccacctgcctctgcctcccaagtgatgggattaaaggtgtgtgcaacattatcctacacacaggttttaattcattggttcattcattcattcatttttttcacacaaagcatcccatatctatccatttattcaaccattatttcagaaaatatatacccactggagccacccctccctccactcctcccagtccccatactacccccgctctctcccagatacactgctcatttgtttcccttcggaaaagggcaggcttcccaatggcatcaactaaacatggcataataagttgcaagaagactagttaaagtccacatatcaaggctggactactcagagacatatgcagttgactataatttgaagtttccaccccctactatgcaaaagaagatagttattagtgttctcaagcataccttttaaatttttttcagaataatgatacttttaagtatatcttctgaatcttgatccagtgattcttgcttcaagatgtgctttatcatgtttttttctttttatataagtgatatttctgagacattgtctactgtagattatttagcttgtttctttctttgtcagtattttggagaggtgtgttgatgtgtgtgtaccttcatgtgttttcatttctagaggttgaactcaggaccttatgcatcctaattagacactattaaactgtgtcttcagccttattaacctttttaaaaagtaattcttcctggtttttatttttacattaaaaccacaatttcctctgtgttctaaggtctatcctgccagcaacatgattattgaatctgtaatcttgtttacacatggacacctctcctagtattcattacagtattaccttggtttgttatttccatggtaagaatttcagtttgggctctagagagatggctcagcggttaagactgactgatcttctagaggtcctgagtttaattctcagctcattactatctgtaatgggatttgatgccctcttatggtgtacctgaagacagcgacagtgcactcagatataaatgaataaataaatcttaaaaaaatgtttggcttcatttttacaacaatcattgtaaacttaatcatatttttgcttgtaactggttgcatttgctgtactatactatctgtccatcttttgataaactccagttactttcagtacaatttcttcaatgaaaggcatggactctctttaaggatagaagaggtagtgtattaattgtgcatcacaaggtcatggcatttagtgcattggatagctatgtacacattagatggaggaataagttcatggctatttcatgtctgtcacttgcttttccacatgttctattccagaatgattttctctttctccaaaggcataaagagctctctctctctctctctctctctctctctctctctctctctctctctctctcccctccctttctttctccttctccctctccttcctcgctccatctctatttcttgcttgcttaattttactggtagttgagagctaggataaacaaaagcatttcaggatacttaaacacaagagtgcctaagttccacacagcaatcatttggaaaagaataactttgaatattgaagcttgctgattgtttagagttttactattatatagaaatctaaagttaaaatgtttcaacccttcagtgtgacgtctttaaactattacaaatgctaaaggtactttctttctctggttatttctattttcatgtataaagtatgtagctttaaaaaagcttcttgagaagattgtcctctgaaggaggggatataaactttgaaaataagttattaaaatatttttatcttgccatatattatcattgttgatgactttatcagagatgatgtgatttcttttgaacttatatgtacctcttctgttccaggatgctttaatctggatcctaatagagttttggatgtcattttagaagtgtttgaatgcaggccagaacatgatgacttctttatatctttattagaatcttacatgagtatgtgtgagccacaaacactgtgtcatattcttggattcaaattcaagttttaccaggtaaaaatgtgtgtgtgtgtgtatatatattatatatatataatatatatatatattatatatgtgtgtgtgtgtgtgtgtttggatcagtgtcataattttgtatgtatagtttgttttaatttgtgttgtattatttactaggttcatcagatgagatagagaaatgaaaagttaatgatatgttgtgatgagcgctatgttaaaagtataaatgatttgatgagacagtagaggaaagcagaattaaattttgcctcaggagacagggtctagtaatacttggaggagtagggatgtgttgaaaattttctatgcagaaataaactgcaagactaaatattggtggtgtgggaatatataactgattgaagaaatagctggttgtcacttgcctgttttgtaacgtgaggaaggagtggtagaaaattgtctctagatggagagctgtgtattagattgccatagacctttgactgcatgttattttaggatttgattgtacatatgaagggcattagaatgttttggggatgttaagtacttcaagaatatttcactattaaatcagtatagtagctgaagacaccctatttctgtgtttctcttttagtctgccatattgctactgttgttttctaaaagatttggtggggatgcctgactactgaaaagtcatttctggtggtgttaagcttttattaaaacattagccacagctgcttctcattttcctaccaggaacctgagaccccattcttattatagggaagtaagtcaaagtgtcttatcaagaaaccaatggctgaaatggaaaggtagagaaaatttaacttggtccaagattaatactttcagatcggataacattgaagattgatgacattctgagtaacattaagttaattgttagttttagaattaaaagtagttttacatgaacatacagttagtgatataaccagtgtaaatttgggactatcttataatatttgaataatactttttggatattttaaaatatatatttaatatatatttttggattttttttaagtataagaaatacttaagtgttagaaacaacttgttcttgtaagaaatacctctatactgctctgtgtgacaatctttcttttttactcttgccaaatctatctagttattgtgagagtgtagtcttatgactgctgaaagaaagaggaaattgtcagagattttaaataatttgtggtcatgtgagggaaagtaaggaaagctgtgtaaaccaagtcttatttaggagatgtaaccacgggtgtaggctcttaggaatgtgtaggcagcatgtatattggtctcttccctaatgcttttgttctctccaaccaccacctgaaaatgctaactccctctttttataactcacatatgacaaaaccacttaaagtggaaggacacaaatgtgtaggtacaagacagttttattctattgtagctaagctgttaattaaatcaaagtaactttttcctaagtctaaaattttaattgtaatgctgaaagtactcactaagaaacagaaaaggacaagaaagaaatccaaatggcacacagaccaaagaagctattgggaatgaggagcaaaaatcacagcaaaaggcccagaaagtctatccttcatattaattcttctaactgtaaaattgatctctctaattaaaagtcaggttttggcagagtacacttaacacaaaacacaaacaaaaaccaaataaaaacatgatccagtattatgctaggtaaaagaaaacaatattcaaaggtacaaataattagaaaataacaatctagaagccggtattatatttgcatgtgggagaaagctctggtgcccatatcaacagcagatagggtagaattcaggtcagaaattgttatgaaatgatgataaatggcctgtaaagactgacagtccatgtaatgatttttaaatagtttatactagttataaacacaaatcagctaagcagcataacctctaaatttatgaagtagaggaacagtttatatttgacccgagagtataaaagttgttgagatgaactgtttagaataggattaagggaacagtgcaagtggtcataatatattctattcaggaatctcagaagagattagaagttaaagaagcttttgtatatttgctctttaaccagctattgccaatagactagactgatatgaaatttatcctgtgataattattcaccttttgtgtaccctgatcttaatcaatgatcaaattaactagacatgttaaaaatgatgagtttcacctgtaatccaggtacttgggaggttgatgcaaaaacatgatgagtcttacttgggctacatattgaaacctctcaaaatacaacaaaacattaaagtgaactgggtctaatacacacatgtggaaaactccacccaacaataccaatatatttttctttatacacctggaacattctccagcgtaggccatatatttagaatttagaccacagaacatcttgaattacaaaatactttgtgatcatatgctatggtatttgattatagctatagtgatggacaatgatgtgaaattttttgacatcagttatctaaattgaggttatgagactagtgaatgtggttttagtatattcaagtcatgtatctcaggacagattatcaataagttcagtaagctttgttttggtatcaaacttggaccaatatttgtttttactgaaaatactttaattcaaaatatccatttatgtgcaaatgtttagaatcaagaacctattgctaagttgaagacttatctattgttaaaaaatacaacaaaacagtatcttctttaaacaacacaacgtagtttggttatggttatattacacataccaagtgtggctacctgtacttacagacgttttatttcagtgttgtaggaaatctgtacctttttttttctctgatatccacttattttttttccattttttattaggtatttagctcatttacatttccaatgctataccaaaagtcccccatacccacccacccccatgatatccacttactagtgagtatataccatgcatatccttttgggtcagagttacctcagtcaggatggtattttctagttccatccatttgcctgcaaaactcaggatgtcatcccagggatgcaaggttggtttaatatatgaaaatccattaacattttcatagtttatatagtggatataatccactatataaacaaactaaaaaaaaaaatcacatgatcatctccttagatgcggaaaaagcatttgacaaaatacaacaccccttgaaattaaaagtgttggagagatcaggaattcaaggcccatacctaaacataataaaagcaatttactgcaaaccaatagccaatatcaaattaaatggagacatacttgaagcaatcccactgagatcagggacaagacaagaatgtccactctcctatatctattcaatacagtactcgaagtgctagctagtacaatatcacaacaaaaagatgaaggggatgcaaatggaatattcttatgcattgtaaaagatgcttagtctcaaaactgttttcttgtacttatctgaagatgttttgggatgctggcaaaagtctttgtcccactgttcagatctttgattttataatgaagaatattgaagtgtattacttaattttattgatgaatggtagagaaaaggtaagattttaattttactctataccttaaggaattcttcctcttttaggaaccaagtggtgagacgccatcgtctttatacagagttgcagcagtcctcctgcaatttaatctcattgatctagatgatctttatgtgcatgtaagtcaagtgctttgttaagagtttttcttatgcatcccaggggtaaggaagagggtaagcacctcactgctggctctagacttccaggtattatttttgaaggcattatatattattgccttgtctaaatcaaaaatagagtagattttcttctttgataaacaatggaaggtaacttcctcttagtcacccttacaggtttcaagattggatatatagctcttttttaaatcattgccagtgcttagctcatggggagaaaggtcaagcactaaacaatgtcgttttaggcttttttatttttatatgaaacttgtaggaaataggggactgtctagaaacttctaggtaggtaatcattgctgtacagcttttacctctaatgtttactggttgtttatattagccttagctatttgaatagattgtgcattttacaggggttaaaacattcctattatagctcactgtggtgcctaagtcacttaaaaatctttttggctgtgtttttgtttgtgtcaggtttattattttgaaatgcttatagtaacaatcctccacttggacaaggtagctagatctgagataatcaaccctcaacgatggaattgatactgattagaaattagtttgtgatttatgagataccaacttattaatagtttttataattgaaaattagaacatttaaatctattcttttgacatatatgcagtactttgtttcgtttgaagtttggcttttaaaggtaaaatatgtactttttattttggtggtattagaggtcaaatatggggtgtagtttgctggacaaactttgctttactgcagagcacccctcctcctggtgttttcaatggagtaggtatatattttaggtatatttataaattcaatggtaaacaactctgtagtatgaatttagagcttttaaaatactaaagataaaaaaatatttgttgctatgtgactttaaaatgtatgtaaaactcaggtattcaccttttaaaattattgggcaataaggcaaacttatttagaaagaattcatatatatgaataaactagccttcttatttatagatgtactaattgagcaatattctgcattttatatatgcaagcttcttgtattaacttatgaaattttaatgatctatttttagctccttcctgctgataattgtattatggatgaatacaaacgagaaattgtggaagctaagcaaattgtaagaaaactcacaatggttgtgctgtcttctgaaaaacttgatgaacgagacaaagaaaaggacaaagatgatgagaaagttgagaaggtacatccctcaggccagcaagacttaccttgtttagaattatgacctttcatttctcatggttaatcaccttatggagtatgttctcttaattttgattatgtgcaatttgatttaggtattattcatttgaactttaatatgaatgataccttcataaagaaaactctttttcttatgaatttcaaaataaaagaaaaaaaaaatcacaaaatattgattttatttttctgtttatatactttctttttaatcctaaagggattctcaaagatgaatgaattctagtgtctcttgtatggtatagcattaagtccaacttaatttcatatttataaattataatgcatatgtatgttctaaatgggaaaatgcaacaacaacaagacaataaaacaaatgcccaaaagatcatattttgtttttcaagtcactgaaatttcaggcaattactgttaagtttcctaactttttttgatgtacagtattatgatacttaggtcaagttttaaagagaaatatctgtattccaaacatcattgtcatgtttgttcatttttagccaccggacaaccaaaagctgggtttgttggaagctttgttaaaagttggtgattggcagcatgcacagaacatcatggatcagatgcctccatactatgcagcttcacataaactaatagctcttgctatttgcaagctcattcacataaccgttgagcctctctaccgaaggtttgttattctacactaagcattaagatacaaatagtttcaggttactaaaaagagttgtgtattactatctttgatctttaaatctagtatctgttactatattttttcaaaacataagaactattcacagggtatgtcagtcatgtgtgcatgacttctgtcctaatttcccagtcttctagaatgtgtgctgcaaaatatgaaaactccaagttaagtttctggagcctgtttgcattattgagagtgaaaatacctttcttctgattttgcctttcttcttgggaagcagaaagtttcccctttaaaaattagccttagttccctattcccatttttctattctggtgttaatggttctgactgaagacattaccattctgacaggctgccttttgggggaaattactagtttaattccttttatcctgaatgtgtcaactagtcctgttgacatcagcctatttgtagagtgcttaggagcagcattagcagcagctgtggcttgaacttcatagattagagcctgcttcaaaagccacaaccttcttgacttgtgtgtagctgctgctttcattgtaacctagggtgtagacagtgcaggcctcttctcaaagatagagccctgagacttaaagtaagacctctacttactctacatgagaaacctctgggcatgctgtcctttctactaggacaacttggattggatggttagcttgcctgctactgcttcctcatactcagtataggaaaacagtagatcctagattgagacatgtttgatttcatcttgtcatacatctgatgtccatgccgtattctccattcctataaccgcaggctctgtgttggtcaagcttaacttaaactcatattcaatgttacttgagatctacaccaagagttcctttatgttgctagtttgaaccattgtctttttgagttttgctttcatgcttactgaatttatttttgtgttttgccagctgagaattatttactgtaataaagtgagtgatgattagaatagttaaagcaaatatgaacaagaaaatgattgtgtcttatattggagacttatatatatatagtgcatagatttctaaatcttgctttttttttaaatagagttggtgttcctaaaggtgctaagggctcaccggttagcgctttgcaaaacaagagagcaccgaagcaagtagagagctttgaagatttgaggagggatgtattcaatatgttctgttaccttggtcctcacctctcacatgatcccattttatttgcaaaagtcgtgcgcataggcaagtcatttatgaaggaggtcagtaaggtttttcttcctagtagaaaattaaaaattgaaatgaaatgttgtgaatatgttttcctgagtatttctagaaacaaacaagcaaaaagtaaacatgagttaaggaaagttgtgttgagtaaactcatttatggaaagccctttgtgtctcaatggtgattatgtctatgtatcaaaaccccagatctaggtatacgattcaagtacctcccttgagaaactctttgcttgatttccattgtaacttgcacttgtgcttactcttcttttcccttacctgtcttctatggattttctttcatgcagttttgagtcattattaaatgtttggatgctttccaacttcaaacagtgcaggattattattgtattctttacgtattttgggaataaggattgagcttggggcattgtgtgtttgtatgtgctctactttggagctatgattccagctcatttttctttataagtaaagtttttattggaattaattatgtgacagaaaaatatataaatgctgaatatacagttcagtgacctttttaaaactaaacactcatgtgtctaccacctaaattaaaccaagaaattgaatagtaccagtagtggtgctacctcatttgtaaccacttagactatttcaaaagtctgtggtgtagaatgttcatttgctagaacatctccagccttagatgcttaattttcaacttctgataaattgtctgtctgtctgtctatctgtctgtctgtctgtctgtctgtctctctctctctagtttatacccattgccataatcaccataaataattactagactattttcatcatacttgctgttaacttctgccacttctgtcactttcccctgtgttgctgctttctgtcactataattttgctttttctatgatctcatataaatagaattatatgttcactcttctgatttctttcacttcatggttttagactcattcaagttattgcatgtgttagtagtcctttgctgagtaataatatcgcactatatggaaacatagagtccttgatacatttgtcaggtgatgaatatttaggttatttctgtgagtagctagctatacttttgggaggcatgtttttgtgttgtcagaagtgggattgattagtgaaatacataagtataactgcaaaattgttggatgttgtgatacatacttttaagctcaggactcaggaggcagatgcagtcaggtctctaatgcgagttatgagtttgtggtcaggccagccaagcctacatagttaaacactctcttaaaacagaaaaaaagattgtaaaaactgtttgacagtgttggcaatgtttatagtattttatatttttgagaacaattatttgagacttctagatgctctacaccctcactgacacatggtattgtaatacttaaatttttgttatcttaatgagttgtggtatcttattgtgggtctatttcttgtcatgctaatgactaatgatgttgagtatcttttcatatgtttatttgctacttataattatttttagtgacgtttgttcatatcttgtccatttttgatatgactatcttttttatatgtctttgtatattgttatttctaaggccttgaccatatagttagtttttgaaaaagtctttcagtctggtttgatgtttcagttttaaactgtcttttataaaattacgtgtatgtgtgtgtgtgggggggtggggggtggggtagtaggaggtttgtgcaagtgggcacaggtgccaggagagatcccttggagctgtagttacaggtggttgtgaaccaaactcctctcctctggaagagtagagactattgaactatctctgtgacatcttaaacatcccttatatgcacatacccccacacagactcatacaactaaagataataaacaaacacctttttaaaaggaaaaattacatcttaataatttcagtttattaatatttactttgaaatttttcgttttgtactcccatgaaaattttcctcaacccaatgctttcaagctgcaaagaattcataatttctttttagttataaaacagaactacaaaacaatatttagaaacatgtatgagcacctatatacatatattgtttggtgattacatttttaatcttagacaatactagctgtatggaaaaactaaaaacagctcttgttatgaatcttatatgatacctgaaatatttgacttggctttcaatacttattagctggtagattattttctctttttttcaatttttattagatattttcttcatttacatttcaaatactatcctgaaagtcccctataccctcccctcaccctgctcccttacccagccactcccacttcttggccctggcgttcccttgtactggggcatataaagtttgcaagacctaggggcctctcttcccaccatcttctgctacatatgcagctagagacacgagctctggggccactggttagttcatattgttgttccacctatagggttgcaggccccttcagctccttgggtactttctctagctcctccattgggggccctgagatccatccaatagctgacaatgagcatccacttctgtatttgccagtcagggtcctttcatcaaaatctttctggcatatgcaatagtgtctgcgtttggtggctgattatgggatagatccccgagtggggcagtctctggatggtccatcctttcgtctccgctccaaactttgtctctgtaactccttccatgggtattttgttcgctgttctaaggaggaatgaagtatccacatgttggtcttccttcttgaatttcttgtgttttgcaaattgtatcttgggtattctaagtttctgggctaatatccacttatcagtgagtgcatatcatgtgtgttcttttgtgattgggttacatactcaggatgatatcctccagatccatccatttgcctaagaatttcataaatccattgtttttaatagctgagtagtactccattgtgtacatgtaccacattttctgtatccattcttctgttgagggacatctgtttttttcccagcttctggctattataaataaggctgctatgaacatagtggagcatgtgtccttattatcagttgggggcttactaaaatgcagattgtgacccctaacttcagtttctgatcaattggcctgggctagaaggtgaaaatttgcatttctaacatgttccctggtaatattgatgctgctggtccaaagaccagattgttcttctaatatagtaagtatatttgatcctcctttttgtgattagagggggtggcagtgactattaatctaaaatatgtaccaagagccactactatactttctgctccagcatcctgggcatttctgtccttaacatactgtgtgaagacaaaacctctatgaacagagaaacccccgagtgtaccgtacttcatgaaaggttcctcggtatcaggcttcttgagtgagaatgctgagattcccaaagaatgcacggcagttcatggagtgctgatggctcttttcctgttagcagcatatgtttctattgcctttcatgataagcttccttaggaagccaaaaaaaaaaaaaaaaaagctgaaaaacacctgtagcacatatatccactcagtcttgtttatttccaaaattcaagggcagaaaatagttctaattggacattgcgtgtgaaccggtcagaggagttattcatatagaagcaaatatttatgtattcatttttattagcatacaaagaaggaggtttattatagtattttaaaaacaatttgtttctgttttttttcctgttcattgaaattatagattttttccctcacacaatatatcgtgattggggtttccctgattctcctcctaatcccccctcagccccctcccattcacatctgcctctttctctcattagaaaacaaaaggcttctacgggacactagtaatacagaataaaatgtgataaaacaaaaactacacataagtattagaccaaacaaacagaaggaaagagcccaagagaaggcacatgaaagagacacactcacttgtactctcaggaatctcataaaacactaaagtagaagtgataatatatctgcaaaggacttggagcagacccatacatgctgtttcagtctctctgagttcatatgagcattgatatgttgatttagagggccttgttttcatggtgtcttgcatcccctctgtgtcttacactccttttgcctcttcttctgcagggtttcctgagccttgaggggagggatttgttataggcattgcttttagcactgagtattctaagctctcccactctgtgtataatgtgtgactgtgggactctgtctctgttcccatccattgcaggaagaagcatctctgatgatggccgaaaaggccgttgaggatagcagagtatagctattaggagtcatttttattgctttttttttttttttaataaaagcccagtagtatttggttttcccccaagtctctgaactatctatctagtctctggttcttcatcacccaagcagtgttgggtatgggttccattgtactagcgtatcttacatgcaggacactgttgtatacccaaagttttgtgactgggatggtggttgtttttcttttggtagtgtacagattatattcttgtactaaagacactaaaatgtagaggtgaaggctctatttaggtactagtttgacttctccatgttgagtgagttgtgtagatatttcttttagcagtgagggcttactgtcgatttgtggagaacaacctatattctttgacaacagcctgggtcatttggggatttttatgggaccctaaaggacaattggatgtaacccagtcccagcactggaagttcatttggcaagaaatggccgtttgtgactctgtctacttcattatttggctatttcatttagattacccccaaatatgtacatattttacaaagcttctactgtattagggttctatactgcctctcaaatgacccttaattttagctgtttctccccatattccttccctcattccccctcccatcctgagttgatcctttttttttttagctccccccattcatccataattatctgttctatttctatttcctagtgagagctgtctgtcccaaatccgttcctctatacccaacctctgtggttctatagattgcagcttggttaccattgacttaacagctaatagccacatataagtggatacataccatatttgtctttctgggtgtgggatacctccctcaggatgactcttttctacccatttacctctagaatttattattttatttttaatggctgattaatactccattgtgtaagtgtaccatatattctttgtctactaatttgttgaaggaaatggaagttgtttctgtttttttttttgctattatgaatagagcaacagtgaacatggttgagcaaatgtctctgcagtaggatgaagagtcctttgagtatgtgcctaaaggtggtatagctggatcttgaggtagatacccttcttcctgtttgccccctgccccatgttctttacttcctttctgaagaaacagactttttatgacatttattttgtgtttgtgtgtgcataagcgtgtatgccacaggactgtatggaggtcagaggaaaactcgtgggagttagttctctccttccactatgtaggttaaaccatggattaaaccaagattatcagctttgatgacaaacacctctacctaataagccacttcaccagcccaagaatattttaaaaacaactaaacctttcattatagttatttccaagttgatacttatcttcaaatagatgcttgttgttgataccatttgttgtacctcctactgtatttttgctgttgtaataattttatacaaactcagagttagagaccaagttctgtttgttttttttttgtcattttgagattttatttttgtatacttttgggtgttttgcctgcatgcatctctatgcatcatgtttatgcagtgctcacagaggccagaagaagagattggatctcttgctaccagtattaaagatgtttgtgaggtaccatatgtcctgggatttgaacccaggtcctttgttagagcagctaatactcttaactactgagtcatctctccccaagttttttgtttgtttgttctcttttttccttttttgtttatgttttatttattttggtgaggcagcatttcactgtatatccctggctgtcctggagcttagagaccaggttggtcttgaactcatggagatgtgaatcctttgcctcaaaagtgctgaaatgtacacaactacacatgaagagagcaaatttaatgtaaaacagttccgcttttcaatgatcctgatcagggagaactactgaaatatttatatttacattgtcatttataatagttggtttgaagctcacctcatttccttcatgtgacagtgttcagatatatttagagactggattacaaaccaaactttatgtaccatttttgttcagcattaaggttattgaggaggggagcagggtgggggcatcagtccttcttggctacaaccaagtatgtcttcatggctgccagcaagtagttcagctcttcttcctttcccttggtgcagatgtgctagcccacccttttcttgatgaacttgaggtagtgcttgttcttgaacaccttgaacatctccttgagccacttgtcagttgtgaagccgtacacttcctggatcatgtcccacatgaacttggtgtgctgtacctcgatttgctgatgttcttcagtatgttgtggccgttgttgaagcaatgggcttgctagagggatgggatagggaatgggttcgggggagggctttggctgctgctctctgatggcaaccaggataggaagcttatgtagcaggtttttttttaaatctattaattttttattaggtattttcttcatttacatttcaaatgctatcccaaaagtcccccatactttcgacccacccactcccacttcttggccctggtattcccctgtactgaggcatataaagtttgcaagaccaaggggcctctcttcccagtaatggccgagtaggctatcttctgctattatgtagcagttttaaccttagctatacttcctaggttcagatactaagtaccaataggcaaatggcaattctatatgaatggtgtgtaacttagtttttaggagacttgttttactaagagtgggacttcaggtacaaagtcaattatatccttcctaaacgtacatttccatataagaaaaaggtagataatatttttaacccttgctacatcttccaataaataagtttgtagatttgagtatgggtgcttgcatgtgtgtgcatgtgtgcctgtgtatgtgcgtacgtgctggcactgcgtgtgctcaggtgcccgaaaagccagagatgatatcagatcccctggaactggagttctaatgaattgtgagccactgtgtagatgctagaaattgaacctagaccctctgcaagagcagcaagtgctcttaactgctgagccattgctccagccttcaagtacttgttttgggacaacaatctttgaagttaatttcaagaaagaacaattccaaatgtaaagaactgaagtaacatttgaaaatatttgtgatactgctgacctgtgagaagctgtgttttgtttgtttgtttgtttgtttttgttgttttttaaagctcaggacatagcaaatgctgtcatatactattttgttccatcaagtagttatagttagcatgagatctgatttcctcactgattattcctgggatccagtgctatacacataaggtaggaattgccagggaactattatcatagtccatttcctcagctttttaaaaaatatacttatgctgtgtgtatgcctgtgcatgtatgtatacatttacataccacagagcacatgtgtagatcagagaatacctgatctcggggtctgttctttccttccactctgcgggttctggggaatcaatgtcaagtcattagctctgtttgcaggcgttttcacaatacgccatctcataggacctctgctcagatttcagccaatgaaagacaagaatcgattgtcttaaacacatttctagagactcggaacctgttgtggtattgaacctttttaatccacatggccagttttctattgctgcttcttaggattacatgcctaggaaatccaaacgaaaatgtaagagtgcgtttctttaaatagatttaatggttaagccataatttgttcaaaagttatatgcacatgttattttttgtttatgatggaaactatttaaatgtagccatatctagtgctggaaaaatgtgaaagaatttcccggtgtcatcaccattcctgtaactctctttctatatgagttagtttttttttttttttttttgtctccacccccatcgagttaggtatatcttttagtatagaataaaatttatttaggagcatgggaaggggcgttgagaagggagtagaggcaagaaagagaagggacagtgaaggatgggggaggggggcctgccaggaacatatggagtgggggagaggaagtggaggagggagaaagggctcggagagaagagagtcagagagatggggaagggacagagcaagttagatttttaaactccaaattattcttattttatcttgataattagcctgggcttgttttgaactcaaaattctcgttcctctagatcactggattccagacatatgccacttccctcagaatttctaaattattttattttacttttacttgattattttaaaaagtctggatttatgtgtgtgggtgttttggctccacttatgtctatgtagcatatgtgtgcaatgtctgcagaggccagaagtaggcgttggattccctggaattgaagttatagatagtaactgtaacaggagttatagctagctgcctcatggatgctgggaatcagacctggggtcctctagaagaacagtcagtacttttttaactgttataccatctctctaggtcagtgcagaaggattttaatgggacctgctttggatcctctctagcaaaaatgtttttcatagaatagttttgaggcatatttgaggtagttttaaatctaatataccatacctacgaaatacttaataatttggtacttagtataaagaatatgcaagtaaaaatagtaccataattttttacagacattttagtcaaaaatcttaagtgtttttttcctcagaggtactgtatagtcttaagcagcatttgaaatattcgtgggttaaaggcactgaattagttcattagtcataagaagctgtttgtttagtattgtctataattccttctttatttcccaactctctcaagactgtcttgatgaaatacctatcactattaatttttggtgctgaatattgttgtatagtgccatcatccgcactgcctttctagagtgatattggaacctcttagttcattttgatgatggcctttgtaaacatagctaagtgctgttttacttaaatttaaaattcaaatgctgaaagtacttcagagttgtcacctcaaagatgggagggaactgtgtcttctttctgttcaaaaggtcagtgcatggcacttggtaaacaacgaccccttggacctacttccatgtgtctctctcctttttgagtgtggtgttcatggtggcattgagcagtctatgttacccctgacctaaaaatgaagtaaactaaaagaaaaagaagctataaatgctgcagaatatgtttatctttaaaaatttgctttttgattggcatgcccccctgattatttctgtttaatccttgttgtcgtcagtgtttgatagtaaggtttactgttcttctagggagctttgttttcttttccatattaaaacaaatctcttttgcttatgaaatattatggacatttgcaactcacttgagttactcaggaaagcaaaacagctaagtaagttactgtgaaaatttggctcgtttaaatcctggtatagtaggaaaaggggtagcctaactgccttaaatggtaatacacaacaaagcctagtttgtcccatttctgccccctgttatacattatatgttacctgaattaccagttctttatcacaaagaaaacagcaacaaacaatagctgttacatttttttttcttccaggccactcttctataattgaattccttatttgctgtcagaatacatgttgactcagctgtagctgtaaaagaaccatattttcttgaacctgccaattagaaaaagaaaatatgttgttatgcatctcgaattaattgttaggtaaaatgaagcacttagatgccttaataacctactcagaagcatacagaatgtgtgtggttgcgtcctagctgtctccttcccatgcatgagtattgaactaggcctttccttcatgtctagattgtccttagatatcagttctttgtacttttggttttctacctttatacacatatacacgtataggcaccactaactttgtttgtttgtttgagacaaagatcctctgtgtagctctagctgccttggaactcactatgtacagacaaggctgatgtcagtctatcagaggtctgccttccaagtgctgagattaaaggagtgagccactttgcttacctttcagagtattgttgttaagtgactacacagtgttgtcaaacaagtcacttcaaggttcagcctgcattgggatagtacagacccaggatgtgatttttctttgtcagcagtgtcctgaatattttggacttactttttgttgagtgctttggtaaggttgaattataatgcaactaaagttcatttccatagttttgacttttggttacattagtattttattttattttattgattttttgcaaaacatcagttatctgggccatggccattggaaaatacatatttccaatggtcttaggaactttgataccacttagtagcaaaattacagttatggagtagcaacaaaaatcattttatggttgggggtcactacaatccaaggaagagttgcagcattaaggaggttgagaaggacttggattgaaaatacattagaactaaatgaccaggatggttacagtttcattaagtttatttattaataggagttttaggaagctttggtttataaggagaaaaaaattggcacttaaaattgataacttagggttagagatgtagatcagctgacagaatgcttgcctagtgaatcaagcccccggcttgactttcagtggtggcacacatttgtaatccaagactaagttcaaggtcaacctggactagatttggaaaccagccaggactacatgagatacccttcccgcccccctgtgtttgtgtgtgtgtctctgtctctctctcctcccttcccttctccctcccccctctctttctcaaacaaatacacacacgcgcacacacacatgcaggaataacacccttccctggatttatacttgaaatttatggaattttaaatttagaggttaaaaatatacatggaaatttgaaatacttatatttagtgataagttatttgaaatatacatgtctgtaaaaggcaaacaactaagtaatatataacttttttcagattataaactaaggcagtgatcaactttctaacatattattgttttaaattttagtttcagtctgatggaagcaaacaggaagataaagagaaaacggtaagagactgaaaaaaattaaataatgggtgtgtttgtcaggatatagcatgccaaatattttactgtgaacaagacttagctacccttagaaatagttattttatactttacatgctcagtacagcatttggcaactcattgaacattttctttgaagattaatatcctctttttgaaaattccatgtgtaaaaaggttaagcctctcattgcctagttaccttctctgcttcttttacttcatttgctatcttaggtaaagaaaaggcaatgatagggtgaggagtgtgtgtgtgtgtgtgtgtgtgtgtgtgtatgatttaaaaatgataattcttttaaggcatctctattttgggtgtattgaaataaacctaatgaaataatttttttgttttctttttaggaagttatccttagctgtttgcttagcattactgaccaggtattacttccatctctttctttgatggactgcaatgcttgcatgtctgaggagctgtggggaatgtttaagacatttccctatcagcataggtaaatacttattcagattgttcactccaattaattctagtatattaacttctaagcatttaatattttctaaattttcatctcattttcttaaagatatcgactatatggtcagtggaagaatgaaacttataatggtcacccacttttagtaaaagttaaagctcaaacaatagacagagccaagtatatcatgaagtaagtttaatttttttcatacttacctcaaatatgtctggatataatttactgtctttcagctattttgtttagactgccagttttgagaaagattataaatacttagaggtatagttgattacatattgcagttagaatgagttttttatgttttatttttataatttttaggtttatataagtgtatgggggataggagtaggtgtgtgcacgctatagtatgcgcatggaggtcagagtggtggggatgggctctctctacttcatgtttgtcccaggaatcaaactctgctcacaagattgatagtcatgccgctttcttataaagttatttgaagcttatgaaaattgtatatttcatgcaattattagtctagatactaaaaactcttctatttgttttcaacaaggattttgtcagttgtccaacattttataaatccatttacagttattctaattaaagttacattttctttggtttcactaagtataatagtttgaagtgatactgtgtttgcccagtgacattgtctttggacattggctattgggaaaacaggcatgaacatggtcatagtttggcttataatgaggtgtgacaatagacagaatgaaatatctaattaagttaataggggaagaaattattgctggagaggctattcagtttgatgaacccaagaaagttttagcttcagaagcctatagatacagtatcgtttttttttttttttttttttttttaaagcacactggacgatcatagttagcacttggcagacttcttatttatttacttagatttatttattaattttatgttatgtgagtaaactgttgctctcttcagacacaccagaagagggtatcagatcccattacagatggttgtgagccaccatgtggttgctgggatttgaactcagaatctctggaagagcagtcagtgcttttaactgctgaaccatctctccagccctgaatttacagccatccctctgacttgtggaagtcagatcaggttttgtctatatatctgcatatacatatgatcaggtcattcatatatgcacacatacactatttgtgctaggcgctgagttgaatgctttttaaaaataatacttaatactaattttcttgattctctttactctgtaagcacaaccttaattcttttatctggaatagtatagtaacttgaattattttcttatttcaaaatctccccaccttttgttttttgttttggctttatggcatggtgctgtgagagatactccttgatctttcctactgtatagcctacctcatttccttcctaatgatgacactttaagctctactgaacttacttgtttcctgaaatacaccatgctctccttagccttacttcctttgtatgtgttttttgcttcctttatttgtacaaattttcccttatcttgcctttccttctccatctggtgattcatcttagaaagtgtgcatgagtgccagctctccgaagcctccacaggacatactgacaaacaaagttgatttgtgccaccagtacactttaggcaaattatgctagcattccacttgtgcacattactatgatagtgttcctttttgtaagtatataaaatcagcagatgaatgaatatactgattctacatataaatgtcattatatagcagttctttctattcccagcttagttcaggtaccacggtgttctccagttttgtccatgttgtgaatgacagaatttccttttttgtttgtttgtttttatttttattttttatttttatttttttggtttttcgacacagggtttctctgtgtatccctggttgtcctggaactcactctgtagaccaggctggcctcaaactcagaaatccgcctgcctctgcctcccaagtactgggattaaaggcatgcaccactaacacccagctcttgttttattttttattgtccggtttttcaagacagggtttctctgtgtagccctggctgtcctggaactcactctgtagaccaggctggcctcaaactcagaaatccgcctgcctctgcctcccaagtactgggattaaaggcatgcaccactaacacccagctcttgttttattttttattgtccggtttttcaagacagggtttctctgtgtagccctggctgtcctggaactcactctgtagaccaggttggcctaatttgctttttttaaagtgaaaaaggacactagtaggagaattattggggaaaagagggatttgaaggaaaggagaaatgttgatcaaaggatgcaagattttacttagatttaagaaataaattttacttacatattatactttgtggtgaccatagtcaacaataataatgcctattgcaaaatttcctgaagactaccttttaaagattcatattacaataaaaagtaagtattgagatgaaaaagtcataatttgcttgacagatttattctataatgcctatatagattaaaaacatcacattgtgctcttataaagtatacacgtttttaaaaaggtgtatgtcccgttcttcacacactcagttctctcccagagaagaaaagtaaagtaaccagtatttacattcttatttatcctcccaagggtgtatataaggcaatgtagatatattatttatactttttaaaaaaaagatttatttattattatacataaattcactgtagctgtcttcagatgcaccagaagagggcgtcagatctcattacagatggttgtgagccaccatgtggtttctgggaattgaactcaggacctttggaagagcagtcagtgctcttaacctctgagccatctctccagccctatttatactttgaatgttattgattaaatataagtgctgttctgaaacttgatacctttttagaaagcaaatttgtcaggaatggtaaggtacttctgtagtccttgtacttgggaagctgaggcaggcggtgatgactctggccctgtctttactacctgagacgagactgggtcagaaaaagcaacagacagacaaacagacaaggtaaaaacagaaattctaaaaatacggttttaaatttgtgtctttagttaggccaggcttgagagcaagaactgctcttcatttttatgttcttaatgcctagtgttttgtcatagtaagcattaatatgaatgaatgcgtacatgaatgcatatttttatttagtgtagaataatatgtgtagaattttttttaatatacttgggtttttgttacattttagctgtagctcagctgttgcaccaaacttcatgaatttactacaactttttacattgacagtggaatattttaggatattatttgtataattttataatttttcaagtcattcattcttcaaatgctcactgattgtgttttatatgtctgacattctggtagcttgaaggtaggacactgtctggagaatatttgtttaattttgcttattctcgcttcagggtagtgaagagaaatggaatagaataaaacgtgtacagttttgtgtgactgaggcgagtaggagagccacctggtgcacgcttcgaaatagggaagggtggtgctaagttgaaggccgaggtggctatggtttccgatgtaaaaccaatggtctcttttctccatcagcagggaacaggagaaactgagctctaggaaaccagaaggggaagcagctgatgattacaccattttaattctcacaagacgcttcggaacatagttatattattactttacaaatggttgcagtccttgaattacaaatggaacttcattatttatttctaatgtttagtgctgttagatgtatattccttttagaaatgttctttcctttgttcacttgctgctgtttagagtctctgttatgtaaccatccccaaaacacttacgttaatctttagcagttcactgttacagagttttagaatcttagaaaacatatgctgatcacagaagaaataaaaaaaatgaaagaaatgtaatttattgattttaaaaattgtgtatcttgaataagaaaatgagagaactaatttctgaactgataaatgaaaccttgtaaatctaaaatacgtatgaatctttttaaaaagttttcatgtatttatacagtaaaataagttttactcttagtagataactagcatttaaactctgaaattccctaagagagtccaccttttgctacagagtggatgaaaatgcagttgtttgcatggatccatttgatgtatttgagttttccacatagtacagcaaagcttatcagcatcctgagtaattgtacttaatactgagccttggcatttctctccctttgtaggcgtctaaccaaggaaaatgtgaagccttcaggaagacaaattggcaagctgagccacagcaatccaacaattttgtttgattatgtatgttttgaagttaatattattttaagagatttcccttttgattgtctttatatcagtacaggtggaaatgaagtaaaatttaaaatgttagaaaacagcagatgaaataccactttatagtaaaaacaaaacttttcatatacagtatttcacaaattgatctgttttctagtaatgtacaacagaactattgttaaacatttgaataccatttcactttgattcccttttagcagtgttaccttctttttaacattatcattgttgaaattttcatacagtatattttgatcatatttcccctcccacaagtcttcccatatcctatctactttcctagttaccaaaccccatgttttctctttcacttggaaaagcaaacaaacaacaaagacagaaattaggtacccaggggctggggtgggggaaagcacagagtccattttagaaagactctaaataacatttaaaacaggactagccattactattacaaaatacaagtttagacctcttggaatcgtttcctaggtagaaaatgtagccttgggaaaatactctatatagcaatgataatgtaattttttttttgtaaaatgttttatatagatgcaaaccagagaaactttgttttcaagacagggtttctctgtatatccctggttgatcttgaactcgctctatagaccaggctggcctcaaactcacagaaattctcctgcttctgcttcccaagtgctggagctgaagtctgcctggctggaaccactttaattttattatttctaattttagagaagtatgaaccttacttagcatagaagtttttttatttatttaatgcaacttactctttcttgatcttccagatcttgtcacaaatccagaaatacgataacttaataacacctgtagtagattcattgaaatacctcacttcgttgaattatgatgtcttggcctgtatcctttcatgtggagcaaaatatagatttcatgtgtccctttatttaattgctgaatgattaatttttctctgactttctttagtaatgatctaaagttggtctaattggctgatctgttgtcagcccaaagtattgaaaaggaaattgtgtatgtgtgcatgtgtatgcatgcacatatgttagtgctttgtgttgtataaagggagagacactcactttatcaagcatgttgatacaggtggaatgttacttgttaggagatgggaaagagggttgataaataatgagtatatggtagctattttcattcctctctgaagatgtgggggtttaagggtctttattactgatgttctggtattttttttcttaatgtatgaaagattgtatcattgaagctttagctaatccagaaaaggaaagaatgaaacatgatgacacaaccatctcaagctggcttcagagtaagtactttcacttttctcaggatggtagtactagtagagactaaggaggtggcaactgccaggctttctttacctgcctatgctttcaggcttgtaagtgcttatttctcaagagctcttgacagtatctagccactaagcttgttctgcaaagtgtcagagaccttgggtctgtatggagattttattaagtacttactaattttctttactgaagagactattttattttactatgatagaatttgaggaagttgtctctggccataccaccctggacttgttgagtatcatctgatctgggaagtttagtgcaattggtctgggttagtatgtaaataggagaatttggggaaacatttggaagctgacattcactttctttctaacttactgttatttagaaattacactctttccttgtctaatgtatatgaatctgaatttcccactgtacttaaggtccttaagtcagaacttaaagtttggtctaattatttacataattagcaaataacttaagtattatagatgattagataatcttcctctagtcttcacttcctttccaggaaataatagggactattggttaaaattggtcttctaaggttggcaagagggctcaatatttaaaagcgttgactggtcttctagaggactctggttttagtcccagaacttatgtggtcactcaaccctttttaaccccagttctggggaatctgacacccttttctgatcttggtgggcactaggcatatacaagctacataaatgttcatataggcaagacacccatacatactacaaaaaagcattctgcttctagcaaaattacctgtttcttttgctttgtacaactgtagtatgttcctagatataaataataatttatgactcaaaactttttaggggtgggcatttagttgtttgagtttacttggtattctgtgtggttgagtcctaattggtcagggtgcatagtttgaatcactgctttagtttatattgtgccttggagcaagtcatgcgacccttttttcccccaatttacctcatcagtaggtttatactaacctaagtcagttattgatataattaatcaatgtaatgtgcttgcttatgtatgcttaataagtattacctattactgtggtaaaagtccattcaattgtacagtcaaatgtacagggctggagagacggctctggttaagagcactggctgctcttcaagaagacccagtttcccagcactcacatggcagctcatggtcatgtgcagcacctgttcaggggatctaatacccttttctagctcttccttaggcacttggtaatgaacatggtacacatatgtccatgtaggcaaaaatgtatacacatgaaataaaaataaaaatgttttaagaaattattcatacctcattttgctttagaaattgaatttaatgaaattatacttactatatttttgtctgataaactatttttgtttttgatttcatgtaggtctggctagtttctgtggtgcagtattccgtaaatacccgattgatcttgctggtcttcttcagtatgtagccaatcaattaaaggcaggcaaaaggtaaattatatggaaatgaacttcaataactcaagcacttctggtggttttgaaatgttgagattactgttattttgaaagacacatagattcaacttaaagactcacacacacgggggggggggagggagagagagagagagagagagagagagagagagagagagagagagagagagagagagagagagagagagagagagccatgtgccatcctggaactcacaatgagatccaggctggccttgaactcaaggagacccacctgcctgcctctgtctcctgagtgccaccatgcccatatacaggaaaaatactttttgaatatgaatttgatatgtaagatttatgtacatctttgtaaatgctgaagtttattctgggccagtggcagtgcttaggttttggataaatagatttgttaaacattagtactagtagattgattataatcaaatattttaggtgtgctgtgaggtagatcatcaaggcttaagggtgtgtggggcaacagatttttcagcaagaaacgaagaggatgcctgcctgcctgcctgcctgcctgcctgcctgcctgcctgcctgcctgcctccctccctccctccctccctccctccctccctccctccctccctccctccctccttgtctgtgtgtttgtctgtgtttgtgtgagatacaggtgcgggaaggagggtgtggagggagtgatgagagagaaagcaaaagagacacagagacagacagacaacgttctgtgacctgcctccttcagctagacttcacctaaagtttcaagaaccttccaaaatagtgccatcagattgggatcaagtccttaactcatgaactcttagagaacatttcttactaacaatcaaaacaggagagaggtagaggtggggtgtgtggaggaagtgaagggaagtacaaatgaaaactgaggaaaaatacatgaagcttgggtaagggagaaggaagatgttttcaataatttttatttttgtatcttattccaagcttcaaattaatccaggtaaaaataaatcaaagagaaacatgaaatatttttattgtaggtctagaatttatgtaacatttattttgaaaataagataaaaaaaaacaagccctgctgttgtctctcattccttcgtctaagtaaagattctcaggagactacttattatgtattattattttcatacttaaagttttaacttcaaatacttttcttttgattttatagtttaatttttgtatttctttaaaatcttgtattagttttgacctactaatattgaaagaagtggtacaaaaaatggcaggaattgaaattacagaggagatgacgatggagcagttagaagccatgactggtggggagcagctaaaggctgaggtaagtaaggacttattatttgtggctttgtctttcaagatgtcaattactcctgcttagccacaattcaaaattaaagagaaacatatccataagtagatgaattataatattttactttgagactcattttatatagaatgataaaaatttttgcccttcttgctcacttttggcacataagttatctttttggccatcgtatccacagtgtataagctactcttaagtcgtagaatagccatctttgtttccatattggctatgtggagagtagtcctggttctcagttggctatattgcaaaatgtttatatcaaagtaacctttgctcaaatttcccaattcttcatcactctgcctgtgttgtttcatatcattaagaatgtcaatgcagtgcagtaatatatttggggagtgaccatatttatgtaacttttattgtatcgttgagattgttgtattaattgctgttgctaatttttttctctttacttttttaattggttattttatttatttacgtttcaaatgttatccgcctccccagtttgccctccacaagcctcccaccccactccccgtgccgctgcttttatgagtgttccccgactttcctacccattcctgcctccccgccctagcattctcctacgctggggcattgagcctcccctcccattgagcctgacaaggccatcctctgctacatatgtggctggagccatgggtccctccatgtgtactctttggttggtggtttagtccccgagagctctgggggtgaggtctagttggttgctaatttcttactgtgcttaattaagctttgtcatggatctacaaaatatcgtttgtgtagagtttcgttccgtctacagttttcatttatccactgtgagttgtagaacataactgccacagataagtgtgtgatgatagtatagaacctaaacagtatctaattacccaaagctaaatgtcaaagtcatacatgttctcctcttaaaaccactgctaccttcttttgtaagagctgtgaaacactagtaattggaacttgaaaacacgcaaaagtataaaagacaataacttatttgtactgaaaagattttccttgatatttccactggaataaatctctatcacagtctactaaatcttttcactgaataaaaaaataatcctttgtgagattttaccaagtagaaaatggaaacaatgagttgcacaattgagctaccattagccagattatagtaaacagtagtatcattaaaactaatttgttaaggagaatgtttataggttatagaagtgctttattttatttggtgttgctttatattaagccaggcatgtcttcttcttattctgttttttaaagacagagtcctttctactcatttcaagctggactcaaacatgtgtagttgaggatggtcctgaacatgcaatcaccttgactctcttgcccatgtgaatggatgataacttctagctccgaaatattttaaagattatgcctcaattttcttgtgtgtcttttcccagtaagacagcatggaatacattgcatatagcaataatttttgtcttcttttatgcagggtggttatttcggccagatcagaaacactaaaaaatcttctcagagattaaaggatgcactactggaccatgatcttgctcttcctctctgtttgcttatggcacaacagagaaatggggtaatttttcaggagggtggagagaaacacttgaaacttgtggggaaactctatgaccaggtaagtgaaagaagcttgggtgttgaggaaaacttttttttaaatctcaataaaatagaaattgtgatgtcatttgaaacataccatttgtacacataatgtgaatgtctggcacctctaatgtcaaataggctttccttaaatagagcccctatttctgtgcatactattctatttacaagatgggtgtaggggatgttatatataaggtcttcagttaatgagacattccatcatgaaaggccatcatcagattgtttgccttctttttgatctttggaaatttgtaattttcattgcaccacagtagatactatatcttatttcttagtaataatattgctaatacgcaaacccattttgttggctagtaatgtttttgtggttaatattttttatcctttaaacaatgacagtcactgacttctcattgcatgcatacacacacacacacacacacacacacacacacacacacacacacacagttttataggattttaggcgagtgttctgagaggctcttgttgaactgtccttgactagcaactcaaaaggtggcttttcaacctagtgttaagtttctgtttcatagtctatggcttttaggagactcttatcaactcagaggggaaattttcatttacactatgttttaagcactgacatgtattaagagcatctttatgtaaataattgatagtgtgattccttgactcttttgacatcttcactgttatttgaccctcctcccctcttctgtatttcccttcctccccactcctgtaataaagattaccttgttttctccattgttcccttcaagtcagctgtctcctgttatttccctttccattgcctccctcaccatagtgttccctttgcacttttctggtttctatagttactacagtttttatactcacagctgaagatgtagtagtaggttatagatatgtatcactgttcttagagctcacatgttctctctcttcttttggagtccataaagaaaaatatatttgaccgattacaactatgtgaatatataatatttgttttaatttagaatttttatttgatacgtagtaattgtgtatgtttatagggtacattgtcataattcagtgcatgtatataatgtgtaaattataaaattgataatttctatcttcatcttttgaaacatttattattcctgttgacacaaattgctttaagccataggcagtctatgttggctgtctatcacttgagcttatgtctcctatagaaatgcactgtgttaccccagctcctgcatctctctgccctttccagcgacgctcgtcgcctctcagagctactcttctttttacttttgtgatggcaacatttttttagactttatgtacaagtgggaatatgtgaaaattatctttctacccttgtttatttcactgaacatagtgttcttcatttctgtccctgcctaaactattgaaatttggattctttttttttttttcattttttattaggtatttagctcatttacatttccaatgctataccaaaagtcccccatacccacacacccccaatcccctacacaatatgtactcactgataagtggatattagcccaaaacctaggatacacaagatataagatacaatttcctaaacacatgaaactcaagaaaaatgaagactgaagtgtggacactatgcccctccttagaagtgggaacaaaacacccttggaaggagttacagagacaaagtttggagctgagatgaaaggatggaccatgtagagacttccatatccagggatccaccccatattcagcatccaaacgctgacaccattgcatacactagcaagattttatcgaaaggacccagatgtagctgtctcttgtgagactatgccggggcctagcaaacacagaagtggatgctcacagtcagctaatggatggatcacagggctcccaatggaggagctagagaaagtagccaaggagctaaagggatctgcaaccctataggcggaacaacattatgaactaaccagtaccccggagctcttgactctagctgcatatgtatcaaaagatggcctagtcggccatcactggaaagagaggcccattggacacgcaaactttatatgccccagtacaggggaacgccagggccaaaaagggggagtgggtgggtaggagattgggggtgggtgggtatgggggacttttggtatagcattggaaatgtaaatgagctaaatacctaataaaaaatggaaaaaaatatagcattggaaatttggattcttaattgtcaattaaaattctgttaaaataacatatatcttaatcatttgagaaaggtttatgttggttttggaaaatgttaacatctgttttttgtgtttgtttgttttttgtcttattttttctttagtgtcatgacaccctagtacagtttggtggatttttagcatcaaatctaagtacagaagattatataaaacgagtgccttcaattgatgtgctctgtaatgagtttcatacaccacacgatgcagcattttttctgtctaggccaatgtatgcacaccatatttcggtaagtatgaatgtcttcattggtgttcaagagtaattctgaatgatttacacaaatatttgattttttaaatacacgctaatttgataaatacagattactctaattttctattactattcttgtctcagcagtaaacagtgaaatgttgttttacaggacaggtcttcctattactttctccatagtcaattcatagagacagacccagcatatcctccggtttgttaatttggagtctagcccttcagttcttctttttcttttttattctatagtttgtggcttccagtccaatttgtggagtgaaatcatttaattctatactgtgtgtggtatttactccagtcattggtcccgtctcttaaactaagttttcctttttatttcctataaaatttctgttatatagtgtgtagcagaagtatttagaaagacactaggggagaaatttgacattcatttgatcatgtaattgagaatactgttagtgtttacatatgaacaactgcttcagtcttacttgatttaatgaccacttcactggcgttatgcagcaattcctttcctgaatattctagagggttaataggaacaaaaatggattttaaactcctttaatgtctcccattccagagaattcactgctgtatgtagttaatgttttacattctcaccctaaccacatcaaaaaatctcatccatagaaacataggacctgattttttcaagaacctaggtagaagaaatgctttatctaagggatttcatatcatattttagtaatttgaaactggacaccctaatcagtaatgagtcctagcaaatgaatacctgattgtctgaaatattcctggtcaaaaaaatgacatatcttttgtgggatgaaagtgttttcttttaagagatatacaatctaatcaaagaaatggcattttcttctcagggtttaagaataaagaaatatatcgtggcatttatatactctaggcaataataaagtgctcccaacccacttcctatagggcacatgcctctttggaaagggaattcctcagcagcctaggatgcaattgaatgggcatccacactgctctaactttgtctcttaggtgaggtctttagtgagcttttgatgaatgagagagaatgtataagaaagtgatgagagggctggaggtatggtttacacagaatgctattctctggcttccacaggtagtcatatacatgtgtcacacacacacacacacacacacacacacacacacacacacacacacacacacacacggtggggggggcggggagagagagagacagagagagagagagagagagagagagagagagagagagagagagagagagagagagagaaagaatatgagaatgaatgaatcattttttaaagaatgagagaggaaatgggataactgcagattcccctcaggaaattggctactacaggccttcaatgaaacactgctcagattcttggcctgacagaaagctttttggacataaatcagtggtactatattattctctgtttgttggaagatgtaaacttaagggctggagagatggttcagaggttaagagcactgactgctcttccagaagtcctgagttcaattcccagcaactgcatggtggctcacaatcatctttgatgggatctgatgccctcttctggtgtgtctgaagatagctacagtgtattcatgtagaataaataaataaataaatcttttaaaaattaaaaaaagatataaacttaggtattagtttaatttaagagaaggaaaattagcattgtagatgaagtataaccatctttttgattaagcttagttttctgactagatactagtagcaggcctacaaactagattcatagattcaagaccagagagttgggaagatttcgtattattggtgctatttagttttctcataactataaggtaattttcacttttaattattgatactcaaatcttgaaacagatctaaaaggaaggttttccttgttctagctattctagacttttcccattcaggagtcagcttgtcatatgcaggtaattccagcactgttttatctcatgcctggtagagcattagcagatgtcatttcactcatctagattcatattagttaccttcagcaaaatctattttttaaatttaaaatccttttcacccccattcttagtctctgatagaattgttatactttcctgtagctaacgtttttgtagctttatcaattctatagtttgagtagttatcagcctgctctctagcatggctatcaaaataaataaagagttctacttctagaataattgcaagattcctggattttgcttgacataacattgaatgtagtagattgtacactttcagttgagtcagcttggatgaagcccagtcagtctcaaggcagctgagactattaccagtgtagaactcagaacctttgactgatgatcatcttggtatatacttaggataaactgaagtatttcaatgctttttctaatacgaagaagcagctggttgcaagacttctcttagattcaacttaaggatcatgcctgttttcttggcaagaggtctttcatcataaaatggctgaaagacatgagatagtgtattaattttctttgttgcatttagaaataattatgtcagtatctctgtactaatagattcatttttaccttatgtaactgaaaatatagtcttcctcccaattctctttctattaggacaaggcagtcaggacaaagaaactgtagcatcacttctcacatggtttcaatttaatttacttcaggtacttatggaaattttcatttggcttggcagtaggctacagtagctgattgctatgtctggaatgttgtcattttcagcattgaagtgttcattctgggacctctaagtctgtggcaaaactgtacatttagtttctgaggtagtcatctcagcgcctttttataacctttcttagtggcagtccaacttactgactgacacatgccctattggagatagtaggtcaacttttattgacaaaaactagttaagaacataaaattaagaattggaacagatttcaaaggtaatttatcttaaaataagtgcttttggtaagaaactagaattgccatgatcattttgtacaaatatatatgatatgttttaactttttatctacagtcaaaatacgatgaacttaaaaaatcagaaaagggaagtaaacagcaacataaagtccataaatacattacatcatgtgagatggtgatggctcctgtccatgaagcagtggtctccttacatgtttccaaagtctgggatgacatcagtcctcagttctatgctacattttggtcattgacaatgtatgaccttgcagttccacataccagctatgaaagagaagtcaataaacttaaagtccagatgaaagcgattgatgacaatcaggaaatggtaagttttgatgtagcgatgcaagtatagttgcgtcatttatgcagtattatccatattttgtaattattttagtttaagattcttccatcttgttcctctataatattttaaagttatttgatggtaacatctcaatggttggggcaggatcttaggaaatggttagaaatcatgattaaggaataaaagacatgcatgtcttttctactgaatactgccattgcagcgtaatgttttttgtgtggtttttgtttcaagaggagtaggaattcccaaagtattattattatcatcatccacaatatgtatatgtatgtgtatgtgtatgtgtatgtgtatgtgtatgtgtatgtgtatatgtatatgtatatgtatatgtatatgtatgcataatccagcaaacacagggagtagtatggggtttaaggagacttcctttactctacttgatgatgtatttaaaaagtcaggttggtaaaaaattaggcaggtattgaaagttggatagaataataaatatgatataattaaagaactaatttagataccttagctgtgaaataacaggtgtaaaaatggaactttaaagagattatgagagtaatatgaagagtgattttgctaggggggtgttatttagtctgaggttagagaccagctagctgcgtgtcatttagagtactttgttatgagatactgagaatataggctatgctagagacagtggcagtccatatggcttttaaacaagtaggctgtaggaatgaaggaaagctaaagataacttgatttttgcctcagatgtatactaccagggttaggaaggtaacctgttccgaaggtgtgtgaggactctgtgatactgatttggatgtgctgaatgggaagagaagtatacactcaggcatatctactggacaatcatgcctcaataatcatagagtataagcacttttctcttgacaattttatacatgaaaggagataatacagttagaaaactgactttactttgtagcctccaaataaaaagaaaaaagaaaaggagcgttgcactgcccttcaggacaagctccttgaagaagaaaagaagcagatggaacatgttcaaagagtacttcagagactgaaactagaaaaggacaactggcttttagcaagtaagttcttgggattgactattcctgctgctgctgctaaattgcaaaagcaaacatttctaactttggcagtgttcaagtgattatgcacatattctgctttagttactcattaccacagaatcaacctcatgtattcactgaagtgactgatgacagtttgctaacgaaataaaattagtttgtgtaaagataatactaatagcttaggatttaaattttctgtacagggtcatagtatagatactatatatctataatatgaacattatagataaatgtccacagagtagtaataggaatctttatcacctcatttgtggttttataacattgtgtacactacagttaaaatgttgtcatgtttggtagccttcaggcactttagggagaagataactgcttaatatgttcttttatttttagagtctaccaaaaatgagaccatcacaaaatttttacagctgtgtatatttcctcgatgcattttttcagcaattgatgctgtttattgtgctcgttttgttgaattggtacatcaacagaaaactccaaatttttccacacttctttgctatgatcgagtaagttcttatcacaaccttaaaaaaaatccacataaacacagctaagtactataaactctagaggcattatgtatacagtgaataacatgatcttaaaagccaagtttgtgaccttgaatcctaactctacttctttaaaactatatgtcttagggttctcattgctgtaaagagacaccatgaccaaggcaactcttatgaggacaacatttcattggtgctggcttagaggttcagaggttcagtccattatcatcatggcaggagcatggcagcatccaggcagtcatggtatagggactagggaaaactgagttctatatcttgatgtgaagactcctaggggaagactgacttccaggaagctaggaggagggtctcaaagcccactcccacagtaacacacctacttcaacagggcgacacctcctattagtaccacttcctgggccaaacatattcaaatcaccacactatatctttcacaaggtatttaacttctctgtgcctcagttttcttatctatagaaagggacttgctttgtaagattgatctgagggttaaatgtgttactatatataagaactccctgaaatggtatctttgcactcaaggttaacctattcactcaggctttgaatttaataaacttgtaacttcattagtggggcctttctctattctttaatttttgctcctcaaaataaaactaaaacaatcttctacccaaataaaagcctttatacatttacaccacatgaaagcagggaaattctttagtttcatattcatgaattttccatcttgcattttttcttatattaccattatttgtgggtttaaaatgtgtattatagtttgtttgctgcatatttctaaattttatcacctttacctttgcctactatctattcagtctcagtcatgaatgactaagtctccaagaagcattatgtaataaaatgataataatagccttttcttttatcattataaattagatttcttcaaaaaatatacttggattctttatgattgctatttttttttttttacagaatctagagttgccaaaaaataaaatctctgcaggtgtgaatataataggagaaagtacttttttttactaaatttatctgtatattgtgatatgctttaatatagtttttaatattttcagttagtttgattttttcgaacgtttcttctctaggttttttctgacataatttacacggttgcaagctgcactgaaaatgaagctagtcggtatgggagatttctttgctgtatgttagagacggtgaccaggtggcatagtgatagagccacatatgaaaaggtatataattaacaaatatgtttatattttacttgtatatgtattgtattacttgtattacttgtatatgtattgtatatgtatatatattgcttcagattggtcagttttaaaagaatttaagactcagctataaagtgatacttaaaatcataatatatcataaaaagtatgttttttattctatttcaacttgatatttcaagttattatcattgggtaagctgaaccattcttttacataaagagtcactgatctggtcttattctcctattttgtgggatgaattttacctctaaaaatgagaaacttatttttcttaggaatgtggaaactatccaggattccttaccatattacgggcaactggatttgatggtggaaataaagctgatcagttagattatgaaaattttcgacacgttgtccacaaatggcattacaaactaaccaaggtaaaatatagtagatatttttcaaagattttttttcctcttcaaacctgtattttatgataatcgttctttcaacatctgttataggcatcagtacattgccttgagacgggcgaatatactcacatcaggaatatattgattgtactaacaaaaatacttccttggtacccaaaagttttgaatctgggtcaggctttggagagaagagtgaataaaatatgccaagaagaaaaagagaagaggccagatctttatgcattggctatggggtaacacaattatattttaatgtaacttataacactagattacagaaggattctgaagatgtgaaaatgttttacaatgttgaagtcttatcttctgctttacttcaggagattatgggagattatgcgatcatgttcccacaggctggtgagagttgtcacttctgattatcaacttccggtctatactggatgatagtttcaaagaaatatatttcttgatggggggagatataatttttaatagttctcacatcttgagtaacaaaaagaaaaaggctctctagttaaagaattagtttaatttgaaagaatgactaagtttttagaacactctaaagaccttgaggaatatactgaaaagtggtactttattttctagaaccaagtggcagagtgaataatttgtaaaattttatttgattaaactccatatttatgtttttttttatttgtgtacgtgtatttaaacactttgtgcgactttcagctactcggggcagttgaaaagtagaaagtcacacatgatacctgaaaatgaatttcatcataaggatcctcctccaaggaatgctgttgccagtgtacaaaatgggcctggtggtgggacttcttcatcatctataggaaatgcatctaaatcagatgaaagcggtgctgaggagactggtacgcttgtttgtagacacttctaaataatgtatcgaaatattttattacatgataattacaatgctaaccccatattgcattttattccctagttatgagtatgtaactattaagaattaatcagcctcctgggccttcctaattatccacaaatcattttgctgtgaagtcagaatttgtatttagagttagctaacaaaaaccttgtttttatttcagataaatcaagggagagatctcagtgtggtacaaaagctgttaataaggcttctagtaccacaccaaaggggaattcaagcaatggaaatagtggctctaacaggtatgaacactgtgccatatgttacaattctaaaccctcgtgtgtgtgtgtgtgtgtgtgtgtgtgtgtgtgtgtgtgtgtgtacaccatgggtgtgtataccattcatgtatatgtaagtaagtagttgtgcatggttgccacaatgtgtgtggaggtctaacatcagatgttactccacaccttgtaccttgtttgaaattggatcccctttgctgcatatcctaggatagctagcctgtagactttgaaaggttctcttttctctgccttccattctaccgtaggagcactgggattacagatgaggtctattgtgcttgtttttaggtgggttctgagttaggtgggttttaggtgggttctgaggagttgaccttgcgttattatacttgcatggcaagtactttacaaacatagccatcttcctaactccagagttctctcctttaaaaaattatcttataagtgagcatacagagtaattgtggcatttccatatgtatgtctcattatacttcattctaatttgcccttacccccgtgacctcccttgctctcattgtctcttgctagtctccgccttctttccaaataatctcttttctgttcttaaatgacacatgtattctattatcttcctttctgcctcttgttcctcttttatgagaactgtttttctttcttggttccttttctactttcataatgtatatggtatttacatacttacatataggttctgcacatggtattttcctatttgagcctttctaatttcaagtactgtaaagatttcccggtgaatccatttccatcaaatgccatcatttcagttttcagtttggttgcatttcattttgtataaatcccatactttctttatccatgaatctgtcaatagataaataggctggctcaatttctttttttttttccccacagaaaattccatgattttattattcgtgcaatcctttcagtttcccccccccctttttttccattttttattaggtatttagctcatttacatttccaatgctataccaaaagccccccatacccacccccccactcccctacccatccactccccctttttggccctggcatttccctgtactgggacatataaagtttgcaagtccaatggatctctctttcaagtgatggcctattaggccatttcttgtgaatagtaaaacaattaacaaaaatgtaagtatctccatgttatgttgaattagagacttttgggtgtacccccaggagtggaacagctgagatattctattagtttttgagacacttgtatatatactgactgctatagtggttgtatgagttaacatttccactagcaagttataagtataacgttttacccacattctcaccaactttttttcttgtttattctcttgatgagagccattctgactggttaagagcggttttattttttatttctatggctaagatgttgaacacttttaaaagtatctattggacatttaattttatgacctgtttatgagttcattactagcctgtttattaggtgaattttggagaattatttgcaattctttttttattctttttttattagatattttcttcatttacatttcaaatgctatcccgaaagtcacctatacccttcccccgccctgctcccctacccacccactcccacttcttggccctggcattcctctgtactgtggcatataaagtttgcaagaccaaggggcctctcttcccagtgatggccgactaggccatcttttgatacatatgcagctagagtcaagagctccggggtactggttagttcataatgttgttccacatatagggttgcagatctctttagctccttgggagctttctctagcttctccattgagggccctgtgttccatcctatagatgactgtgagcatccacttctgtgtttgccaggccccagcataacctcacatgggacagttagatcagggtcccttcagcaaaatcttgctggcatatgcaatagtgtctgcgtttgatggctgattatgggatggatccctgagtggggcagtctctggatggtctatccttttgtctcagctccaaactttgtctcttaactccttccatggatattttgttcgctattctaaggaggaatgaagtatccacatgttggtcttccttcttgagtttcatatgttttgcaaattgtatcttgggtattctaagtctttgggctaatagccgcctatcagtgagtgcatatcatgtgagttcttttgtgattgggttacctcactcaggatgatatcctccagatccatccatttgcctaagaatttcataaatccattctttttaatagctgagtagtactccatcgtgtaaatgtaccacattttttgtatccattcctctgttgagggacatctgggttctttccagcttctggctattataaataaggctgctatgaacatagtggaacatgtgtccttattacatgttagagcatcttctggatatatgcccaggagagggattgcttgaattttggagaattatttgcaatccttgtcactctcctgtctgagacataatttgccaagctttccctcagtttgcatgctgtctattcactctgatgattgtttccttagctgtgtagaaacttaatatcaactctaacatcgaggtatttgatctttgaattgattttgagcagaatgagtactagagatctagtttcattcttttacatagcagtattcaggtttcccaatgctgtctgttgtatatactgccctttttccaatctatgttttgatacttctgttgaaatttaggtgagtgtagctgtgcacatttatttcttgcttcaatattctattccaatgatctccacttatccatgtttgttcctgttccactaccatgctgtttttgtccctatgaatcgctagtataatttgggatcagttattgagatacctcctagcattaccttttctgctgagtattgctttggccattccaggtcttttgtatttttttttcagttttaggtgtgtgcatgtgtacttatttgtgtgtgtgcatgcatggcctcctctctttctgtgtgtgtgtgtgtgtgtctgtctgtctgtctgtctgtctgtctgtctgtctctctgtgtgtgtatgtaattctgtaatgaagaatttcctttgaatattatagggattatgttgaatatatagattacattgggtaatagaactattttcacagtcatgattctcctaactcataagcatgggatttcatttttttttttaaattttattttcatggtccagtcagttttgctgtttaaaatttggtcattattgaaaatatttttttccatacagtatattctgattctgatttcccctccccatctcttcctagttcttcttcacctccctactcacccaaatctatgtcctttcttactcattagaaaacaaataggcatctaaaaattaataatgctgaaataagataaaattaaagcaatataagttgaataggacagtatcttcttcagttagtctctttttaattctctactctcttatttcctcaggacaattcctaagtattttgctttttgtaaagttattgtggatgatttcttcctcaacaatttaatctttagtaaatagagcttttaattttcatgttactttgtagcctgttaatttgtttaatgtgtttattagaaataaggactttctggtgtattcttctggacctttttaaggataggctcatgttacattttaaatagatatggtttgaagtttttctttcctattatctctttcagttcattttcttgtttactgctctagctaagattttgagtactataataaatgggttgagtctgattttgcctaaagtgcttttgaaggtttgttatatggtccctgtatttctagttcccttagggttttgttttttttttaattcatggaaggatgttgttatcagtgtttctctgcagttattggcataaaattgtgatttctaatcctgagtgtgtctatctactgtattatatttcttgaaccattctttcatgcctgaaatgaattgagtttggttatggtgcatgattttaatgtgttcttgagttctgtttacaagattttaagaagttttgcatcttgaactagagagactgctctgcaaggttaagaacactgactgcttttccacaggacccaggtttagttcccaaaacccatgtggcagctaacagtcatttgtaactctagttctaggggatctgataccttcttctggcctctgggcatcaggcatttatgtcatacacagacatacatacatacatacatgcaaggaaacatacattcgcataaaataaatgaaacatgaaaggttttttcaaggatttatttatttattttatgtatacgaatgcaccattgctctcttcagacacaccagaagagggcatcaaatcacattacagatggctgtgagcctccatgtggttgttgggaattgaattcaggacctctggaagagcactcgctactcttaagtgctgagccatctctccagcccaaaagttttttttttctttttctttttttagtttattaggcgaattgtccatagttttgttcttttactgtgtatttattcaatttggatgtatgggtaattactgccgtgaacagacaccatgaccaaggcaagtcttaaaaggacagcatttaattggggctggcttacaggttcagaggttcagtccattatcatcaagggggaaacagggcagcatccaggtaggcacagtgcaggaggaactgagagttctacatcttcatttgaaggctgcttgttgaatactcttttccaggcagctaagatgaggatcttaaagcccatgcccacaggtgacacactttttctaacaaggccacagccactccaacaaggccacacctccatatagtttcactccctgggctgaacatactcaaactactgcagtagtgttactttactttctattttatgaaacactgaggatctttggcattggcacttttagttgatctgaatggttctggctttctcttctgtcttgttgcttgttatggatctatttaaattgattgtattcccttgacttaattctgattgatcgtgtgtgtgtgtgtgtctgtgtgtgtgtatgaaaaaattttactcattttttctagatttttcgagttttcttccttgatgatactggatatcattggaattaacagtaaatttatccttttcatctctaatgtgtattaacttgagtcttctgttttgactagtttgcttagaccgttacaattttttatttaattttttcaaagaagtaagtctctaattggttgattttcaatattgtccttttagtccctgtttcagtaatttcttccctgacctcaattatttcttgttattagctgctttgtgattttctttgttcttgtttttttaagatatcattagactatttcagacttttgatttttttatgtaagtttttatagttagaattgccttagttgtatttgaagtagtatcgtatgttgtgctttaattttcatttgattcttggaattttaaaagtttctcctttatttcaactacccagtagtcagtcatgagtgtatttttcagtctccaagtacttgtgtaatttctcttgctattgatttctcttatagtctactatgatttaatgagatagaaaaaatcatttcagttctgtatttcttaagacgtagttgtggtcagaatcaagtctcttttagaaagcagcagcctatgggctgctgggaaggatgtgcattcagtttctgatggataaaatattctccagattatctgtaaagtccatttgctctttggtgtagtttaactttgcagtttctttgttgatttttagtctgaatggatatctaaagttgacattggaatgtcaaaatgatcactgttactatatcaacacctgtgtgactctatatgaacattaatgtttgtttttatgaaattcacaggtctaacattcagtgcatatgttttttgattgttacatattctttttttaagattcattttattttatgtatatgagtacactatagctgtcttcagacacatcaaaagagggcatcagattctaatacagatggttgcaaaccaccatgcggttgctgggacttgaactcaggacctccagaagagcagtcagtgctcttaaccgctgagccaattctccagcctaactattacatatttttaaagcattcatatatagctatattattaaactgttatcaaaaagttggattctactttgttagctactggaagagctatggcagcttgattttggctgatactcacttggtagattgacctctatctcttgaggctcactctgtggtatctctagcagtgatagatgtttcttggaaacaacaaaataattgtatctaatccagtcagccacattgcctttccttattggtaagttgaggtccctacttctaaggctacatctccctcatttagtcatacagactgacagaatgggattcctgtctatttttcacccacctgctattggtgtcattttttttccactgaaatctgtaagtagatttgatggtaatgagtgttatcactggagtaaaacttattccccttccctttttctatccctcttcccctcccccctccccgtgtgtgtgtgtgtgtgtgtgtgtgtgtgtgtgtgtgtgtgtgtgttagtgttagttaaactgtgaatggagtttactttttccttgggctcatcacctaccattttacctggaagttccctggattcttctttgtttatccgtgagtggaatggtaaatggtagtaatttagcagtacaatagtcatgtatgctagactttgaagttttgcttactcccatttttatttatttataactaattatagtttacataattatgttttgtttttaacagccttatttgtcctgcagagagattggatgttcagggagatataaatggggaagttttcggatacagttcttgttgtaggcagtttgagtaaggctggttagtataagaaaagctcatagtaattttgaaagtagtcagtacagctgaatagtctgtttactgatagtgcctttaattggtttgcgccattattttattatcctcaaagtttatatataagataatctaaaattacttattattaatcattgttttaattacatattcatgaattagtgttgtttgtttcacatgaagaattactgacttatcctaaagcccttatttatctttctgaggattcctcttagtttcatggaattttttaagtcattggaagccctttctgatattttatttgctaatttgtttgtctgtctgtttgcttgcttgcacgtcaacataggatttctttgtgtataggcctggctgtcttggagcttactccgtaggccaggctgccttcaaattcacagaggtccatccacctgcttctacctcccaagtgctgggattaaaggcgtgcaccactactcacttatgattttagatatgggatatatttgatgattattttttaaaaaatattttttttattcttaagcaacaaagctgttaaggaaaatgacaaagaaaaagtaaaagagaaagaaaaagagaaaaaggagaagactccagctacaactccagaggccagggcacttggtaaagatagtaaagaaaaaccgaaggaagagcggccaaataaagaagacaaagcaagagagacaaaggaaagaacacctaaatctgacaaagagaaagagaagttcaagaaggaagaaaaagctaaagatgagaaattcaagactaccgtccccatcgtagaatcaaaatcgactcaagaaagggaaagagagaaggagccatccagagaaagagatgtagcaaaggaaatgaagtcaaaggaaaatgttaaaggaggagaaaaaacaccagtttcagggtccttgaagtcacctgttccccgatcagatatctcggagcctgacaggggcaagtgtacctttttatatttggttactttttggacctaattatgcttgttggttatctctgtgtcttgttatggtagtgattttgttactgcaacaaatacttggtcttaaaagttgttaattttttgaagtgtttggaatgactagacatataccttattctgactatttctttttgtccaaacagaacaaaaacgccgcaaaattgatagtcatccttctccatcacattcctccacagtaaaggttagtatagcctgaggaaggcagcgtccgtattaggctcacctgtttggaataccaatgtcctgacttccttcaagtcttgtgccaagttttcactggagccactggaggttttatattgcattagaaaatgaaatttttctgtattggtggactgatttttcctattgaatatttttcttataaaaatgttaaaacttcaaggacctagcactaattttattgtgtttcaaagtgcaagagaaattttacccagaagtgcctcactgctttaagcagtcctttttggagtgcaatggtagctacaagcaaatgaatcttttcagcagaatgaagctatttttcggcataaatgttgaagattatatagcactgaagacttcctgaatgatacaggataaacaagatacctctgaatttatcaagcttcttgatgagcatcataccgatgtgccttctaagaaggaatcttgaaaggagttccattttaaagtctccttggtgatcagttctcctgtagttgtgtttattcagtgagcatgcagcttctgttgtatcttcccttggaggtttgtttatacccattgggttcccaacaagttgaaccttgcgttacgataagagcagatgtggcatccagtcctaccacccagcaaagagaaaccccaggcattcaactgcagcacaatatcgtgggtgtagccttcttgaagactcagggtagccattccttgct

SEQ ID NO: 711 - DNA, 83183 bp, mus musculus; identical to SEQ ID NO: 34

SEQ ID NO: 712 - DNA, 11405 bp, mus musculus
gaggcagtccttagacagctcttcccatgcccggcagtttgcggcatctggaggagctctctggagaatctccaacctcagagcgagccttctactaccgtaagtacctacaaatgagcgcatagttcagtggctgaagattaattactggccacaaaatcctaaacaaaaccccgaaagaccccctgctgtgattaatcgccgtaaatcaaactgctccccagtcgttccccccacccccttcattcctgcctctctccttctttccccggatccgagccccgcctcgatgagaacctctgggcaatgtggatatctcccctttcatttctcagtcttccctccaaaccctaagcagggcttgtacccagcaccccgcggagcccaatccttttgattgctgtagcccttaaagctatgaaaggggctacctttagatattttgtacatatcactctcaaaaacactgcggcgctgcctaatggtggggaaagtgcttggggtagagtgcaaggggaccattaaaaaaaaaagcctcaactgcctaagttgggggtggggtgaaagagcaaaatgggcgtggccaattttgaacatcgggttgttcccaagttccctgagcataagattcatcatcttggctgaaatgatatggtacaattatgttttgtttggtttggttttaatgattgaggagtggtcagccatgctgagcaattcagcttttctgactccactccagttaccaagaaacaagactcagatgtccatgtggtaaggctggatcaggctggatcctcagagggcattccctgggtgcaatcccaggttggactctttccttggcaaagaatctagtttcccccaatagatcctggcccagtgccccaaggggaaacagcaacagggtggtattcaagctttgacctggcactgagaaaattggggacaaggggttctaggaattgggatgggaagggtttcaatacggtcttatgccaaattataaccctgtttgaaaaaatgagacaaaatacacctgtttacaagaaacatacacagaatgcctggcactgtacactcattttccgtaatcgaaaacaacaataccagatacacatgaacagataaataaataaaaaaagttcagagactgtaagttaagcatccttcaacacaaaaagaaaaagaaaatcagggcccagctcttcttgaatcttctcggtgtcaacatgttgtctaaggccttttgaaaatgaagctttccacttgtccatctcactcactgttagtctgttagtgttagaccatactaggggctgcaagccggccataagtttagaaaaactaagtcattttcttatcctcttgtggttgctgcatctacctcactctactgagctaagatcaaatagctgaaggcaggtgggattttgtactacagtagaggtccccgtggagtttgtgctgtgaggacacaccttcccgaggcaaaaggttactttgtggtgagaggggagaagatccgccttgtgcatttggagtccatacggttccattttcttcagaggtagtgaacaaatctgcttagaagttaagggcaagttctaagagggatcattcagttatactttcattaactacgtggaagcagctgaattaactaacacatactcaaaagagggttttaagctttggagataagggataagggtgcattataagcactccttacaggaaacagtctttgtgatggactaggaggggtaacagaggatgaagaggggacaacgacagatgctggctctgggcacttgagccttggagtttaaattaaatgaactttactttttatttaatattttaactttcagcaaattatgtatcctccctaaactccaattgccccagcaacaaaatggcagcagtggtcacaaatgcccttttttattaaactattggatgactgagatgcgcgcgtgtgtgagtgcgtgtgtgtacatgctgtgtttgactagtgcagttgtgcacttgtctaattaaaaggcgactcttggcatggtccacttccccccactcagtaggatttcttcaggcttgtctaaggtcaccttctgtgcctttgaaatctcagggacaaataaacatttcaaccaaaaaataacatcttggatcgcaggaaaagatcttgagtagagagactgggaaaagtgacaagtggccttattagcatgctaggttcctgggagctcatggaatgaaggttgtagagagggatgcactgatcacacctcaactccagagagcagaactagaccctgagcaagaaaatgtcttcttttagattctactacgttttaagaagcaaagccttcaagacttggaatactacaccagagggcctccaggcctggacaggccacagcctaagccatgatgcttcggaccttcactcttttgctcctttgcatttgtaagttcaaggaagggatgagaagcaagtgagcctgatagagaagctcctgtgagcaggctcctggggaatctggggaactgtttgaggttggagagcaatgtagaaaagcagactttctcttctcagggctcaatccgggtatgacttcactgggtaagtgtcttcctatcagggattgtaaggtactggcctgtgtgtatagcggctgggctacttgggaatcaaatcctcttccattatgatttgatttcccaagaaatatgcagattcttatcttgctttagaaggcagtctacttccccctgctcagttggattccttgagcatatgtccctggcccctctgtcccaaatccatacaggagcagaaactcccactccctacaagaaggcagaagtcagcatctgggtgggttagagctaattttaaggtgtgttatagggcactttgtgggatggggagggctgagcactaatatctttctgattttggggaatggcagcagtggagtctcaaccagagctatggatagagtccaactacccccaggccccttgggagaacatcacactctggtgcaaaagcccctctcgggtatccagcaagttcctgcttctgaaggataactcacagatgacctggattcgtcctccttacaagacattccaagtttcattcttcataggtgcccttactgagtccaatacaggtctttatcgatgctgctactggaaggagaaaggctggtcaaaacccagtaaaattctagagctagaagcaccaggtgagatggcaagggtaaaaactcaagaatattcacccactcttagtacgcaaaatcgccatcccagggaaggatttgttgaagtgattcatttacctcaaatgtatgcatgtatgtgcgtcacagataacatttaagtgcctactcagtaacagacaatgcatgcagaggactcaaccctgcaagggtggggcaaggaagagttgttcagggaaggctcgtctaaagcccatctcacctctcctgctatctaggcagtaccgccctttctttaactcatatcagttcttttttttccaggccaactccctaaacccatcttctggatccaggcagagaccccccctcttcctggatgcaatgttaacatcttctgccatggatggctccaggatttggtatttatgctgtttaaagagggatacacagagcccgtagattaccaagtcccaactgggacaatggccatcttctccattgataacttggcacccgagaatgaaggggtttacatctgccgcactcatatccagatgctccccactctgtggtcagagcccagcaatcccctgaagttggtggtagcaggtgggtgtggccacggctgctggcatctgacaattgttatcccagggatcatggctggttgagcaaaagttgttcatattacttgcttctgccagtttctaggccctgcacagtcaatgaggtagagttgcttgacaatttcctgagctacaaatcagagtcacacatgctttaaagcagataatcctttgacttgtttgtgagcctacccagctattcagaaacttcatcttatcatagttttactgtcctttacttgttgatcatcaatcattcattcatccaatatttattgagcacctaatatgtgccaggcattgccagtgcagtcttaaaattggtttattaaaagtttaaatgtatttgcaatgattatatttaagagtgggaaacagactgaatcactgtgcctgttgatgtaaaacaaaccaaacaaatgagaaagcaagcaacaggttccctttgtcctatatcactagagccagtaaaggcagcaccaagctctaaacacagaaggcaactcccccaaaggtccaaatgctagaaaaacacactccagcctcaacttctctatcccatgccctggatgattccaaacaaaattgtctttatagatctagtttctgccccaagcaaaatagatcttgggaaattgtggtgctacagaaagtacccctgatttctagttccacccatgacactgtatgatgttgagcaagtcatgtcacttctctgtgctttggttttctccattctaagacaggataacaggatctttccaatctattgtacaatatcactctgtgcttcaatttcatgatctgaaaaatctctataagaataatgcctacctcacagggttgttgtgaggatttgcctaaataacatgtacagtgcctggcacatacgttctcaataaatggtagttaataattttattaatatagctttttcttgaggatcaaaatacaaaggattgtgtaagccatgtatatggatgcttgttgtacacatactcttccaacatagttccccactaacacacttgtacgattaatgttcaccagaatttcccatttcttcattaattttaggctggcagggactttatattatttacactcaataccactagactggcatgtttcatgacacatccgaaaagctcccatgagtatatgacagagctgatctttccatagtagatgagctggtgtacctgggatctgagtggggataacatggagtcatataaagctgaagtttagtagcacaaccaccttagaaaaacaatccatggaaatgagggtggaccccattagcagatttcattggcttactgagctatctccctattgacctccttcaaccttgtgctgcaagtgttgaaagtaggtgtcttaaagcaagattaatgtgttcagatgctctcatcaatatttcagtgaaagttatgctctacaagatggaatcaaagtcattttgagaagtgtagattttctggctgtgggaagaactatatatgtcattttagagaccggaagattcagggaattatggatgtagacagtcccctgagggaagcacctctacctgggcaagctcacagtggagctaatagagctgaatgagagcggaagaaacgtgtccttgattatatacatgaagaggcataaatctaaggcaagagaaggaaagaagcttacatcccaattaccacttttgtccaaagaaagtagaaaaataagcatagactggggaagaactggccaaactgtatcttaagggtctcttccctttctaggtctctaccccaaaccaactctgacagcccatcctgggcccatcctggcacccggagaaagcctgagtctcaggtgtcaagggccaatatatggaatgacgtttgctttaatgaggttggaagacttgaagaaatcattttaccacaagaagccaataaaaaatgaggcatatttctacttccaggatctgaagatacaggatacagggcactacctctgtttttactatgatgggtcatacaggggctctctgcttagtgatatcctgaaaatctgggtgactggtaagatatgggtatgctacggaacaggttgtaaagcttcctctgactccctctctcctcttgtacttagtcccccggccagaactagtggtgggggtcaggaacagaatttgtgcaccatactgagggatttgtaaagtacaaatgggaagacagaggagggaaatcaccctaagtagtagaaggagtggagactttcaccattggctgtttgtattttgggtctcatcctagacactttccctaagacctggctacttgttcagcccagtcctgtgattcaaatgggtcagaacgtgagcctgaggtgtggaggactgatggatggagtgggtcttgcactctacaagaagggagaagaaaagccccttcagtttctggatgcctccagcaacactggcaacaattcattcttcctaaagaatgtgacctacagggatgctggcatctatagctgtcactattatcttacttggaagacatccattaagatggcaacatacaacactgtggagctgatggttgtaggcaagtgatcttaactggctttaattttcctatcacctatttgttattattattattattattattattattattatactctaaggagggggttagtggcttgtgcactttcctagaggtacaagctaaagagataacactaggagtatggtatagggctttctatccttcaggaaccttctctcctgagactaaccttaagccttgcctctcagcatgacacagccccactgtgagttatgaaaaatattaaaaataatttctttcaagccagggagagtttacaggtatggggtcttcctgattgaaattaagaaccagtagtctttagagaaccacagagaggggaaaagaactctaaatgcacaaagtttgaagccattaaccaaatgtaagtgaagaaaatcccaaatgaagagctgtgaaacatttggcaggggagagggtgctgacttagtgtcacttctaactgtggtctctggattggtttcagataagccccccaaaccctccctttcagcttggcccagttccgtgttcaaagtaggaaagaccatcacccttcagtgccgagtgtctcatccagtgcttgaattttctttggaatgggaagaaagaacaacattccaaaaattctcagtagatggagacttcctcatcactgacattgaagggcaaggcacaggaacctacagttgcagctatcgtattgaggcacaccctaacacctggtcacatcgcagtaagcctctgaagttggtgggaccagcaggtgagaagataagttctcatatcctgggattccaaaacggtgcccagaaatatatgggaaggggagtgagggcttggaaatcaggacccatgcatctaggcacactttccttgggtgtgctaagatacctcaagggagtgaccagaatatcctgaagaatccttcctattctccacgaacaggaaggacacatctgtctcaagcttctaaacagaagctttctctgtgaccagctcccctcccccaccatgacattatctgtctgacctcatccccatcaaggtttctgcttctggtctcctctggtcacaggcttcctcacctggaattccattctgaatgaagctgtcagggtgtccttaaccatgcagcttgcttccttgctcttgctagtggtatggatccggtggaagtgtcggagactgaggctcaggtaatttgctcagcctgttgttgcccaagatagctgactgtgtgctctcctagtctccagaatgggccggtccccagttaccataagtgtggagacacattcttaggtttctctcagcatctagatttacaagtcaaggcattctcattctatctgtttctttttcacctcacagaagggtcattacccaagccaagtggagtcatgtatagttttctggggctacacgaataatcagaagcatgttccctgacctctacacctcctacagtgcccaaatcacctcttaaacagctctgtccacaagacattatagctgtcttccctattaatatggtgtgaacatgcttgcttgtaagaagctatgctgttggctcttacagcttgttatctgactaccatcctattttttccaacattatatccctcacattaaagggatagagagaatattttcgtccattttaagttccttacaaatcagtttttctgttactcttgactcctattgtttgcccagagcacccttagggtagagttttaagctggataggcatttgataagacaataaatggagccagagggtcagattgtttcctctagccagaaaatacagctcacaagatcctactgccatttcctgagattctccagtgtccttcggaccattgatatctctccctaatccccacggttttctaaggatattatagatgacaatgaaaagagagaagtaacagttcttaatcgagtagattaagaactacctggataatttgacttccctccaccccttgcctctggatgtacctgtctgccacctttgtgtgtctgggaaagttaacacacaatggaagatcactgtgactccgtgtgtctgtgatttctgctggaatctgagggataatgtgccagggcaacaagttgagagagccaattatgatttctgacagagaaaaaaaaacacccttggagttttcacgttcagggagatcaattttatggcctatagatctgtcctaaatttcatatgctttaggctaagctcctagtgggattatcctactccaagatcattgcatcaaaaaataagataagaatctagattttatagaaagcagcctgaaaagttgttttcctgaccagaaaaaggctgagggtattcactgtttcccaaggaaaacaaaattgtcagctgaattttggctttatacctcctaattgtatgggaggcagagctcagcaacagtgctacacatttgtagtcacaatctatgtggtggagagagagatcccactctctgacaagctcgctcaggactgacaggccatcttctggtaattcatcaaggctgcctaggcaacccttccataacaaaggcaggtgaggcaggtccgtctaaagaccaatactgccataggaacaactgcttccaaacttaaacttgatgactgagaaacactcaaggttgctctttccacccccacactcaaccacccagagctgctgagctccaggggttctgagaactggagatacaaaagcactttcccacctgacatttcatttgctgcagcaacctcatcaagagccatgggaagctgatatataatacagactgggggaggggcggagatgaggggcatggaggtcatagaagtgcaagaggtttggaggcgattaggccctcaagaagaaaagtcatcagtgtcagaaaagattatgtgccattatcctggtcatacccaatccctattgggtagtgaataagccaatgacataaattgccgcccccttctctccgccctccccctaatcccagcaactcctctcatcttttttttttttctggtctcgctagagaagcctggttgttgggaacagctcaaggggtcgccatgctcttcatactcatggcccttctttgctgtggtgagtacaaaggggtgggacaggggtctgggcagcaggctggggaggagggagccgaacctggcaagggtttcttttgcaggactgtgcaatggggcattgacagaggagattggtgagttttgtcctgccccagactgggacattcctctctggagatccgaaataactacagagtgtcagtgtcagtgcccagggagtgactggttgggagggaaggacagccaggaaggggcacttgttaaagctactggcagcactcagcctccaactgtctttctgcctgtaaaaatttccttcagactcctgcatttttgtgaggctcagctgagaaagcagcttccccttttcccagtacctggagaaagaagaaagataggaaagagagggttctgattgaaggggaaggggcgtgtgatctgggtatggacttcaagagaaaggaaaggagggaggggaaataccaagaggatggctttattaactctgctgtttctagaaatagtcatgccaacccctaagcctgaactgtgggcagagacgaacttccctctggccccgtggaagaacttaaccctctggtgcagaagcccatctggctcaactaaggagtttgtgttactgaaggacgggaccgggtggattgcaacccgcccggcctcagagcaggtccgggctgccttccctcttggcgccctgacccacagccacaccgggagttaccattgccattcatgggaggagatggctgtgtcggagcctagtgaagcgcttgaactagtggggacaggtaagagaaaacagaggatcatcccggagtgatccccagtgcccctggaactcctgtgctgctaggagtaaagggtgggggaggggtgaggaaagagtaagaggagacaaactgaggaactcaggggtacatttcatttgtttgcagagaaagtaactgagcgtcccatactgggcacgtccaaacttttgattcctggccatcccattttgttttctagacatccttcccaaacctgtcatttcggcttcccttccaatccggggccaggaactgcagatccgctgtaaaggatggctggaaggtttggggtttgctctgtataagaagggagagcaggaacctgtccagcaacttggtgctgttgggagagaagccttctttacaattcaaagaatggaggataaagatgagggcaattacagctgccgcacacacactgaaatgcagcccttcaagtggtctgagcccagtgagcccctggagcttgtcataaaaggtagagctggatagggtgtggggggaggaggggcgggaaagtgcgtgatagacactcctatctccaccacaaactttgctgctggtactaggagcctgtgtccaatcttagagccaggcaggcgtggcgctgggagtgccagggcccctggctccacgatattaatagccataattgttattaatagcttgggtttgtggagggtgatttaatttttctgattattttcccatcaattatctcatttaagtatagaggaaatcttgaagtgaggtgaagcagctactatttcattctcttatccagatgggcgaaccaaggctcagaactaatagcgtcccgaagaaagatgactctttcagtatactcctttgcctgttccagtaacagtgaagatttctctggagacaatgagggacagggatgagggatccctataaaaacaaacaaataaacaaaaccatcaatgcatatatgtctgaataaaatgcatatagcggacttcttcctaa

SEQ ID NO: 713 - DNA, 211 bp, mus musculus
cagagtgcccggcgcgctcgagacgtctcaacgtcctgtgggtcgtgtgcgtacggagggaggcaacgtaagggcgctcggcgagcccgtctctcctcgaatgaaaggaaactacccctggcgacagagccccgctcttcggcagtgccggagaaccgactcccgccttccccgtcttccctcgtgggcgctgtcctcccttcgcccagcc

SEQ ID NO: 714 - DNA, 168586 bp, mus musculus
  misc_feature (5702)..(5801): n is a, c, g, or t
  misc_feature (34958)..(35057): n is a, c, g, or t
cgcgcgggcgggcgggcggttgggcggccgggggcgggggcgcgcagaggcgaggagggcaggcggcaggagggcaggcggcagcgggctggcgacagggcaggcgagctagctgtccgctttgcgccgcgggcccacgccgcagtgtgttttgtggacggcgccttcccagacagcccagcggagcccagcctggcaccccgcagcctcggacgcgatgttccgccggaccctcaaccgtttggtgagtacactggccgcggctccacgcgtaccccggtggcccgctcgctggccccccgccgctccttcgcagtctctgggcgaggggacgagcgggacgcgccagccccctcccccgcctctgcgttttagcggaaacccggcgccccgggtggcctgggtggggaggcaggtggggctctcgggcgtcccacccctgccccgggacatttcagctgaggttccccgaggctctgaggaactctgcctccagcctggggaatcgcctcggagtgacagacgcgcggaactcggggcggggggctccccggggcggggggctcagtttcccaattagtggaagatggcgttgaattatcggggaggaagctttcttttgtttcctctgccacgagcacgtggaggtaaacctagacctgtcactgtggcccaaaagaagagctagggggctgagagaagcggaggctaaaccagggctcagcctcgcccgggccatggccgatgaccagagactgggcaaactttgaggactcagcctccaagctcaccttgagggtgacagaaagagcgagggctgtgggcacgatgggctggggccagcagcgacggcgggagcctgttccagctttacagaccctggggctcaagcctcgcagagcagcaccctctgctccaggcttggaatccacccggcagctgaactcctccgaccaccttctccacgcctctaaagccccccagaaaagggaattgtatttctgtggggagtgtggcacgggattgggagggagcgatttctggctgctattgactttttggattaacctgtttactcagagggtatgttaagaactgagtaaagtagagcagtttacttaaaggatgtttgtagcaactcccctaatttccagaagaggtgtcagggaataggattttatttctgccacggatattaaagaaagccatcatcctaaaatttttatttttttccctgtagttaagggggagaatgcagaatgcttccccattccgtcttaggatagacttaaggacttgacaatttggtaactttgtggagtcatttctaattaaatcattgctgacatatttttcataggtcagaacaatttgctgtcatttcccaccccccatatctgaaactttcacaaatgtcccctgcttaatcacacttaaggcatccccttttaggatatcagtatactaatactttttaggttttgccagatgtctgtttcactcagaaacatgcaaagggaggtggaggtaattattacctgtggcactgagcaggaaacggtgtgtacatgcaggatctcaagagccatgggcagtggattgtgttggatgctttgctgaagcaagtgactaacatttgttctcacatttcgcctgagactgtaaaagagcattgtacctcctagttctgtttcacataggctctcgtgatttggaagtgttgttttggggcgataaaaagggaaaggcgacacgaaagctaattgtagtgctcagcaaaagggtagcctttccacatgacactcatatgttagacactagctgctctctgggtcatattaaattcataaagtaaagatgctgacatcccatttttgaagactttggacatttggaattaaacaaacggtgttgacccaaaagcacttcccatttggtgttcttttgctaagagtgctctgcattgtatctgtaaaaagtaagcagtgctggcccacaaagctagggcatgcagtagaatttgcagtggctgttgaggtgccagcctgctgatactctgcatctctcccaagatttctgcagagactcacttttgctcatgctaaagggagctttgacctcattgtttcaactaagatgtccagctgttcacattttactgcacaaccctgactgtgataagtcctaggaatttgttccactgtcataagctagaaggttcttaggagttttgtctgagccctaggcctagagaaaggaattaaactgcaaatcattgcactgaatataccattaaacactgtcaaagtctcactgctaaaaaatgacttgaaatttgggggctggggtgggaaaattttaaatccctcaaactctgctattgtcatctacagggagtacattcttttagtagtacacacatttaaataactagatcagtaaattaaagatttaactgaaatgttcagacttacacagcccagtagatgtagtccaagttctgtgttatccttaaaattgttttaatattttacagatagggctatgaattctttggaagtcaattctgctgtttatttggcagtcatgtgtatctgaaattgactttgactattatataaattatagtagtgttggttacagttgctggtcattgctggcatattgcaatgaggctatctttgagtcttaaacctggtataggaggtcagaatcttgcaggaatcacatcatcttctgaagagctcagttatgtgtgttgagtcatttttaaaatgtcatttctgtttccccctctttctgagctaaaagagatagtgattaattgtacttctaaagacacagccgtgacattacatctttgccgctaagaattgtcctttctgatgaattacaacttttaaaaaaattaaggcagtgtctcatatagtacaggtggtcttatactcagtgaccttgggttcctgatgcatgcttccaccttccaggggctgggttgtaggatttttggcagctgccagtgtctgtttccttttgacagccttttgtggggttttgtttattttaaagaattatttgtttttatgtataggagtacacggtagctgtcttcagacatacaagaagagggcatcatatcctgttatagatgattgtgagctaccatgtagttgctcggaattgaactcgggacctctgggagagcagtcagtgctcttaacaagagccatctctccagccccctgtttttggttcttgagacaggatctcctacatagatagttccagccactctgaaacttactctgtagaccaacttggctttgaattcacagagtaccatcagcttctgcctcgagtcctaggatcagaggcatgtgccacaaaagctagctacttatttctttttgtagatagtctagtctggctttgaactctctccatcccgatcccttagctaatgctgagattacagacaagtcccgctatgcctgggttttgacagtttgaggtagactatcaagggatttgatagtacagcgttttgggagttaggcctgtgtgtgggggtcttaggagcactatttgtttctagtcaacatttccatcaaaataacaaacgtgagagtagttttgcctgttcaattattttgcttcacaggtaaatttaattagaagtttgaactagttgaaatttaaacttccaggtcaggggcttgggtgtcttcctatcttttagtaacatttgtattgattataggaattttatagtcttgtattgagttttgtaatctataggcttaaaggcttattgacagtctgtcataaatttctcccctttagcttattaaattatttcttgctaaagattcacataaaattccccaataagtagattaggtgattttattgagtaggtgctgtcaatttaatttgttggaggggaatctgacagttacagatcattgataataaagcttaacagtattgtggaaagctcaaactgcattggttctacaaagaaaatgttttatcagagactgggcaaattaggctgtatcaagaagaatggacattttaaataaggctgaaatgcaaactgcaaattaacaaaataggtagctaatttattacttactttgagtacagagtaagggcgctgtaataaaacagcatagagagacaataaagtaattcaggtaactgcttttttgttccaggagcaaaaagggttttggcttccttgtgaaattataagggtaattacaggttctttttcttctgtttcatttacctataaacttgccctgacattagtgagtgtcagacataccggttttatgttactgggttttgaaatctgtatgtatgggttataatatttttgtattcgtatagctcttaacacagatctataaacaaagttggtaagttggtatctaccagatagttctgacacttgtgggtctgacagttgaactaacccctccctaaaagcaacctttttaccatattacattcattataattacagatgaatttgttggctttctgaactagcctttctccagtgggaaagaagccctatccctagggcatatgttctatgtgatagattttcccagatggagaagaatccccaatagagaaaggctggtttatactgaaagtaattagggggtagcttttaacaccatgcttggtacttagtagatggttaatgaataactgttgaaaatacagcttttaaatgtttcatatagatgataatctttacctatgaggagtgatttatagtaaactctgttattgtttggagtgattaaagatggggatttctagttcctgggggtggaggatttaccaagtggctgttatataagaattatagtatatacatcaaatgctgaagctatactgaccataatattctcttttgtaaggtggtttagtcattttatggtattgggagtatcattttactcaacaaatactaagcactaaaatactaccactgactggacactgtgatagataccggggaatatattgtgagcaatgcagacaagaggcctatcctgagatgttttattgtatttataactatagctatagaggcacaatgactgcacttgtatactttgtactatcccaaaagatttaatcctcatgaataaattaatgttatataattactattaatgctgtatacttgctgtttgtcttaataccaaaaatagattatatgatttattattttccagtggctttgatgtcagataaaaatttggttgcaacttgatactgttgatatgcttgggaagttgttcttttgaaagtaggtggtaggctgacccttttgcaaagtgagaagcctatttaggagtggtctactacaacttgggggaggtggggggagataaattagtaattgtcttttctcccctccaccctctgctaccctcctgtctttgaaagagtctcatcaggtaaccctggttagcctattcactatgtactcctaggctagtctcaaaacttctgaaatcttcactcctgggcctcctgagtgctgagcttacaggcctgaaccaacatgtctgacttgaaataactctttatacagatagaaacagatttttctcctgaagtatttctctttttttaagggttatttatttattatatgtaagtacgctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggttgtgagccaccatgtggttgctgggatttgaactcaggacctctggaagaggagtcagtgctttttttttttgtttgtttgtttgcttgttttttgttttttcgagacagggtttctctgtatagccctggctgtcctgggactcactttgtagaccaggctggcctcgaactcagaaatcggcctgcctctgcctcccaagtgctggcattaaaggggtgtgctaccacgcccggctaaggaggagtcagtactcttaaccgctgagccatctctcctgcccgaaatatttatttattgatttaaacagtccaaaactgagagtgagtgacatatttttttattgatttaaacagtccaaaactaagagtgtttcctaaatgccttcagtaagcatttctcatttgttgattttgtttgtgttattgctaattttcttccttcacttttaaatttattcttattttcagtgtatgaatgtctttgcctctatatagatactgagcctgaatcttctggaaaacctgtcacagtctttggggtgtgtgtagaaatttattcaaatgtttacgatggtaaaacaatcttatgtgtaaatcttctattccacagcttccatccaaatgcttgtagaaaagatagccgttaggcccatttccagatcaggtagtattctaaagctgagccatccctttaggcttctgtgctgcgctgcgctgcgctgttccaatccagtccggtctggagtggtctagtcctgttctgtcctttcctttcttccctctctttctttctattttgagagagggtcttaatatgtagccctgagtgagttggaaattataagtagaccaggctggcttttaaatcatacagagccacctgttttctgagtgctggcattaaaagtgtatgccagattatttttcagtattttctaaattttatttttatgggtatgggtatcttgcctgcgtctgtgtctgtgaaccatgtatgtgcctgctgtctgtggaagccagaaggggtattaaaccacctctctggggcagtatgaccagtggcccttggaagaagccctttgtctttatgatgtttaaagaattagcttggtttgccaattcaaatactgttttgttgagtggaaaaaagtcaaggctggttgcttatcaaccatggttgatcagttttttcaaagagggcagacatataagatgcaaaataaacacattttttttctgatgttgtttgagtttcctgtacatgagtagtgctttaaaacagataacttctgatgtctggaatccctgaaatgggatgctttctctggttggatgaaagagaattctgacttttccaaggtaacggggtgcttcacaagtttattgctctcttaagatttatttcctctcctgatgtaagtgaaggtcagcagtgatcataaagcaaatatattagtacagctgcagcatatgataatactactgcagattaatgatgaatgagtgttcagcactgcagatatggcacaggatgccttattcacactggcagacagcccctcaattactgcagtgtatggatggattgccagtttggctgtcttcttgattataaaagatgcagtttttgcatggtgttagaccaagaatatctggtttaggacgttgttttgtagttttaatgtataggctatcattgatatcatgccctatacttacaatggaatatgggagggttgaagatgtgtgcctggttcaagcaggtatcatttgtttcttaggccacattatcttgaggtattaatgtggcagtgtcttcctagtccagtcttcttcaccaatatattcttgaaaaaattcaaacagtgttcttgacaatgattttacactagcacaggtaaactatagataagatgttcagtaagtacttttgaattgctttgaactgacttagtaacaaaagctgtctagttatcagttgaaaaagcagccactaagaggcctctgtgttttagaataggctttttattttaataaaagcatatagcagaaaaaatatcctttttattggatagtatgtgtcttagtttgggtttctttgctgtgaagagatactgtgatcatggcaactcttataaaggcaaacatttaattaggtgctggcttacagtttcagaggttcagtccattatcatcatggctggaagcatgatagcatccagatacacatggtgctggagaaggagctgagagttctacattttgatctgaaggcagcaaggaggagactatctcttgcatgcagccaggaggagggactcatctgcactgggtagagcttgaggactaaagaagacctcaaaacttgcctacacagtggcacacttccttcaacaaggccacacctcctaatagtgcccatgggcccagcatattcaaaccaccacaatgctacaccattattttgaatgaggaaaaaaattatgcaccccagtaggtggccagaaaaagtttgccctttattgaaacttttttctattcgtcagaaggagaacctttaaaccattcccttttcttggtgtttcataaaactaattaatatactatcttcagcttttaaaattctaagtacatttggatgctttttttgttaagtacagttgataaaacattttctttttaaaaaaatttttactagatattttcttcatttacatttaaaatgctatccctaaagtcccccataccctcccccccactcccttacccacctactcccacttcttgtccctggcgttcccctgtactggggcatataaagattgcatgaccaaggggcatctcttcccagtgatggccgactaggccatcttctgctacatatgcagctagagacacgagctcttggggggtactggatagttcatattgttgttccacctatagggttgcagaccccttcagctcttgggtactttctctagctcctcttttgggggccctatgataacacattttctaattcaactaatacatcaaatctactttgaagactaaaactgcagtgttaactctagcagagctttgtgttacttttgtttgtttttgagatagagttgtctttatagttcagattgacctgtactcattctttagcccaagctggcctggaactctgaatcctcgtgctttagcttctcaagtgatgtgattatatgtatgtgctaccatgcccatctgctttatgtcattttactcactgtggtaagtgtaatttatttgaattcaggataatccttagaatttagtactaagaatataagaatgtataggccaggcatgggggtacatgccaacaaacccagtgataggaggataacaataccaacttcagacatacagagttctaggctatagcttaggccataggggactccatttcaaatatcccaaactaggagcatgggagagaggagatgcatattatgaaggatttgcaattgtttgtgaaataaatctcacctttgtttgaagggtgctatatggtattgacattgaaaaaaaattacttttccgaggtcaataagctagccagccttggagttgattgagtctgtatatgctactaatagaaatcataccttttcagtgcttccacaaccatgcttccccataatgagtcatttcttttcatattgctgaaagcattccctgtttgtcacttgcagaagagcaacctccggtagtaaattgatgcacccagtgggggagccaggaagtattgatgtttctgccaggttagcgtcaacacttgctggttttctctctggagtatcaccaagttcgtggattctgtttgtacttctataactgctcagatctccatgttccatatatttgtccatgttttccaacattcatttgcacctttctcacatctcatcctgtacatatcttagttcataggcagtaagtataaatatcctcttaggcagtataattccacatagcaagcacactaatgagtatttttattataatagccccatatataaataaacatacatacgtaacacatacatatatggagagaaagaaagtcttgggataataaatttagggcaatatttgtaactattcttttattttgggattagttttgagttgaataatcaaggaaatccccagaaatatatttctggttagtctcaagtttcatgctatttactggtgtaaaggaaaagtaacaattttgcagcaatcctgtagatcaccagggagtagaagccagtagggaattgtcacaaataaataacagctggctagaaaagattatataaggtatacctgttgtgtgagcagtgggcatgtcttttaagcttcacaattaatctgctttgtggcaatgtggattaagttgtttgtagtatagtgcacaatttaatttacttcagctcattttcctttcattttaaagaaaacaggctggggagatggctcaatggacaaaagcacttgattcagatcctcagaacccacaaaaccagctagaagtggtagttcaagagtttgtcatccattcaggtgtagtgtcacaaagctttgaattccagcacttaggaggcaggcagatctctgagttggaggccagcctggtctacaaaccaagttccaggatagccaggactatacagaggaatgttgtctcaaacaaagcaaaacaaacaaacattaagtccatattctcagtgtagcctttcctactgggagattagaggctgagaccagagaatttctagaagtctactcaccaaagctggagcccttgtattgaagtaacatttgaaggttgataccccactctctctttctctctcttcctccctccccccctcttacacacacacacacacacacacacacacacatgggtggggagggattgacctagcctttcaagtaactaggactatgccactgtgcctactagcttaaatttcttttctgacaatattttatgagtcataagcttttatttgaatattcatgtcctgttaagggctatagaggattatacggtacaagctctgttcttgagatagaagatatacatgtaagatcaatctttatatgaagtatctgattgatactgactagttgagtcagggatgcatgtagcccaggtagcccaggctgatctcaaactcccaaatctcctgccttcccccttctcagtgttgggaatcgtggacatgcatcgtcatgcctggctttggcctcttgagtagcatgtgaagtagacacttgcaaagagagaggcatcgactcttcttcactttagttgaccaatactaatcaatttctcgtagttctacccacatcacctaatcaatttccccaaagttcttcataatatcatgatgagagctagacttcagcatataaatttgggagggaagggtcaccaacatctagtccataacatagctggaagagttgttcagtgctttgtttcctatgataaaatttataatttataaaaggtaatgataaaactggatatcaaggtgctttaggtttctacaactgcacaaaatttcccataaactcgtttctgaaatccatgattccagggcattactctgctgatttggaacagtaaaatggggaccggaatgaaattaacatttgaggcaataaatcactacttcatacaaaactatgtggttggatacttcaatggcttaagtaatgggtagataccttcagaaacttcatatgtctagggtagtgatttatttattatcttgggtgttggtggccatatttattctatttatgtatgtatgtatttttgttttatgtgtatgtgtgtgtgtgcatgtgcgtgtgtgcatgtgccctgttcccttggagagcggaagaggggtggattccaggagttagagatggttatgagctaccatgtaggtgctggaaattgaaccccagtcctctggaatagtaacaggctctcttgattgctgagccatctctttagccctggtaatcattaattttaaaaaccgagagtcagagctttaagagtacattctttaacatttctatttcaagtccattaggcaacatggctatgaataggtattcagtattccaagagtagagcatgaattgtgatttttttttaatgaccgttgtatcactacacatgaccggtggctttttgtcaaaactggcattctagtccaagtcgtatttgacttttccatatttgttgatcttctagttttctatgatttaatagatagtactatttcctgttcagtggtactagcaataaatggagaagccatcttttatactcctgtttcttttccttttttctgtctgtgtgtgtgtgtgtgtatgaggagtgctactcatatgtgtacaggtgtatatgaagaccagaggccaatattggatgttattctatgtttttttagagtcaggttctctcactgggccctagggctcaccaagcacattaggctggtaggctgagtggctggctggctagtgagctccagggatccacctgcccccacttcctcagcaatgagattactagaatgtgctactgcacctggcttttcttttgggtgctgggaatcaaagtgaaactctagtgcttggatggcaagcactttcctggctgagttacctcttactctctccctcccttttcatcctttttcagttactcattctgtcagcaaatctaatagtttctatatctgaaggtacttttaatagctgcccatttcttttttcatgaccaatactattcatgtctaagttggtgctctcatttatctggaccactgcaatagatgatcttacccattctgtactcttcagttatcctctataaacaccagagggatattttacaaatagatacctcaaggtcttcagtgattttacactgcttcctggatttgctggaattgttctcactgttccttgcatttctcatttccttgtaaaaattgagatagagatataaaaattcagcatttggagtatacatttaagtcgtttttagtatagtcaatcacttagagttatagtatagtacaaccatctaattccagtacatttccaccatttcaaaactgaactctgattatcagccgttactcccaattctcttcccacacccacctctgctaatccccaatttacttttcctctaccatttttgccaaatccatacattcacataattgaaatgatataactgagttttgtgtcgatacttgtaatcctagcactcaacaggctgagacaataggttagcatgttggaacaagcctggcttctatagtgagaccccaatgtgtgctctgttgtaacctttttctttagtatatttcagtgttctattacagcatgtatcatatattggtactttattattttaaggctgaataatattccatcataagaatataccacattttatgtgtctgttcatcagctaatgggtatttaacttatttctactcaattcattgtatttatttgtatttgtgttggcatgttttcaattctgaggagtatataggaatgaaatttctaggtcatactataattctatgttttaattttttagcaactgccaaattgtttttctcacagttcaaataccttgggtctttttttttttttttttttttttttgagattacgtgtcactgtttttctagctggcttggaagtcaggggtggaaagttgacctcagagttgtggtgatttcttttcctctacccctaaaatgctaggattctaggtgtgtactacaattgtcttgcacttgttttatgttttaagatagcatcttacgtagttcatgttggccttgatcttgttgcttctacttcccaagaactcaaaaccacaatcagcttaaatgatgggatttttttgtttgtttgtttgttttgattttttgagacagggtttctctatatagccctggctgtcctggaactcactttgtagaccaggctggcctcgaactcagaaattcacctgcctctgcctcctgagtgctgggattaaaggtgtaggccatcattgcctggctatgatgtttatttttaatagcagttaacaacataaaacataaagtttactaacataactgttaagtgtagtattgactagtgcaacctcttagctcctcattttctcttcctttatggtttttattaacaaatcttgatataatggatgggcgttgagaaatgtgagatgcagagatatggaatttcaggctcagctctttcacctgtgtccctagttccctcatctgagactgataagagctccttggtgatttatatcttaaatcctttctcagctttataattctttgaatttgacagtctaggagcagattgtttttactggtttttgacttcttcacctgttcctgcttaaaatattcaaatcttgatttctctttgactatactctgcaccaaatttcagtttttccaccagaagtaatgagtttgaactttgaacgagaaatttgacaatttttagaaaatactgttcatgggcttttaataattatactttttcagttttacactggcctgaatgattggaatgcctttgctacttctgttgtattaaactcagccctattatattacttgcttggcaaatagtactaatgaaaaggactgttttgctgctacaatattgtgggcaggttttcaagagagcaagactactgaaattatttccaagagatactcatttctctgttcatggatagtcagctgcaaaatggtggttagagagaggcaactcttggattggcaagctgcataacaactgctaggtggttaagtacgtaacagtagatataagtaaacagtagaaagcaagtggattgttgataatatgtatgcacttgagaatcaataattcattggagaattgaactccatgattattgtggtgtaattcatacaaaatgatggccaccataagcaaaagtctcacttcatgaactagattctgtaaatacattctatttagaaagttgttgttgggcctggagagttaagagtgccgactgctcttccgaagatcctgagttcaaatcccagcaaccacatggcaactacatggtggctcacaaccatctgtcataagatctgacgctctcttctggtgcatctgaagtcagctacagtgtacttagctattataataataaacaaatctttaaaaaaaaaaagaaagttgttgttagggctggagagatggctcagcagggaagagtattggctactcttccagaggatccagattcatttcccagaatccatatagctcacaactgactgtaactctagttccaggggaatccagccccctcgaacagatatacatgcaggcaaaacaacaatacaacataaaataaaagtaaatgattgttttctaaaaagtcattgttatttgtgaaacgaggttatatgattgaccttgatgaaaaataactagaatagctgtaaaggagtgtaattaaatattcttgtataaatttagatgggttacttttcaaagatactaatgaggcagtgtaatcaaattaaaatcaaatgtaatcaaatcgaaagatataattgatttttagaatccatgtttggaattaataatttgagctaattatgaaattttcattgcattagcaagtgtctgtttggtttctaatatgtatctagtattacacaagttttttcaggtaagggacagggcatattttttaatgttacacaaactacccagtataaacctagagaaaaatcacttccatttgaaagatagagtctttaaggttttttaaacctttatttttaatttatgtttatgagtattttgcctgtatgtatgcctatgtatcacatttgtgcagttcccacagatgccagaagaggatgttggatcctctgggctggagttttagagttgccatgtgggtgctgggaattgaattggaatcctctggaagagcagccagtgctcttaactactgagccatttcttcagctttagatattatcttttaaaaactgtaatatttggcacatatagaagagataaaatgcataataattaatatttaagtgttaattgcctaacttaagtaattacagtgttatttacctataatgctactgtcacatcacatatctcactgctgtcagaaagctttcagattttgttttgccagacagggtctctccttagctccagctacatagaccaggctggccttaaactcagttatttgcctgcctctgcctcccaagtgctggaaataaaggtgcgcaccaccactgccagtgaagctttcagcttttaatccattctttacacacagctacttgttttaaggaaggtgtgctgatacacacccataatctcagtactcaggacgaagcaggagaaactgactttagtgttagcctggtcacatgctaaatttgaggtcattttgggctacatactgagatagcatctcaaaaaaaaaaaaaaaaaacacttaaacacatttatgtgcaagcttgcttaaaacattatttggcttcttatttagagctttatcaaaatgcctaatgtactttttaacttgtaatatatttttataagattttatttatatgtgtgtatgtgcattgtccatggaggtcaggagtgtattgggaccccttagagctggtatttacagatgtgtatgagcttcccgatgcggggatgcgggtgggcattggaatctgaactctttggtcctcacaattgagtaacagattctctttatgtcctgcacactctctcaagcccttaaaaagttctgtggggttttgtttgtttgtttaaaatataggtatagtttatttcttctatatgtacccaatttgggaagtgtactagttaacttctcttcttgctgcaagaaaacatctgacgaaagcaatttaaaagaagggttgattttggcttacagttctaggagatagtagtctatcttacttggatatgtccttcctcttcctcattttggttgtttttttttttaatatttaatcatttacttagtatgtgtagaggggagtacatgtgcatgtgagcacatgcttatctaggacagaggttagcactgggtatcttcagctggtttctatagtgtgtgtgtgtgtgtgtgtgtgtgtgtgtgtgtgtgtattcacattcatgaatgtgtgcctcctgagagcagtgccctccccagtccctccatattattttttaagataaggtttcactgaacttgggacttgttgatttggctagactagttggccagtgagcctcaaggatccttttgtttctgcttaccatgactttttacagtgtgttatagatcaaactagggtcctcatgcttgtgtgcccagtactctactgactgagccttctccccagactcttgcccatttttatttggtgaaccagtgttcttcaagatttttgttgttcttaagatcagcatttatgaacatcatgtttttagttgtgtgtatgtatatctgtaagatttatgcttatatacatgtacactcagacttacttgtaagaaatatcatacatcctagtaatgatgggtcttagactcataagaagctgttcagtagttatatcaatatgttatcacagtggctatgtatttcccatttcctcatagatttgtgggggtggtttgaaacagggtctatctacacagccctggctgttctggatggaactcactatgtagaccaagttggcctctaacttacataggttcacctgcttctgtttctcaagacagatagttttctgtgcatcatatgtgtactggtgcccacagcttgagaagagggcacccgattccctggaactggagttaaaggggtggttgggggtgctagtaatcaaacccaggtctcagtaagcacctttaaacacctgagccaactctccatcctcttgtttgtctttctgacaagatttcatatagtccatgctagtcttgaacttgctaatatagccaaatttggtcttggactcctgatcctcctgcctctatctacctcctgatatttttgggggattacaggcatgttccaccacacataactcattttgattgtttcctttgatgtattttttctgatactgatttatgagacattattatgttcaaaacattcctttttttgtttttatgttaccagtatcttatttaagtttgtagctttgtatatttccttaccctccctctctctttgcttttgttgatgctgaggcaaacacactctaccattgagctacacacattactagatcttactgttatttaaaaccttttcataagcaaatgtgttagttagttacttgttgctttgataaaattcctgacaaaatcatcttaaggagacatttgctttgacaaggaaagtcttagtgacagaactgtagagtagctggtcattgcattcacagtctggaatcaggaagttctggtctccctttttattcagtggagatagggggaagtctcatgaagttgtctgttttcagggtgggtcttccctgcttaatcatttctgaaaacactctcataagcacatttagagttgtagtttcatgatgattttaaatttagtcaagttgacagtgaagaataactatcacagcaagtttctgttttttctatttgtttattttgtgtgtgtgtgaatatgggtgaaggattgccatagcacaggtgtgcaggtcagaggacaacttctgggagacagttatttcaccctgtgagtctgaggctccgactctgatcctgaggtttgagagcaagtaccttttgagccatcttgccagtcacctacccctgttttaacttttattttttccttttttgtctctatggggggtgttgttttctggatgaggggttaaattgtcttgcttatgttacccaggctgatagcaaaccatgaatgatcctcctgccttagcctttctagtgctgtgattgcaggtatgtactactatgagtttcacgtgtttgtgtgtgttgaggggatatatgtaccaccactgcatgtgtgcattggccagaggtggtcttctttcttacactcctagaatgaatgctaggattataggtgtgtaacacaacattttcttatgtttattttattttaggtttttagatggtatttcgtgtacttcaggctagccttgaacccctgatcctattgtactaagtatctgttcttcttgaaccagagctaggctggctgccagcaggccctagcaatcctcctgtctccaccctaaacagtgattcagttacaggtgttcatcagtatacctagctttcttgtaggtgctttgaatttccactcacgtccttttgctagctgaccaagtacatgttcctgcctacttagccatctccccagcctgaatttctaatttctagagtgtttttctttccttattaaaacataatttatttatttgcttctttttttgagaactggtaatgaagaaatttatagtttcagtctcttctctaaccttggggggaaataagaaaaagctgtactgggtaggagcactaggcatactcatgtcaaccttgtaggatgaattgtatcttaacacaaatcacatttttatgaatctactatatagatgatttcttctgcataaacttgacttgtagtagatacttgctgagtatttgatatccatttactatcttgccccagtgtcaaaatcttgctgtgactttcttcctttttttttttgaaaatagcaaattatctctgtagtttattcccattgttaagatttgcagtgatgttgggctagtttaccaatactgtcataatactcgtgagggttccaacttcctggtttgaggaaggaggaagaatggggttcacataaataaaacaactgtccacacatttcagaacattttagatgaagtcagggagtccttgaatggtttgtttttgttctatagcacattcctatgtttttatataggctatctctcacagcctttagaaggatgtccatttttcccttggtgttactaggagtcccctctggcccagagaggcagcagctgaagattgggcttggtgggagaatctagagtgcctgttttgaggagacctctgaaaggtcttttctgctgaccatagcttctgaaaaggggagctgtagcatggtttcaggctcctccacaaggttactctatttctgtctgtgtgtgtgtgtgtctgcgtgtgtgtgtgcgcccattcatgttcatgcttgtgggtgcccacagagaccataagaaggcctttggttcccctggaactggagttctgggcagttatgggtgttgggaactaaattccaatcctctggaagaagagcaagtactgttaactgctgagccatctcttcagctccaggagtttctttatggttagtgctatatatagtttaagcagtctctttttctaccaacgttagtaagctggtatacatgtgtgtacatgagtgtggaggccagcagttggtgtcaatcctccctaccttattttctgagacattatctctcactgaacttggctagatttgcagtgggttccagggacttgcttttctctgttcctctagtgctgaggttacacacattggctgcttttacatcaatggtagagatctgaattcaggtccccatgcttgcatggcaagcacttttttgattgagacagctcccagtcccaattgatctttttttaaaaattgaagtttggcaaattattttatatttcattatgcattttgtctgtagtagtggatataacaacctacatgtgatataaagctgtattacatgtacaaacacacacaaatgaatagaaactgaaatctccattttcaggtctttaaaatgtgcagattcaatttacttcataataacccattactcagtggagattgtggaatttagagtatggtttgtttacacagatttcagtgttttaaattttatttcactgtagatatcagaggacaacttgctaaaattggttctccttgcagtatgtgggtccaggggttataactctgtcagttttgatggcaagtgacttaacccactgaccaatctccccagcgggggcttgtttgtttgtttatttttttcactatgaaaatgtatttattgaaataaatacaaacgggaattttaaccattccaccgctctttatttttatctatttttttaattaggtattttcttcatttatacttcaaatgctatcccaaaagtcccccagaccctcccctcccactactctccccacctactcccacttcttggccctggcgttcccccatactgaggcatataaagtttgcaagaccaaggggcctctcttcccaatgatggtcgactaggccatcttctgatacatatgcagctagagacacgagctctggggggtactggtcagttcatattgttgttccacctatagggttgcagtttcctttagctccttgggtattttctctagctcttccattgggggcactgtgatccatccaatagctgactgtgtttgctaggccctggcatagcctcacaagagacagctatatctgtattctttcctctgtagattccaatggagtgttgattttcttgctttcatttccattctcttcctttcttcttccggaaaataagtgactgaatcctggaacatcatcaagtctctaagttgaaatggtatttgaatgtaaatttatattgaggtaactacatatacataaaattataagcgagtatagagatgctatataacttttgtctagtttttctcagtagtagtttacaaaactggtataatgtcattctgacatttgtttcgtttatgtgtgtacttgtgcatgtaatgggcagttttatctcacatgtagcttgttgtgtccactactaaagacaaaatatagaaggaaacaccataatttataattgaaaatttacatcacttgccaaatgtggtggcatatgcctttaatcatagcactcaggcagaggtaggcagatctctgtaagtcctaggccagccaaacaacaagctccacgacagccaaagctacacagtgagacctcaaaaaaaaaaaaagccataatttaaatccatgtcaatttgtgcttccagactgttccagaatttccagtttggctgatgcccagttctaaaagatcatctcaaattacataatctacaagcaaagtgatgagagaaaactttgacattaaaaaaaaaaactagaggaacattattagtcctttgatgttgagggatgccgattgcctattaagtatattatacatgcccatatgatcctgtgtttgacatattagtgaaagctgtcaatataccagtaagaatcttgaaaaatctggtattggtggtatgtgctattaattccagcatccacggggcagaaaacagcaaacgaacaaaaagaatcacgaaaattcttattaccagataaaaaatagtagtggaatggaggaaataagtgtgctgagagtaaataggaacatgtgtgggggttttgtgtttgcacatacatgcggacaggcctgagtttgacataaggtgtgtttcttgattcttacctttgtatagtgaggcagtctctcacttgaatacatagcttgcttgtttagtttggttagctaaccagattgttagaatcccctatatctgcctccagtctcctggaattcctatgcccagccagcttttatgtaggttctacctttacacagatccctcagcttaaatgtcaagctcattgcctgcagagtcatctcccaagccccaaggatctaggttttggttttgcttgtttgttcagacagggtctcttaaaatagcccaggatgtcttgagactcactatgcagatcaggctggcattgaactcacagagacctgtttgcctttgtcccccaagtgctggggttaaaggtacgcactatctgcccagctctagggtatgtttgtgactggatgtgtaggaaaattgtaaggagatgtcattgaaattcataatacagtgaatgagataaactaatttaatgtagagtgtttcactatatagcccaggttggcctccaacttgtactccttctttctgtcttaggctctcacatgctggggttacatgtgtgtgctgtttcatctgtgtaccatttaggttttgtgaagtaagcttcttgaagtaatgaatatggtttgatgatgtggttataataaaaatgtatgtttaatcagttcacatgtttgtgaaatttcctaccatatgccatatattgtcttctacttgccagagatgctttggtgagcaaatcagacaagtttactcttggttaccttacattctaatttgagagacaataccaggttaaagggtaaactgaagtagcaaagaattataaaacagtggcctgaaaaaatgtgtttgtttgtctgttatgtaagttggcagtctccagactatgaggccatctggggttatttctgctttctttaccatttggttttcaagttctaggaagcaggatgaatgtctagggcaagcaaatatctctaggaaggtgattaggaagttccatattatcactttattgcacatataaccttaagtaaacatcttagctctataattcatcctagccataagggaaaccgactctctgggtctccctagatctatctgagaatcccaaattccagataaaagcaaaaacaaatttggaaggacaattaggaaacagggactcaggcagtaaacaatgtcatatgatatgaaagagatagtaatagcatgggaaaccgttaataatgaaatcctaaagggaaactaaaccagaatgaagacagaaatgcctggttggagttaatcatagtgtgacaaaagacctcttgagaaagtatcttttaagctgggtgtagtggcacctgcctttaatcctagctattggtaggatgaggcagaggaaactatgagtttaagccagtttgagtttcatagtgagtttctggctagcctgagccacagtgagaccctgttctttttttttttttaagtgttggttaaacagaattgtggactggtgagtaagcaactgttctggtttgttataccacaataaatgattagttttagcactccagaatcttccatctcatctgaaagggtttagttagtataaagccacaatcataccacaggttcactcacagcaagcagtacaaaaaggctttaaataatcaatggtatattggtgaattatactgtgaggatcaaggttgaagtatttatgtaagattttcaactgattaactccacctggtgctttaatagatgctaagattactcccctaaaaagtgagtaagattctggcctagcacaggatccagagggctgggtatatgttttcatgtaagtgtagaaattatttatgaccagaccttgctacagaattttcattgatgttggtctgtcattgtcagtgtacttttaagacttggtgacataaagcagtggaaatattttcatgcttgctcataattctacagcactctttcctactcaatagtccttccacatactagatagatagatagatagatagatagatagatagatagatagatagagaaggcagtatttttaaagcatttaagctttatctttattaattatatatgtatatatctatgtgtgttttggggaatgtgagcatgagagtacaggtgcttgaagagtctagaaaaggacattttgattccttggagctggagttacagagccagtttgagtgctggagactgagcacaggaccttggaagaatagtacacacacttaaactcttagccatctatctcttctgcccctacatttttctttaattgtatttgagcgttcctttaaatctgaatgtaaggaagaagcacttttctactagtttttttttttcttttttaaggacaaagcatttgtgtaatgggacataatttcctgcctgttcttttaaatggtgtttctagcttcaacacatctatgttgaagtacacagatttaggctttcttattttttcttaaaccgtaacttttcattagggatcataagagtttagagggagaagatatataggtgtgtaatgaaaatgcatgacagaaagtaataagtgctattagagagctaaaaataaggttcttcagagacagtggaatgagatgaattactgtcagtttttgcttccatggctatgaagagacaataggttaactttgagcttaaatataatgttctcaaaaagattttctacccttaaaaaggagagacatttgattcatcattctactgtcttaagtatttttataagcccagtcttttcctaggcacaaataaaatccatttttggcctcatgctattccatagggaaaaggtcagatcagtctagaataggctaataatcaactcagcattttatagtggcatggaagttaatctagaatcatttctcctctcatcttactctgtccacttctaaattctgctcataatctgtttcttaaaagcaactaaagcttaaaactcacattaagttattctaagaatatttactactatctttattcttactgtgtgcctacctgtgtgacatttgccttttctataccatattcatgccatcctactcttcgattggactcccctactgcattccattttcaccatacatgcaactgatatggattgctttgccttgggaccctgtttgtagtctttcagagtaaaactcagtccttggggaagtcatcctgaccatatataaggtcagaccactgagtctcacagatgtaccttgtacttctcttacatagtgatccaacaattataattaataatgaatcatatagaaccagttgttagctgtctcctactctacagcaaaacttgaaaggattatgttttcacttattcactacacacctaataccagtgtctaatacagtgctcagaactggagtaagatctcaaaaatatttgttgtaaaagaaaaaagagaatcctctcatcacataaatttggtttgaatcttaaaatttaagttcttacgtttgatcacgttgttttaaatgttgaaatgtttagtaataccattatgtagaggcattgaaaatatgactctcagccatctgatttagatctcctatatcagaaactctgggaattaggcctagcagtgtgttttccaacaaacttcacaagttacagaatgacagatttaaataacagtagtttccatatctctctttttaagtgtatagaaatacaagatcaagggtctggtagatatggtgtccaataaaagcaaatactgtccacatgtcagctaaagtagagggatactaaactctcaggcctctggtcccattaacaatggattgactttttttttccagtggaggaacattggctcccccctgccttttattgaaaatagcccattcttccttacaccatatatccataattatggttttgcctctctctagtccttccagtttctccccatttcccctcccatctagatctctttctgtctctcattagaaaacgggcttctaaacaacagtaataaaaataaaatataagataaaacagcaacacatcagaataggataaaacaaacaaaagaatgcaaaaaagacaaaagaaacatcaacgtagagacccacttgttggtacactcagtaatcccataatagcataactggaaaccataaaatatacccaaaggacttgtaggataaaaagagatatgtataattaggctaaaattaaaagtaagattttaaaaaagccttgacatgacatgagacaagaaacccccaatgatgtcactgaactcattttctgttgttggccatctactggtgggcatgtagcgtacccttaagagttgtttgtttcccagtgagacccccgcttagagaaaaagtaaagtttcatctgcaaggagttattaattggagagatcttctggtgtagggatgaggacatgtgcacacgtttcagtgctagggcctcacgtggtgccgacccatggagacccatggagaccctgtgaactcttcttcagtctctgtgtaaacatgtgcatcggacatgctggtttagagggcctcatgttcttggtgtcctccttcccctctggctcttacactctgtctcctcttccacaggcttcgctgagctctgaagggagggatttgatggagacaactcatttcgttagggctgagtgttccaaggtctcttctctctcttcagaatgcctggctctgggcctctgaatttgttcccatctgctgcaggaggaaacttctctgatgactgagcaaggaactcatctaagggtatagcagaatgtcattaggagtcattttattgctatgttcgtgctctgcaacagaagcagtaagagtttgtctctactaagaacatagtaatctgaagctaaaggtacataccaatggctaagggtgtatgtttggagaagaatatggggaaatacccttctgactattccagaagggtatttgactttacccttggtactgggcaatctaatctcatgttcttagttaccaagcagtgtcacttatggatttcatctcatggagtgtatcttaaatcagatacagagttggtttaccacaagctgggtaggtatttacatttcatgaaggccccaggtcttgtgagcacattgcagaataagtagatgttgtcagatgtcatctgaaacgtaaacaaggtctacatactcaacacaaatctggaggtttaaaaaatatcttccatttgtgattccttagtctagattttaacattaatcttgttaaacaaatctagaaaatgattgtaaaactaataatgttcatgatctttagtaatggttggagcctttgactttacattttttgttcattacaagtgaaatgtctgttttgtttcgttttggtttttgttttgctaaagcttactgtattgtggtttcattaggcatctttttttctttttatctcaaacatcatcaaacaaaaaggttttcacgtatatatttttcgctctgttgagacatctgggctgcagcacaccatcaggttgatggattggattccttgttaaaggtcactcatccccaattctgtcatcgatcctatatttgcttcatgtttgattcaagggcacaattttgacaaaaccatttctacctgaatgatgttaggtgacccatagaaaattaattaggttttttctttaatataacaggcatctaggcctcactgattgttgttctgattagaattgggaagagctaactaggaaaaagatttcgttggtttgttttcattttatttttgtttgcatgagtgtctgtgtcccatatacatgcctggtgtgctgagagttcaaaggagggcatcggatcccctagaactggagttatggatgattgtaagctgtcatgtgggtgctgagaatcaaagtcaggtcctctgcaatgacaagtgctttttaactgctgaaccttcctaaagtaaaggtataaaatatgtttggggctgaggagatgtaagatagagatagtttagaaattttccatatatcctataaccagttttagtaatatacacatgacattaaatgaaccaatcttgatatattactttaaaataaagactatattgatttgtattccctcagctttcctttaatgttatttttgtctctgcattccagaataattaggtcattttgtctcttcaggctttttgttggttttgacagtttcccttcaatttgatgaacttgacagttctgtgaagtatgttgacatttttgtttcttgatcagaattttatttttaaaaaaccattaaataggctttattgggcttgggaaggagttaaagtgccatttatgtaatatcatatcaaggtacacatcaccagcatgagttattactggtgctatctgtcctagttgttcttttttttctggtgccatgataaatcactgaccaaaaccaccgtggagttagaaaaggttcatttgatttacacttccatatcacagtccatcattgagggaaaccaactcaagcaggagccaggaggtaagaacctaagcagagaccatggagagacgcttctgacttgctcatcttgattttttatgcaactgtcacttacccaatgtgccaccacccactgcatgctggaccctccccctttagttcatctatgggttattctggtggtggcaattcctcagttgaagttctatcttcctaagtgtctattttgtgtgaagttgacaaaaaccaaaccaccacaatattgccccccaatcacctatctaaaatagtatttgccagactcatttactgaaaagatactttttttttctatttctataccatatttggaatcaagtcactaagcatagcctaagagtctgttgtataaagaggttccaatcaatgactgttttgctgagaacttgtatattgcttttcactatctcctttaattagggaatagttgtatgtagttagtatgtttaaagcatttatttaaattataaagtataggggctggagagatggctcatcagttaggagcactggctgatcttttagagaacttgggttcaatttccagtacccatgtagtggctcacaactatttaactccagttccaggagatgacaccctgttctgaccccagtagttaccaggcacaaatgtggactacacacatgcatgcaggcaaaacacctatacacttaaaataacgattttttgtaattgtaaagcatattgtgctgttgaatggtttttaaatgaaaattgatattttagtgactcttctggggtgcttgtgggaggacttgatgcagtttcgcatatgttcctgtccacattgattgttatcccctcagctcccaagtcttttctgtgtgcctgctagtggagtttagttgactgataagtatgttttaagtatattgcttcttccctgtctcacaaaaacaacaaacaaacaaacaaacaaagtatgttgtttctttgtgagagggaggggaggatgagacatttcttcctgtagcccaggctgtcttgagactcaatcagtaggaccaggctggccttgaactcagagattcaactgtgtgtgctttctgagggctgggattaaaggtgtgccaccatatccttgctgagtctttttgattgagaagaatgccttttgtgtattgtgcttcttttgtcaaaatagatatggcacaaaaggtttgcttgttttgttaatgtctttgttttgagaagatatctccaacctgaaaatgtgcattttgtacaatttgataatcttatttgaaaaataacattgctttactttgcataaatttggggctgttgtaaaccaaggaatatgtggcatgttctatgaagaaggtttattctctagtaattatcagattcacagggagcaaagaatgagaggatagacttcatatttgcacaaggactgttgaccagggtcagatgtgtcataggaacattatctctgtcagtccatctttcctttatattcactctattcataattcatgttttgattcatagtgttcacttaacgtgcttcccagaaagactgttctggaaaaaaaagcttacagtaagtaagcaattaacttttcattgaagctaacctttagtttttattagtaattttcaattcctccttaattcaataaataaggagtaataaacctcactgtgtttagatatatatcaaactatgggaggtttcattcaaataatatttgtcctaagaaagcaaatagacaaaaatagggatttttctgcatagattaatctttgtagctactgaggtcttagactccttgaatttgaaagaaatgctacaaaagggaggttgagaatgtttatgttttatttagttactttttcagtgttgctatccagtatctaattgcatatgtttactgtatagaagaatctagtactaatttttaaattttatttttattttattggtatatttactttatataattgttagtttgcaacaacatctagttcaccttgttatttatgtcttactagattaatatatgtgtgttttatatgaacaaataacaagttttgctttttagcattttctatgtgtacaggaggatgtgcatgcttgcacatgggagaaaatgcacatgtgtacatgaatgtgtggaagcttaaggttgatgtcagcagtcttgttcagttgctcaccaaaactctattcactgagtcatggtctcagttgaacgttgagctccatgatgtgactagtgtggctagcctgcttgcttgagaatcctttttcttcaccttctgaactctggtattacaggtgagctgccacaaccacctaacattcacactgaatctggggaatctgaacttagttctgtccagtattctaaccaccaagcaatctctttttaaatctttttaacaaggtcttattatagagccctggctggacaggctattatgtaaagcctgataggccttgaacatctagcgattctcttttctcacattttctgggattattggtatgcactaccatgccgacctaatattgatgtactagtagtaacttaacatcacaatttattaagatttccttagtccctagtaactcttttctattaatagtcctatctaaaataacatcatatttagccatcatggagttttgttttgttttgttttgtttgcaacaggttttcactgtagccctggctattctggaactgaacctaggtcttctaaggagagaagccagtgctctgaaacactgagccatctctccagccctgctaagaaatactcataggccgaagtgatttttcactttaattttattctgcattttccccagtaactaatattttattacacctcactttagtgtgtgtgtgtgtatgtacaaatcagagaaccacatgttggactttgttctcttcttcccctatgtgagtcctaaggatggaactagggtagttaagcttaatggcagatacctttacctgctagacgatttttgagcaagtgtttgttaacattattgttttacattgtgtatttttttaattagacagttttgagatttctagatatatttgtcaatttatcaaatatgcattttaaaaatatttccctgtttatggcttgtctttatattatttaactttgtttgttatatttatttatttacctattttgtgtgtatttgtacatacagatgtaggttctggggatcacactcaggtagtcatgctggcgttattcactaaaccaccttactttgccttgtttgtttgtttttgccttgttattttttaataatttttcaaaaggaaaagttttaagttttaggttgctttttatttttcagtttatatttttcagttttttcttttacgttcaggacttttctgtactaagaaatatttccctgacccaagttcataaatatttcagttctttgcagaaattttatagctcctatgcccatatttcagcgaatagtccacttcaagttggtatttattacagaaatgggttaatttttttttaatttggattttgttttgttcagttatcccatcattatttgttggaaaatacctttttttctgttaaattaatttggtattttctgtgacgaataaaaggtctgtatgtattgatttctagacaatctttgctttttcattaagctataaatatttgttttcttgctaatatcactttgttttgagtattgtaaagtatttttaatcaattgatatgagtagttcaatttttttttaataatagtttgagttgggcaggggatatatttcctggtagagttcttgcctagcatatttgaggtcttgggtttactacccagtaccacataaaaaattgtgtgggctcttagatacttgtttctactataacttttagaattactcccattaatttctgagaggggcctggagagacggctcagtggttaagaacactgactgactgctctttctgaggtcctgagttcaagtcccagcaaccacatggtggctcacaggcatctgtaatgggatctgatgccctcttctggtgtgtctgaagacagctacagtgtactcatatacataaaaaaaataaataaatcaagagagcctgtttaaaaaaaaaaaagataccaagcaagccagtgaggaggttccttttaaaaaaaagttttctgagaggaggcagggagaacaaacacttttaattgtgatctataagtttgggctttgggtatcttttagctgaagtatcagctctaccatttacttaaaatttttatgacactaatctctcaggaccaaccaggttaaaaaaaattcattataagctagtgatttcttatgccccttttaagaacagagtctgttattgactttgactagattggcctggagctaactatggagcccgggctggcctgaaacttgtgacagttctacactacttccagcaatttgggagtattatgaggaatatagatagtatatgtaaataacttcacacatagaatgtgttcaacatagtagtacctagtaatcaaattggtttttttcctacaatgaaatgtgtttcacaactgaaaataattaaattataaggattgccaaatgaaacttttagaatgattttaaggctatttatttttccaaagtagccttgagcaattcgaacatggtttctttacctcttttaaaacagtgtcagatacacacacacacaccaatttggaaggttatttgagacagagtttctctatgtatcctggtttttttggaactcactctgtgtagaccaggctggccttgaacttgaactcacagagaaccacctgcctgtgcctgccaagtgctgagattaaaactgtttaaagccatgctgagtccaacttggaggaatttaaaaagtacagttgagtgctttgtgcttttctactggtaggaagcatttatttcaacccagaggactgactgcagaggacattttatttcctgagtcatgtaggtgtgattgtttatgactcctgaggctctattctttaaggaacacagaccacttcagcctgtctggtggtaatttccagtaagattattttggttatcacaagtggagcccaagaagtttctgttgtcttagtcatttcaaggtaagtaagaatcaggagaaaaaaatgagtttgagaaagtgcataaagcctacaggaccaggacattaggagaagagttgtctctaaggttatcaatccatggccttctgtacattgattacgtcattacttgatttcatagtagtattcttccaatcaaatgtatgctgcttgagacatgacaaaatggaaaatcaattgtatttgaagattttcttttgtatagaattacattatcccttgatgctgaaaatccgtttattatcagtagtcggtttagagtgcatttcttctattaccacagcccttaagtaaatatgttaaacatattgcccaaactgtggttcaagcaaccttatatcatagtaaatacaattccggagttatgtaactcttattgtttgtgacttctgagactctgctctttaatgggcacagaccacttcaaactgtctgaggtaattacttttcccagtaattttttttttttatcacaagtagagcccaagaactttctgttttctcagtcagttcaaggaaggtaggaattagggggggcgggatgagtgagtttgagaaagttctgttcatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacttcatcagatatttgttcagaaatccagaatttaaggcaatatttactgtttggtgcttttgaattctctggttcccaagtggagtatttattttgtaaaacaattcattttacattttggcagtggggtgggggagcagactgtgtagcatacctcagggtggtcttaccccaggctgtggatgatcttgaacacctgatcctagtgtttctacctctgatgtacttggattagaccaccttgctttgttcttggggtgctagatatcaaactcagcactttatgcatgttcaacacctattctatcagttctcctatcccagagacctaaccttcatttttgctgaattgaaagcacatgaatgacatctctttatttcattatttccttttatagcagttgagaataagtcttgcttctatttcttgcttttgctttgaaatagttttttataaagatttatttatttattttatgtatatgagtacactgtagctgtacagatggttgtgagccattatgtagttgctgggaattgaactcaggacctctgctcactccagtcctgctcgttccagtccaaagatttatttattatatgtaagtacactgtagctatcttcagtcacaacagtagagggtgtcagatttcattatggatggttgtgagccactatgtgattgctgggatttgaactgatgagcagtcagtgctcttaaccactgggtcatctctccagcccttgaaattggtttttatgtgttccagcctgacctgaaactcattatgtagccaagactggccttgaactctcaattctcctgagtccacttcccagttccacattaggttctaaagagatttcctttttttgcactgattatcattgactatttagttatgacttaggcttgattattatttttgttccttgttctttagatataaattctttgaaccttgaaaatgttctgactcttaacctcatcgatgttgtcgatattaaaaaatgaatatctaggcgggcgtggtggtgcacgccattaatcccagcactcaggaggcagaggcaggcagatctctgagttcgaggccagcctggtctacagagtgagttccaagacagccagggctacacagagaaaccctgtctcaaacaaacaaacaaaaaagaatatctattatctatctttgtcctcataattatgacaaagatgattagctgttcatctttcaaagagttcacaaaataacaagttagtaaaagagataaaatattgtgattaactttttctaacttgtcaaacatgtaaatacccctactaaattagctgaacaatgagttccagggtccgagcaagaatgtccagatattggttaactaaacttgtgagtaactttaactaaaataagtgaggcctagtcttacacattcaggagaggctactttgtgttccatgtaattctaaacattttaaagaaatgaacaaaaataaaattctattacccgaggattctacaaactaggagacaaaaaagaagtgtgtatagagattgttgtattttctgcctcatcgagtctagcctccataatgtttcagttttggttggtttttgttgttttgtttgtttgattttaaatcatgtcctttcctacttgggtgtgatttcatcacaaatgctagcatgattttttgtggctcttggagtgtccatgatcaattatgctccttgtagttggaagcctttgatttgcccccacttgattgccttttcttcttttcttcttttctttacttgttcttttttttaaaaaaatatttttattaggtatttttctcatttacatttccaatgctataccaaaagtcccccataccctcccccccacccgactcccctacccacctactcccactttttggccctggcgttcccctgtactgggacatataaagtttgcaagtccaatgggcctctttttccagtgatggccgactaggccatcttttgataaatatgcagctagagacaagagctcggggtactggttagtttataatgttgttccacctatagggttgcagatccctttagctccttgggtattttctctagctcctccattgggagccctgtgatccatccaatagctgactgtgagcatccacttctgtgtttgctaggccccggcatagtctcacaagagacagctatatctgggtcctttcagcaaaatcttgctagtgtatgcaatggtgtcagtgtttggaagctgattatgggatggatccccggatatggcagtctctagatggtccatccttttgtcacagctccaaactttgtctctgtaactccttccatgggtgttttgttcccaattctaagaagcagcaaagtgtccacactttggtcttcgttctttttgagtttcatgcatttagcaaattgtatcttatatcttgggtatcctaaattcctgggctaatatccacttatcagtgagtacatatcatgtgagttcttttgtgattgggttacctcactcaggatgatgccctccaggtccatccatttggcgaggaatttcataaattcattatttttaatagctgagtagtactccattgtgtaaatgtaccacattttctgtatccattcctctgttgaggggcatctgggttctttccagcttctgactattataaataaggctgctatgaacatagtggagcatgtgtccttcttaccagttggaacatcttctggatatatgcccagaagaggtattgtgggatcctcctgtaatactatgtccaattttctgaggaaccaccaaactgatttccatagtggttgtacaagcctgcaatcccaccaacaatggaggagtgttcctctttctccacatccttgccagcatctgctgtcacctgaatttttgatcttagccattctgactggtgtgaggtggaatctcagagttgttttgatttgcatttccctgatgattaaggatgttgaacattttttcaggtgcttctctgccattctgtattcctcaggtgagaattctttgttcagctctgagccccattttttaatggggttatttgattttctggagtccaccttcttgagttctttatatatattggatattagtcccctatctgatttaggataggtaaagatcctttcccaatctgttggtggtctttttgtcttattgacggtgtcttttgccttgttcttaaaagaaccactataaatgtttcttttaggaaacatttccttgaaagaaagtcttagtgttcacagtgatcacagtcctacaatgattacccttaatatatagctgagtgattcctcagtttgtgtccttgacacctgttataagatcaaatatctgatagctgcttgggaaaaattgaaggaatgcattttgagggcacatgcagttttagggtaataattgaggcagagtgcactacttaagcaaaactatgcatggaaggaaaagaggatttagtttttctctcttttttcttcttccctctttttctccttctccttaccaaataagtttatactattttcaagttgtcattttagggaaagtatgttatgatgcaaaacagtgagagaaaggagtatgttcctggtaattgaaaatgatttgtgttttagaattttgttaaaaacagtgaatatttgtgagggaacttgagagaaagcaaagctcatggaaatgtaattttatttttgccaagaaaattgtgataaagtttaattctcatataacaactactaccagaatggaaatttccatagagcaaagagatttcagacttgtagcacatatatattttagtactcagtgtagaacaataattcggtaatagaatttgacaacttttgacaatttagtttatgatatatgaattaatgaaggcccattcatcatgggatttggtgactctgccaattttggccatatttttgatggaaaagaacagctagttgtccagaagcccaaattttcactatgatctctgtaccacttcaacagaatgccaaaggacataaacatgctgcaggtaagacttgagaaaactccatcagcaagtagagatttggcccctggttggtatgaaaagttttactgtagcctgtggtgtgtttgtatgtccatttccccacctatccatttaacagaatcaagtttcttggtttgtagcatgaggatgaataaaataacacctgcctcattggcttgctatatggatttaatagagaatgcaggggatggattcaactgtgctcaataaacagtacttatattttattatgtagcagaagcagggggctgagtaaattcttctttttaattaggtattttcttcatttgcatttcaaatgctatcccaaaagtccctcagaccgtcccccccactcccttacccacccactcccacttcttggtcctggctaatattactagttgagtattatgatcaactttgctcatgtattcattgaccattcatccatcctgtgataattcagcactgtgttctaaagactgtcatgacctggactgcactttatttaacacgcaatttgttttttcactttatttgatgcccatctcttctttcaactgaggacaacttgttttgactcacaggataaaattacctattcctccattgtattcaacttagtacagaataccccctttcccctcttcctcattgacttatctctcatgtttatatttaatgttcaaattagtagcgtcttcaaatttcaattcttttgattttatgtgcttagttccagaaagtcccaggcatgtgaaagaaatgtatgatgcctgagttttgctgtttaggttaggatatactttgaccaattagttcttctctatcttcttttcttttactgctattgttcatacaagattaccttttttacttttgtatttgaatgtcaacagagatgatcatttctccatagagcttatccttttttataaaaagattatttgtttatatatatatatatatatatatatatatatatatatatatatatgaacactctatttatatgtatgcctgcatgacagaagagagtatcagacagaagaaggcatcagatctcatgctgtgagctaccatgtggttgctgagaattggactcaggacctctggaagagcagtcagtgctcttaaccgctgagccatctcaccagactgagcttatcctatatatatccctttatatttatacatatttcgtctaatcactgtcgggctttgttttgtactatgcattttaaaaaaagagctcctcactttcagcccacttaagtaaaaaaatatgaattgaatcatgactagtagggaatatagtactgctatttatacacatgtgtatcaaggaaaggggaagccataaattaaaaaatttggaaagtaatatttgaattcccagaggtgtcttttactcagaacttccaaagctgaacttgcttcttgaatcttctcctttaaactgcctcttcttggaacccctctagacatttgtagcagtcaactctcaatgtgcttctttcttttgtttttttaattaggtattttccttatttacatttccaatgctatcccttcaaagaatgtgcttctttctaaagctggttgatttttgtctgagtctggtccttgacctcacagagatctacctgcctctgtctcccaagagctgggattaaaggtgcttaccacctcagccagcttcaggcccaccccacccctgccgcctcttttgataaggtctcactgtgtagccctagctggcctagaacttgctatataggtcagactgttctcaaactcaaaaagatccacctacctctgccctctgagtgctgggattaaagtcatatgccatcactctatactgtgatggtgctatttttcagattttcttcattgtgtaaaatggcacaagaatttttttttttaaatcaaagaaatgtgtaacttgtaaataatattacaacttgcaaacatactagaaggtattattcatataaattgttgctagtcatcccagatatctttccatgtactctcttaatcaacattgaaccttgaatttgaattgatagtcagtcagtcttctaatatgcctcttttaccagagcatcctgattttattgagtgctttttatatttcagttctggtattgtccagtgtcaagctattgagtcattagaaaaataccaatgagatagatggtgttaatgttcttatttataagaaactaaggttcagggatattaagaggtttgtctgaattacatagttaatttggggtacagcaggaagcttatcaaaatcatttgctctagtgtcaactctattctcactgggccataggtgcatggatttggaatgactgactgctgtctccagcattgtttttggatctagctagctttcaactcatgtttcagaagagcagcagagatgactcatttatcaacaggatctaagttcaatttccagcacctatgtcaggtggcctaaaaccacctgtaactccagctccagggcattcaacactttttggcttccatgcataccaatatacatatagaatatgctcacagacacatatatacataatacataaataaaaatgaaaagaaatcttaaaaataaacatttttgagttgcgattgattgattgattgattcatctgtatttttgagaagggtctcatggaatccaggagggcctctaattttcagtgtaactgatactgacattgaacctcctgatcttcctacttccacctctgatgtactgggattatagatgtatactatagtgcccaacttaaacattattttaaattgtgataaaatagacataataaaatttaccatcttaatcacttctaatggcatggtactttggtaataagtttattcatactgttttataactattactaccattcattactagaaatgtttttactttgcaaaatgaactttttaattggatattttatttatttacatttcaaatgttatcccctttcctagttctctctctctctctctctctctctttattagatattttctttatttacatttcagatgttatcccttttcctagtttcccctccaaaaatctgttatcccccccctgcaccccaatccacccacttcttggtcctggcattcctctatactggggcatggaaccttcacaggaccaagagcctctcctcccattgatgacctacaaggccatccgatgctacatatgtagctagagccatgagtcccaccttgtgttttctttgattggtggtttaatccctgagagctctgtgggtactggttagttcatattgttgttcctcctatggggatgcagaccccttcagatccttgggtattttctctagctccttcattggggaccctgttcttcgtccaatgggatggctgtgagcatccacttctgtatgtcaggcactggcagagcctcttaggagacagccatatcaggctcctgtcagcaaaatcttgttggcatcctcaatagtgtctgggtttggtggttgtttatgggatggatccccaggtggggcagtttctgggtagtcattacttcagcctctgcttcacacttagcctctgtaactccttccatgggtattttgttccctcttctaagaaggaacaaagtatccacactttggtcttccttcttgagtttcatgtgttttgcaaatcatatcttgggtattctaaggttctgggctaatatccacttatcagtgagtgcatatcatgtgtattcttttgtgattgtgttacctcactcaggatgatgccctccagatgcatccatttgtctaagaatttcataaattcattgtttttaatagctgcatagtatttcattgtgcagatgtaccacattttctgtatccattcctctgttgagggacatatgggttctttccagcttctggctattataaataaggctgctatgaacatagtagagcatgtgtggttattacaagttggagcatcttctaggtatatgctaaagagtggtgttgctggatctttcggtagaattatgtccaattttctgaggaactgccaaactgatttccagagtgtttgtaccagcttgcaatcccatcagcaatggaacagtgttcctctttctctacatccttgccagcatctgctgtcacctcagttttttatcttagcccttctgactggtgtgaggtggaatctcagggttgttttgatttgcatttccctgatgattaaggatgttgaacatttctttaggtgcttctcagccattctgtattcctcagttgagaattctttgtttagctctgtaccccatttttaaatagggttatttgtttttgttggagcataacttcttgagttctttgtatatattggatattagccccctatctgatttaggataggtaaagatcctttcccaatctgttggttgcctttttgtcttattgacagtgtcctttgccttacagaagctttgcaattttatgagctcacatttgcccattcttgatcttacagtgcaagccattgctgttctgttcaggaatttttcccctgtgcccatatcttcgagactcttccccactttctcttctataagtttcagtgtctctggttttatgtggagttccttgatccacttagacttgagctttgtacaaggagataagaatgggtcaattcacagaagtggatgctcacagtaatctattggatagacacagggtccccaatggaggagctagagaaagtacccaaggagctaaaggggtctgcaaccctataggtagaacaacaatatgaactaaccagtacccccagaactcctgtctctagctgcatatgtaggagtagatggcctactcagccatcattgggaagagaggccccttggttgtgcaaactttatatgccccagtacaggggaacgccagggctaagaagtgggagtgggtgggtataggagccgggcggggggagtgtataggggactttcgggatagcatttgaaatgtaaatgaagaaaatatctaataaaaaattgaaaaaaattaaataaaggattactaacattgaatatggaataataaagaatgggtcaagtcccactcccccccaccccacacctttaatcccagcacttgggaggcagaggcaggcggatttctgagttcaaggccagcctggtctacagagtgagttccaggaaaccctgtctcgaaaaaccaaaaaaaaaaaaaaaaaaaaaaaatcacattcttctacatgctaaccaccagttatgccagcaccacttgttgaaaatgctgtcttttttccactggatggttttagctcccttatcaaagatcaagtgaccatatgtgtgtgtattcatttctgggtcttcaattctattcaattggtctacctgtctgtctctataccagtaccatgcagtttttatcacaattgctctgtagtaaagcttgaggtcagggatggtgagtccagcagatgtccttttatcgttgaaaagagttttgctatcctatgttttttgttattccagatgaatttgcaaattgtcctttctaactcgggaagaattgagtcgtaattttgatgggaatttcattgaatctgtagatttctttcagcaagatagccatttttagtacattattcctgccaatccatgagtatgcagttttccctcttaaactgaacttttttatccattaaaccataagtccccatttccctctcctaccaattcccaaaatctccccagcccctctcagtgtcattattatttcttcttcctttttcataatctatagagtcccatttgtgctgccatatactcatgagtatgaggctactatccactaaagggtggtcaatctaccagggccatacccttaaaaataactgagtctcccttctccataagccatcgactaagatagtcgtgtgtgtgtgtgtgtgtgtgtgtgtgtgtgtgtgtgtgtgtgtgtgtgttgtttcattttgcattgtttttttgagacagattttctctgtgtaacagtcctggctgtcttggaactctctttgaaaccagggtggtttcaatatcatagagatccaccagcttttgcctgtgctgggattaaaggcatgtactaccttgcccggcagcagtctcttctttctttgaaggtataatatcaatcctcatagtcaacagctttctgattaatgtttaaataaaatattgcaaattcaacttggatttacaaacatgcactctagtattgaatcaggaactcagacatttttagtagaatttagaatgtttttaaaattatgtgattaggcacatggtagcacatgcctttaatcctagacttcctgaggatttctgcaaagtcaatggatctctgcaaagtgaatgccatcctggtctatatattgagttttggatcagtctgagttcataatagtgactctgtgtcaaacctacaattataaaattgtgtgattagaggctggggagacagctcagcagctaagagcacttaactgcccttgcagagtagagtttgtatcccagcatctatatcaggcaatttagtgtcctgtaactccagctctcaggagtccagtgccctcttctggcatccttgattctggcatacatgattgatggtaagatcatcatttagtagatttattttaaatatgtacaacttttacctttatgtatgccgatgcaccacatgtgtacagtgcctatggaggccataaaagtgggtcatatctcctgaaactagaattgtatgctgccatgtgggtgctgggaattgaacataggtccttagggaaagctgctagtgttcttaaccagtaaacgatctctcccaattccagtagaaattaattctcctttcccttccccttcccctcctttcccatcctttccctcttcctcctcccgcctatcccctctttttttatatgtagtttgagctaggctaatacctggagtcaccggagttaggaggatcacagtcagtttgggtccagctggggatatatagtaaattccaggacagcctacgctatagtctgtcataaaaaaatcaataaaaatgtaactttatgtcttaaagaactcaagttttagtccttaataaataactagttttgtatttagtaacatacagagaataactgcactgaaaggaaaatgaagccctatttctgggctgttcctttattcaagaccaaaaaatagtttctttggaaaaaaaccccacaggtctgctcatatgagttgctgcatcaggctaaaaactgcattttattcagtaactttaaataatgacattatatatttgggagtgctttagacagcaaagtattatgaaatgctgaatacaaaagctgagtaaaaaatactctgctttttagtttttcttcctgtttttattaatatttagaaaatagagccaggcatagagtctcacacatatagtcccatcactaggaaggttgaaagcaggaaggtcatgaattgagaaccaacctgaacacaacgagtatcagtccaactttggatacatagagtaaggcactctctcaaaccaaccaaccaacaaaccaacaaacaaaccaacaaaccaattagaaaatggcttgtggggttagggatgtatctcagttggtagagtccacagaatgcttgtctaaactgcaggaagccctgtgttcagttaccaatacttgattaaactggatctaatgattcataccttcatcccagcatttccagcactccagagggcgaggcagaatcggtaatttaaagtaatccttgggtttgaggctagtgtagactacatgagaaaaaaagaaaagaaaaaggagccaggtgttttaatggttttaatcccagcactagggagatcagtgaatctctttgtaagttttgaggccagcgttccagtatagccatatctgtaacagagaaaccctgactgaagaaataaaaaataaataaaataaagaaaaaagaggaacttgcttctggggaaatattcaaactagaagaactctgtagaccaggctggcatcaaactcagagatatctgtctccttctgcctcctgagtgtggatgggttttttaattttttcatggtaaattttcactaaagttaagcttgatgtagattgtttgaaggttatttttactctgaaagttattgtaatcaaaataattcttagctcctttaagataacatttccgtgttttcatatcctctttaccagggtaaggcccatctttttgtttgcttttatacattttaaataaaaaattagttacatcattttctacttcctttcctccagcctttcttctctgttattattgttaaaacacacataaatagctaaatacagcctgttcaattcatttttttgtttgtgtgtaaatggttttagggctggccactttgtgttggataaccactgtgttcattctgagattgtttcacatgaggtctaggttctttaaaatatttttgttattctttaagataggattttactgtatgggccaatcaatcctggaattcttgattcagcctactgactgctgggatcactatgcccagcttcttctaaactttttaagaatcaatacctattagtactttgttgtgggtcagatctgtagaacatagtcatattgtccaagataaatgctatccattggaaacagtatcccatttctcctttctcccagttcctggaaatcaccatctaattcttttccctgattctctgaatttgtgaagttgaaatgtctcatataaatgaagtcatatgttatttgttcttttaaggctaggtccaaactcataagagatccacctgcctttgctttcctagtactgcaataaagatgtgtgccacaatgaccagactccattctgtgagcatgtcatattttctcttccttccctttcattagagaaagtctaagtctgtaacgcacactggctttgaattcaaaataaatctttctgtctccttggtttacaagtgctgggattatacgtttatgccactatatttaaacacattcttttcatgtttatctattagtggacatttgtatttttttaacctcttagcttattgtgaataatgactctgtgactaaaggaactagagatatcagcctcttcctgaccctcattttagttttttggttatatactctgaagcagcatagctgagtcatgatttttcaatacataaacatagaaggacacattcaaactatatcattgactttagaattctcctctgatagccgtttataggttgttctggttcagtgtcattgccacagctgccaaatttaagttgatatagaacaagtctctcctcttataaactcctccctcctgaggtacaaagctgtttttggagctgagcactaaagaggtcttttatgttttccaatgcccctcttatatagcagtgtgttcaaagatttttattagtatctcattcatgaattcttttttttatttcctggttaggtgatactgtctctatttaccttatcatctgagttatatacctctaagcctctttgttctttactctgttaattccaggtactcttacacttttatgggcacagatatggtcaaggtccttaagagttaggcttgtttcctttgggataggatctcatttatatagttcaggctggtcttgaagatgagatgcttctggcttagcctactgagtattgagattctagatgtgcaccaccacacatgactctcttcagcagttcttacttaggtaaatacaatcacatgcaccccataagggattcatctttatgtggccttgctcattgtcttacctgttttctttcaatggtatgtaaactccttgtaaggcagtgagtcattgcatccatcgcctgccttccagtctttacaggttaactcttctactctttatttcttagtctgccttattcctcctcatctttataagagtcacttctggtattgtgtctgtttatagagccttacaaacttctaactggctttgtgttcatctccttgcttgtagctcctctgatgttttatttaccacattagggtttgatgatatgtagatatctgttttctgatgaattgtgaattctttgatgctgcagccatggtgaaatccttatctagtctgtatgttacttacattaatccttatagtaatatcctagtagtacacatctaatttacagataaagcaataggtgaagagagtaattaattagtatttgccaccgtgaggtaccttgtttgtaaggagcaaaaacaaagtttcggtctgagattttgacaccactcatcctatttgggtaagaaagtatactattaaccagatacagtagtgcagatctgtaatctaagcactgtaacctacagcaggaaaattgtgactttgggaccagcctgagctataaagagagtttgaggcctgtctgaacaatatgacaagaccctgtcttgaaaaataagagaaaaagaaaaatacaccattattcatcttagtgttgaaatctgtcgtattactaagttttgctacttttaaattgcttaaaaaattttatgtgtttgagcattttggttttgcctcacatgtgtgcctggtgcccatcgaggccagaaaaaagtctgttgggaatcctttgggactggagttagaggcaattgtgagtcaccatgtgagtgctgagaatctgatacagagcctttggaagagatggaagggctcttcctgctgagccatctctccagcctttgttttaccactattaaataataggcacagtgtttaaaaaacaaacaaacaaaaaaaaaaacttaaagctcttcaaaggcgggagatttttttttccaagacagggtttctctgaatagtcctggctgtcctggaacttactctgtagaccaggctggcctagaactcagaaatccacctgcctctgcctcccgagtgctaggattaaaggcgtgcgccaccatgcccggctaggcaggagatttttgccaccatttttgagaagctaaatccacatataaagtatattcaattcccaaattaatagttgtaaaattgtgttaatgtatgctatatgtatgttaaattttatcacaatgtttttagatgtgttaagaatccttgacttcgtatcttatttctattctaaaaattttggatggctaatatttttttctttaaaagtagattaggtttttttcttatagcttcaatatttttagcaattttgagctttccactaatgaggcttttctagtttctattctattctgagcaatatttctgtcattactctttatctttgaattaagcatcttagtaattatatgccacttgggctgctgtgtgaccctctggaaatctctcttatacagtcttcaggaatgttaaaaacaaatgtgcttttctaagtggtagagttaatagataaaatcattttaaaattaatattcacaggaaacagttctacctagcaactcgtgtatagaatatactattattagggcatgtatgtcatttccatgccctttttgtcttctttggggcaaatctcttcttttcttaaaaacaaatcacaaaacagtatgttttggtggtagaaataaagagtcctattcatataggaaatgctcccaaggctggtaggaatcatgagatcaaaatctaatgttttatttggggcttagctgacatctttaaaataaattttgttattttagaataataaatcatacttcatacatatgaagttatacatgaacacagcattgcacatcactcctaaccctttttccctctctaactcctcccatgatcctctccataaatttattaacttagttatcactgtaacatgtatatattattataacatgtatatatgtacatgcatatttgcatataacctactgagtctatttccctttgcttatatggacatatgtccgaggctgaccactttgcattagtcaatgtatatgggagcttatccctggaggagaatgattctcctcaacagtcattggtcacttgtagctcttcttctaggaaccctgtggaatttacccggtccatattagcatgtcaaatgttgttgtcattatgctgttctcatttaggcaactgaatgagtagttcacaggtaaacttttcatatagaagatactaccacacagaagatagcctgctcttctagcttttccaatcttactctattctcttctacaatttcccctcagccttaagtgtaagtgctgcattggggatgtattagagttagatacttcatagtcactttgaacattttgactactcatggatttctgaaatagtctcctatctgatgcaagaagattcacttagaaataagaactacatttttctgtgggcaagtatttagaatacacttagttcaagaaaaaggtagtagagggttctcctctttggtctgtaacccactagcttcagtgtactaggtatgaattctttcctgttgagggaaattaagaacccaaattgagggaatagaaaatgccttacttaattattaaatagttaatagtactggctgttctctttcataagacttgagttaaagagtcccaactaccatatatctgctcacagcccaggggatccaagagtaccaggcaacccattaggtgcacagacacacaacagacaaaacatccatatgccttaaataaataattttttttaaaaatgagtctaatatatacaaaatggaagaactggaaatgagacatttgaaaaaattctttgtataatgcaatggatacttttcttcaatgattattcttttcttttacctcttaaaatctatgtatacatctattttccttttatttcttccctggtctctaatggtaaattagatttggaataacttattagtagtttacaatcactgggtaaagacaactggaatcagtggtgtagttttattcttgccttatccctcttgagatgtcatggaaatagatactttccctaattatagtcattaaaaaactaatgaactcttctgttttataaaatcttctctatttcccttggctaaccaccttcttttatttatactgcatgtgctactgatagttgctgtttatatcattctcaattcaaacacatggttccttccttcacgaaactagacacatatacattgtagaaaatggtggcttacaaccttcaataactccagttccatgggatccaaagctttcttctaacccctatgaacacaagacatgcaagtaaatacatacatgcaagcaaaatattcgtgtgcataaaataaatctgaaaaatagaacattgtgcttgtaaggaaaggtttcattagggtatttcctttattgtttacatgagggttgactgtctacattctggtaagtagcatattatgactataatatttatcttcttgtaggaatatatttacatctttcttattcagatttggcatagcaaatgaataaatttaatcctgtggagtgttttttaaaacacataataatatttgcctcattaaactattatgtgtgcaactatagaatatagaatattatttgaatttttatggaattcaatgtgacattatcatatagatcactgatcacatttgacctttctttttgttaccctagtgcttcctcagtccttactcatcattctgctttgaagtcagcctctgtaaatcatgtacacattccacatgtaagcgaaaccctatttgtctttgtttaccttatttaccttatcattttgtcctctaatccaatccaacttgatgaaaagacaagatttcattatttatagataacagtctagtgtttgtacgtgtgtattacattttttaaacatgaacctgttgaggattacctaggctgattcaatattttagttattatggataatactgcaataatcttaatagttcactttctaaaatcaaagtttaaaagttttaagtataagcgattaccaaggggtactgcatttcttgggagtgatgaaaacctaaaattgcattgtgcttatagttgtatgatgttttgaatatattaaatattatttcatgataaataagtatgtcctatgagtatattaatgacaggttaataaagctgtttgaagggatactcaaatcattatataactatgctacaatttagttagctctgtatcctctcataaattactttcttccctgtatcctgacttctttaaatgtgtagttaggataatattcagtaaaatattctgttatcagctggttatgagaataaaagtgcttagaaaaaaatctcgggatggatgaattaattttcaatggatagataataaatgcaagcgacttaggattttgttactcaggaagaatatgtggttaggcagaagttacagaggtaagggaaatatcagcatttattattcagggaggaaaagcagaggtatccaggaagggaagatgaagattccttaaagaaaagtggtatcatagaaataaagggaaaacagtctttctgtggattgtggtggtaaggctagagagaagttaaagcctggcagctggagctagtgttttcacagtaatggaatacttacctaccatgcagtagagttctggatttgttttcataattctataaaacagaaaaacaaaatcagaagaaaattttaaactgtaagtttccattggatttggcaagtttgtatcgtgagaatatattaaccaggttacagagaaaggaggttgagagaaagcatgaggaaatccctggatgtgttttgttttgttttgaggaaggttatcatttctttagcagttatgtgttgagttcttactgagtgttaggcattgctgcaagtaattgtggtataccagtgaacaaaacaaaataatttctgtcctaaaggctgttccttcacactagttctagtagaaggaagaggctaggaagagcttttgcaaggatttttttttaagctgaaaagtgcttaaacatatttaaagtaaggaataatgggggacagagtagacttgatgtgacttgatgatgtgtagaggcaaaatgatagctttggtgaacaaaagtgggaatgttgaaatcagaaaaggggatagctaggcttggtgatggcacacttttaattccaacacttggttggcagagacaagtggatctctatgagtttccagaccagcttggtctacttagtgagtttcatgacagccaggacaaaataaaagagaccctgtcttaaaaaaaaaaaaagaaaagaaaagaaaagtgtaggcaaaggctcttgatcagacttaaaacagaagagacttttttttcaagctagaacaaagagctggtgtatacaaggagggaaatgggaggagcttcttgggactaggtgacattgactgtgggttgaaagagcaaggtctcatgtggaatcaagtatggaagacaactggagggggctggaaaactttgaaaagtatacttaggttgaatgtgggactgaagaaaaggagttctgagagattctaggtttttggatcagtgggattggggggggcgtgtctgtgtggataatggactttccaagtactgtggcaagaagtagaatagagaacaagagtgaaagccaagtttcaaagtcttcatttagtgtcaataagtgaccaaagtgtttttgatagagatgatgagatggatgttaaaggtcactagagataaagatgtgcacattaacttgacaatttcatcagatactggaaggagatgaaatggaattgctaaagacccaagtgaatgaagtcaaaaggtctttgggtggatagttagttggccatgtgagaagtaactggtgtttctcttcacatgtatgagccaaaaggtatgaggtgatgaggtatataagcagtgcaagggttataggaaactctgggtggtgaagttggaggcaagtcaagaatatatgggtagttcctgggaagaatttccaatttaatactaaagagaaaatgtttaaaagggctaggctagtggattctgcagggaatagtataatcatgaaaaacgagctggagggagagcgaacagtaaggttatgagtacttgggagactaaaaccagaagatttccatgagtttgaggccagcttcggctacatagtatattccagaactggctaagctatagagtctcaacaaagaacagaaaatgtgttaggcagaaatatagaataatatgaagataagcagcaggggcacagtcaagagtagttgtaacaggcttttaggttttagtgggtttttttctttattcattctcattcattcattcattcattcattcatatttgttccgttttgctccctccctgcctgtctctcatcctctcttgtccccctccctactctttcttcttcaaaatgctatagcatgtgagcagttcagggtttcacgaatactctgttttctttttttttttctctgcagaaaagagtctaagcctatttacggttctaagttatattcttcctaaagcacaagccctggtatttattctacatgctgttttagaaatgtaataagaaaccgtggtggtgatgcccttttttaggttactttaaaaagggaaaaagtgtgttcttaggaataaacaagaccattgatttgtagtattttttagtcactgttggagcttagtttctgcttttagtataacagttgaataactggcatttattcatttgtttatctacttatttataaagaaaatggaaaaaggacattgacaaataatataggtccgagagttacagcgtaaaacagtggattgtatgcctgtcctatgaacagttgctaaacttagtcttatttaaacatctccaaagctgtttttggttagttccttaattcagattatcggactctagtatctgaacccaagtccagaggttattcatactaaaagttataagcaccgacactacagtattgcatgaattgattctttagaaatttattaattgtgggagatgtatttaggaaggaaacctaatgtttaacagctaagaaaatattggacattggtaaaattggaactctttggtaaatatttagttcattttttgatacaacatctgggtaaaaatcaaaggttacttggattcatacaagaggaagtatttcttttctttcttcttttattcttttctctctctactcctgggtgtttttctctctctctattcccagatgttctggaactcactctgtagacttgctagtctgtacaccaccaccaccatccacctggaagtatttcttaaggttaagcaagacatcctattttatcataaatgtaaatataaataagtcatgcaaagtttattttagaggatcacagttaacctaccaaattcataatgtggtttaatatgagagagagacctataagtctgaataatttttaaagtagtctattgtttttcttcttgttatggtagtttcataaacttaattattcctaaagcaaatctattcagataccacagagatagaaatcatatttagtaaacttaggttttgtttgtttgtttgtttgcttgcttgagacagggtttctctgtatatccttaactgtcctggaacttgagctgtagatcaggttggctttgaactcacagagcttcacctgcctctgcctcttgagtgctgggattaaaggcatgagacactataacccagctaagcatgctcggttttttccaataatctattttttattcactttacatcccaatcacagccccggttctcttttcccagtcccacccttaaatatccttccccccattgctctcccccttctgagaaggggagtccctcttgggtaccatcccaccctgggacatctgattgcaaagattctttttaaggtttaggttgtagtaatgattccgatgcatgtatgggacacattgctctttcgttttctttttacttaaatatgtgaactatgctcagattcctcccactgttctgctcctactttgatatattcatacttttctctgaaatatccctgtcttaaccttgatcttaaaaactagattgctttaaacatttactattaatacatacattaatggaaaagttggaacacttataatttctctaaatttttataacaaattctggaggaattttttatttagttttgttgctctgggtattaaaatccaacacaagagccattgctccttatataagaggcactccagcagggctcaatgctgaaataccaggtgaggcttagttttgacctggctgactaaaggcatgtgttcccaaaagagacatttgagcctcacttgggattgagggttatcatcaacagtgaggacacagtagatgaggtaagtgtaagcatcgggaagaaactgaggagaggcaaacaaatgtgtctaccaagacctagcattgttcataacctcaatcttttatcctaaaagcttgacttccctttaagtacataataactgcttatattcatcgaacataaatattcattctccaggattcgaactttttttgtccatctgactaattgatacccttggggaccctcttggttggctcctacattttatggagaggaaaactgagattcaaaagaacgcaacagtgattcaaagttgtttttttttttttttctggtgaaataaccttctaattcagcaagagagtggtgcttacttatcattttgccttacatattccgtgttctttaaacttgggtttcaataggaaggagcatacctttgatttataggttttcacaaatacaaggctatgtgcacatattatttgatttgatttggaaaaaatcataggggaaagtgaaatgtctcaagtcaattatttccagttctaaacctgtgcccctctacagagcaattcactactctgactgccttcttcctgttagttagggtgtttccaaaacaggatgggaggtttcttcctattgcctgcctgtgtagatacttcccccttattctcaacactcagctttcccctaatggcaagcattgcagagctttgttgtattccagagtgtgttcatttgattatacttgctgtttagttctgtttctagtagtctattgcctaccaagggccctccagtttataactgcacacaaccatgaggagaatcatttattataatgtttgaggaaccttctccttttgatagcattttgaatgtttcatggctgtccagtgaaatcaaaatatatcattctgccttcgtttatatgctcatgataagcattggacacatagctcagtaagtaaagtgcttgtctagcaagcgtgaggaagggcctaagttccgtcttcaccaatataaaaagctgagttggatgacatgtgctagtaattccagttttggctcagagacaggtaagaattcctggaacttgccagccagccttgcctaatcagcaaacccatgttcccagtgagagatcctgtttctaaaacccggatggatggtgtcctgggaatgacatctgagattgacctctggtttccacagatatgtacacatatgtacatgctctcctgcacacatacataaatacacagaattaataacttgtcatctgattagtatagaataacaaaatgtttgctcattttgattttacagccttactattttctcttccatttcacaagactctttgtatctcttttcttagaaaaatattcacattgaattcatttgtaccaaatgagtttaaagcatagtaaccctgaagatgtgtttcatttctttgtattaggattacagtttacatggagattaattttttaaatttgtatcatgagcaactggtcattggtaaataatatttttattatgctgtatgacaataatcattttcttagtgtttactatatgaaaagacactgctcattgtaagtcgtcaccatttttatttaaattttatatgtatatttgtctgtatgtacgttagtgtaccgtgtgtatgcaatgcttgtggagatcagaacagggcattgtatatcctgaaactgagattgaaggtggttgtgagctgcaatgtgggtgctgggaaccaaactcaagtcctctgcaagagcagcaagtggtcttcaccactgagccatctctctagactcaccatttccatctagattgtgaggaagctgagatattatggggtcaatgaactagctgcagttcaaatagctagtaagtgagaaactcagtacttggacccagacatttgattcaagaacccatatccttagcctgcatgttcctttattttgtcaatatgtcttctctgaaacatgataattaccacgccctcttaaagaaggtcattatcataaatgtcagagtactgctgatatttgaatattgaatattaaggtatatatccattaaaagacgagacagagctgggaagagatgggtcaattggtaaaatgcttgtcatgcaagcatgagggcttgaagttgcatctacatcacccatgttaagagtctggaacagtgatattcttttaataatcctgatgagtttcagattcagtgagagactatgtctcaaaaaaaaaaaaagatgaaaaagcaactgaaaaagacagccatcatggacttctgggctacacatgcacatacaactctcataacacagccttgatcaaatttttttctcttcaatagacctcaattggtcacagattgactccaaatgatagtgagatttgtttagtcaaacaagtaagccatatttggctataaaacttgcatcaatctgtccttccatcaatatatctagaatttttatctgctcataccatgtatttaggtgctgcagattccagttgtgtgctgagagaatcactggttgtgtttaccttagggaaagctactatatgtattttgcatatttatagttcccatttgttacctgggcttttcattaagttgctggttttagcaatctttcctttcttcctctgtgtttatttagctgtgtgctgcaaatgtatttatgtgattgtttaagtcctatataactttaatttttcaaagtcttatttttaatgatggttcttaaacactttaaccttccatttagcccactacccaaaagaggtagtgggaaagaaaggatatgggggaagtgaacctgtttagaaaggttctttgcagcaactcccatctgtgttgtctggaaattggcagttcaatttataggttagtagcagcagcttgatctacttacagatacttcacagatacagcagccgtccagttccatagagttgggatagtaaacatgaattagcagcagtggcactacctagcagacagagtcaggcctcagcctcagctccagtcagcaggcaagaatagggaggaatgtcagaagttgtaggctgtgcctctctcagtaagtgaagttcagtgaagatcaacaagcgttgcacagctagctctataagcaagcctagctcagcctcggtcactgtccttagagtcctatttataccctccaaacatcacgagtcctccacaggtcttgtctcaacatgtgtcttgtctcagcatatgagtgtgtcttagctgacatcactctgccagtcaacctaaatctgtagaaacagcaagaaagtgcagcacatcaccagaagtttttggatgcatttctctctatggactccttacaaatgtagattaactttgcaacgtaaggcagacccatacatgcttgtctttagcgaagaatccttcatctcatgtcctttcacatgcttgctttagcagaacaccctttcatccatttctgcttcagctaaacgttccttcatgagtctgccttagtttttcacccgtgcctacttcaggaagacagtccttcatgtgtttgccccagcaaaacacagttcaatgcaactgacttcccaaagaacccctaagtttccacttgagtcctacttggatatttggtcaaccccatactgttaaaaccctgtgcatgacaggcactggtatagccccaactatagtaggtcactgagacctagagaatatgtagaaagagtgaagagatcaagccttgcctccctcaggtttgctcttatttgtctgctgatagctttgtggaatggctaacagtgagtaagtgaaagacaaggctaagagttcctagggactctcagcactcatggaggggtcatagaatttaaaaccctctcatggactctgagaaggaccaaagcaagatgagagcctaaagaaagtgggacatgtcgtacgtgagttataacctggcattttcttaattaatgataatgatagccatgtttgtgatttaaatgtaccagtaaggtgtctgagtattttttcatagaagatcttagggatttcaaaacataaagagaaaaattcactaatttgagattatcaatcaaatgtttttcttttttttttcttttttaggtttgatttgtttttattttttctttttccatttttttattaggtattttcttcatttacatttcaaatactatcccgaaagtgccctataccacccccccccccgctcccctacccacccacttcttggccatggtgttccccagttctggggcaagaccaagggacctcttttcccaatgatggccaactaggccatcttctactacatatgaaatgtttttcttatagttaaatatcctttccatgtttaattttaatattttccttatccttcatgcttatttttctctgtgtgtgtgtgtgtgtgtgtgtgtgtgtgtgtgtgtgtatgtctgtgtctgtgtctgtgtctgtctgtctgactgtctgtctgtttctggttatgtatgtgcatatgtgaacaaccctgggtattatcctcatgaatgctatccaccctgtttgatatagggtttcttatcctggagctcaccagttaggcaaggctggctggccagtatacaccaaggatctttttatgactttcagcactgggatatcaaacaaatgctacatttgtggtttctgagtttacagtcaaactcagatcttcatgcttgtggggtaagcactttactgacaaccttctccccagttcaggttggctttcaactcacagtgatttcctgacttagccttctgagggttgggatactgtgaagaatggagtaccacacaggtttgggggttacgtttctaaaagtaattggacgggggggggggggtacacattacaatgtgttgccctttgttcttaatattctttattctttcctttcacatagctacagttttttcatggtaatttaatgtccatctcacagggtcttgtgtgcatagtgtctgtccatgtagaaacccacatcaggccttttctgacaagcctgaacagggtccaaagggtatatcagaagagtagagggtgctggctcagcatttaaaaacacttgggttttcagaggacctgggtttaattcccagcacccacaagggagttttcattgatccataactttcaacaatctataagtccataattacaggggatctgacctcctccagtcactgaatacatacatgatgcatacagaatataggaaaacacatatataataaagtgaacatatctttaaaaacatttttaaaagaatggaaaaatggcaggttttagctataaacaaatatagcagaagaaatctctttgcagtgcttcagtaaaatgatcagttttgcagtcatggtagccactttggtttatttggaatttgatgtgaaaacatagttttctttcctggccccctgtagtagtcatttcagcctattgtctttcttccctattccataccaccttgtgtagtatcataggagcaaataagaactgtgactaaatagaaataatgcttagattttactagggctgacatacatcatggacaaatattttgtgttcataagcattttggatttaggataaaatccattaaaagcaaacatactagtcttgtttttccatttcctgtaagtcaaagtaatataaacctaatctgattgtcttcataaaaacagcattatattaaggattatttctagcctaattcctgactttttaaatagaaacagccttagctaccatttttaatcaactgtttaatcagctggatatgattaatctgaacaactcttgggataaaactgtttaaaatctatgtaaatcaattaacaataacagtcatgtgagaatatgtctaaaaagtcactagacaatgttgctattgtcacaagtactgccttgtttttctgaaattaatccaaaggggtttcttttcatttgaattagtgtacatgtggttatgtgagcatctgtgcaggtgactacagagactagaggtgttgagctccctggaagttggggtcaggtagttgagagcttccagtgctgagccctgaactcaggtccttcaagagcagtatgttctcttaatgttagagctgtctctctagctctttaatcaaaggggttttttttaaacaagtttttaagaaatttgctgagactttgtgctttgctttgtttgttgttaattctctgtaagaaagattttatagaacaaaaagctagatggtgatggtacacatctttaattgcagcactctgaaggcagaggcaggggggatctttgtgagtttgaggtcagcctggtatacagaatgagtttcaggacagccagagctacacagagaagccctgggttaacaacccctgcccccgcccagcacacaaattttatagaacatgttattattcttttgccatgagttgtcctttgagagtaaagctaagtatagtggcacatacctgtaatcccaccactcaaagtggaatcagaagaattagcaggaatccagtgccattctttgcttcctcgtaagtccaacgctagcctgggaaaaataaggaaagtgaaaaaaagaaagtgatgtctgatagttcgaggccagcctggtctacaaagtgagttccaggacaagccagggctacacagagaaaccctgtctcgaaacaaaacaaaacaaaacaaacaaacaaacaaacaaacagatctgaagaatggttacaggtaggtaaagaagtgataggaattttctgtgctaagagaagtagtggaacagaagttctggggcaggaagaagcctaggacttgcctgaaatgggttgtaagaaataaaaaaggtgagatagaggtatagggtaagatatgagattagacaggagagaactagactatgtgtcacaccttgcagaataatttaaatgttttcagattggcatgaaaccattactaaagtaggactaataggactaggtttcattatgtgactattgtctgttattggctgggtcagcttttactgttaacatttacctaactgttcctttttttttttttttttttttggcaagcattcagttaatgttcattctctcccgtaataagctacttgaagacagacactgtaaaatcagtcactgtttccagtattttgtatatagtatgagatcaattaatacgggttaatgaagtgcttcctgacaggagcctgatatagctgtctcttgagaggctctgccagagcctggcaaatatagaggtggatgttctcagccaaccattggactgagcacagggtccctgatgaaggagttggagaagggactgaaggagctgagggggtttgcaatcccttatgaagaacaacgatatgaaccaaccagtacctccagacctcccagggactaaaccaccaatcacagagtacacatggagggacccatggctccagctgcatatgtagcagagggtggccttgtcagacatcaatgggaggagaagcccttggtcctgtgaaggctctatgctgcagtgtaggggaatgtcaggaacaggaatggacttgggtgggttggggagcagggggagtggggaggggataggggattttcagagggaaaacaaggaaaggggatagcatttgaaatgtaaataaaatatctaataaaaaaagaaaaacagtatctgtaaatttatcttgttagctggggatgtgtgtgtttgtgtgtgttggaattcacacaatacaaaattaactatttttgttacatttgtgtgtgtaaacattttgtgtgcatatggaggtcatatgacaattttcgggggtttgttttctcctatcatgtgggttcagattgtcatcagctcaaaattaactctttcaagacaaactttatatttatttagtagtatgaggttaggatatatatcttttgttgctgttttctccatgtttcctgacgtttttcctatctagagaaaattacataaattaaaacttccctcacctttatgtcttgggactagcagtaaattatcttagctatcttgtttgacaatagcttctgagatccgaatttcagaagtgatcctgttatatcaaagaggaaggaatgctgcagagcaaagcaaagcagaatcaaaacctgatgtagggcacaaagagaaaatcaggaggacgtggcaattaaaaggagcccctcaccctagagtcagttgaatgaagtcttgctgtttgtgactgaagaattcagcacactaggtcttagagcttctacaatagagtctcactgaggaaacaaactactcttaaaggtaggctgcattcacagcagtccatggccagcagaaaaatggcctcaaaggcatctttggaggttctttgtctcataatgtcatatcagagctctcttgttatttttaacgttactggcccaatgtatacatagtacagcacacatagtctagtgtgtctctccatccatatgtgcttcttgtgcttttactttggctgttttccttctgttttttttttgttgttgttgttgtttgtttatcctattctgaattttctgttttgtcttaccatatattttattttattataatctcttaagatacctgtttgttgtctaaggagacaggaaggggtctaaatggaagggaagatagagaagaacctggggtggggaagtggtcagggaaggagaaactataattagaatatgttgtaaggaaaaaaatctattttctaagttctggtctataagtatagcagagtatcattaggaatcatttcattgactcttttttttttaaatatattgtattttatttgccagttgtgtttggttctgtcataggtctctgggctgtccagcttctggttcctgaccctccatgcagtgtccagtataggcttcctcttgtgatatggcatagcaagttacaataagactaggtatatatccttatgtcaaggctggacaaggcaacccagttgggggaacaggatcccaaaagcaggcaaaagggtcagacacagtgctcaaactgttagaagtctcacaagaacaccaagcttcataaccataacatatatgtagaggacctagatcagacccttccaggcttcctgattgtcacccctgtctctgagagcccctatgagccctgcttaattgattctgtgggctatgttttcactgtgtcctctacccctctgggtcctgtaatcctccttcttcctcctctttctcttcctcctcctcctcctcctccagcagcagcagcagcagcagcagcagcagcagcagcagcacaggattccctgagctctgcctaatgtttaggtgactctctgtatctgctctgatgatgattgattacactaggctctggtctatgagtatatcagtttatcattaggaatcatttcatcctctaattcaaaacaatcttccaagtaggtttgtctctagatacaatatttttaaatattttataataatcctgtgtataattaaaattcataatttgaaatggcttactattttttaaaattgccctatgtcaattagcatcttttcacttaaaattgcttatacttttgggtgtgagaacatggaagttgttctctaagtggactaaaccattgctctacagtaaggcagatttgagggggcattcttttctatttcacatgtactggttaaactaacattaagtaaaatttgactgtagtgatttacattgatgtctgtaaagcctaaacgaaccaatgaatcttttagtgtacaagatgaatatcttggaggagcttaatgtagtcactttgtgcttacacattttgagaagacattagcatatgagtcttttctggtctgtgccttttaaaatgtttcatatatttctgtcttctttttgcttagaagcctacaaataattttttattccaaaacatttcatgtgcttttgtacttttttttttattttcaaacacttattctctttcttgcccttgaattactcattttattttagaagtcttgactaaattcaggtagccaaattgtacaacagctgaagctgcaatgcaagttttcaatgttagatatgtctgcaaatgttggtcatccccttagagaagatcttctagtcaagctctatgttagtcaagctctgggtgacaaaagccccagtgccagggtgttcccaaagtgtacacagagtgagcagttgctagcagaagggaattaggaccaagatctcctgctgccttgtctctcagaattcaacttcagaagcaaaaacttctacatttttggccaaatattttacttatctacttttggcatgtaaagttagaaatatcacaattttaccatttatctcacttcgtacttttggatgctttgccagaatggcaaattgtgagtggtgtgtgattttcctgccaatagagtccagtatagctataatctaaatgtttggtgtagtaaaaactgaaatggtaccaaatcatatattagcgtgatggcactggagtcttctttagggagaaagtcatatagtcaaataaacatgggaaaggctaatttatgtagttaaaatggttcttttttgaacttttaaaaacttatactatataagtatgcattgtggagccaggaggaatagttatggattgggtttgctacttctataggaacatttttgttaactttttccatgtaatgcacttttgggagaaattgaatagtacattctggtatttttttaatttaattttgtttgtaattcattttttgcactcccctcccaccctccaactgctccatatcccacacctcctcccccacaccccttctccacatggatgtccccaccccccaccccacctgacctctaaactccctggggcctccagtttcttgagggttaggtgcatcatctctgaatgaacacacacccggaagtcctctactgtatgtgtgttgggggcctcatgtcagctggtgtatgctgcctggttggtggtccagcgagagaactcaggggtccagattgagactgctggtcctcctacagggtcaccctcctcctcagcttcttccatcttttccctaattcaacaacaggggtcagctgcttctttccattggtagggtgcaaatatctgcacctgactcttttagctgcttgttggatctttctgagggcagacatgctaggtccctttttgtgagcactccatagcctcagtaatagtgtcaggccttaggacctccccttgagctggatcctgctttgggcctgtcactggaccttcttttcctcaggctcctctccatttccatacctgtaattctttcagacagaaatagtgatgagtcagatgtgtgactgtgggatggtaaccccattccacatttgatgtcctgtcttcctgctggagatggtctctataagttccctctccctacttgggcatttcatcaaagatccctccctgtgagtccttgaagtctctcacctcccaggtctctggtgcactctggggggtcccctcaacctcctatttcctgaagttgcctgtttccatactttctgctggccctcagggtttcagtccttttccctcacccaataccagatcagcttccacccccctccactttccctccctccccatttttgattgctttcttctctctcccaagtgggactgaggcagcatcctcacttgaacacttcagcttattgagctttttgaattctgtggactgtatcttgtgtattctgtatgtttttttaggggggggtgactaatatccatttattagtgagtacatatcatgcatgtcattttgggtctgagttacctcactcaggataatattttctagttccatccatttgcctgcaaaactcaggatgtcctcctttttagtagctgagtagtattccattgtgtaaatgaagcacattttctgtatccattcttctgtcgtgggacatctaggttgttttcaacttctggctatcacaaataaggctgctatgaacatagtggagcaagtgcctctgtggcatgatgggccatcttttgggtatatgcccaagagtgatatagctggctctgattcaggtagatctaattgcagttttctgaggaacctccagattgatttccagagtggttgtaccagcaatggaggagtgttcctctttctccacatcctctccaacatgtgttatcacatgaggttttgatcttagccattctgactggtgtgaggtggaatctcagggttgttttgatttgcatttccctgatgatgaaggatgttgaacatttctttaggtgcttctctgccattcgagattcctcagttgtgaattcttggtttagttctataccccattttttgattgggttgtttcattttttggtgattaactttttgagttttttatatattttggatattagccctctatcggatgtggggttagtgaagatttttttcccaatctgtaggttgcctatttgtcttattgactatggcctttgctttacagaagctttccagttccataaggtttccacttatcaattcttgatcttagagcatgagccattggagttctctttaggaaatttccccctgtgccagtgtgttcttggcagtttatattttctgtgggttcctaattggcagtcttcaaagacattgagatttaacaaagcaagcaggtatttttaaatttacaaattatttatttttttatgtcttaggatactaaaagttctgtcttttacttcaaaatgcttactgattattgtaaaatcttctaaacgtcttttaagaataatttagccttgggttggagagatggctccatagttaagaacacaggcagctcacaatcatctgtaactccagtccaaggggatctgacaaccccttctgccttccacttcagggcacatagatggtacatggatgcatatgtaggcagaataccaatacacatagaagtaatttcttttaatttatggaaaacattagtctcttggacaagaatgatgacccaggcattaagaatatgttccactctagcagaggaccaggtttggttcctagtacctacatgatgctcaaaattatctgtacttcttgttacaggtggttctttgtcctcttctggcctctgtaaccaccaggcacacatgtgtggtacatatgcatacctgcaggcaaatactcaaaacataacataaaaataaatctttgcctttaaagaaacaataattagactagaatgcacgcctttgatcccagcagcacttagaggaccgaggcaagtagagctttgttaaggtatagggcaggtctacatagtgagttcagaccatccaggactgcataataagcctttgtctcacaaagaagcaggagaggtagaagactgttttgtctcagtagtgcagaggaagtttaaaaacaaagctttggagaagggaagggagtgcattaattttggaacaatacacaagtaactgtacactatttaccataaagggaaaaataaatactaattttgtggccaagatctcagacagttctaaaacaatgtatattttggacaacagtctccaatggctctatgattggccctcatttaccatctcacaggaggcattgcaaatttaaacctgtgcagggctagtttttcaagttttatattactgtagtttttttaacatctgcaaaaacacattctttgttcacatgactaatttcgagttataaaaggttatctctggctattgagttaatcctactatagtagactttagttagtgtgacctcttttagagagaatgaaattgagtcaagtaacaaaaaaatgttttcctcaggtttcatcctttaaaaacacatgtaaatgtttcccaagaacatgtttttttttttcttttgtttattccatatcttgtcctgaaatccttacttccaggaaacatcctttttttcaagaacagacttttccttcattaagaaccgagcaatgacgttagcaatataactagctaacgtttgtgagtcagaatccagagccacctcccattaagccatgtgccacaatgaaaagatgaaaatctgttattttcctttccttctaaaaactgtgtttgcagtggtgaggaatgaagccaagccttgtttttacttgctaggcaagtactctgccactgagctacttcctcactcaggatctttagacctaacttttggggactgttcaaactaagttgacaacagcaatggaaactgtaactaaaacagaaatgaaataaaaccatgttcataccatcatgttcctcttgcctctctggctgttgtacgttagccagaacttttctttccttatgctgtaatattttttcttttctgatctaaaaagtagttcttgaatgagattttatctcttctaggtaataatattgattgaaggtgcttcccatacccagtggttctttttgctggacattgctgtttgctgctgacatataaaatttttatacctatgagaatctctaaataatgagaattttctactcctaaataaactttcccacagaaaccattttcttatgtcttacatctgttttgtaccgatctttaaagcttggaaatgtaaaattgtagtagttttcttaaggagaaacccagtgattcataacaaataccttctatctcttaaactattcaaagatcagttaaactgggcaggaggcttaagcaggtatatctctgtgagttttaggccatcctgtttctaggccagctagtgctacatagtgagacccactttgaaaatatcaaatatatgtaattaacatttgtgaattgtcttaagaaatataattgtcatcattttcttttttgtttttatttaagatttatttattgctatatgtaagtacactgtagctgtcttcagacacaccaaaagagggcatcagagctcattacgggtggttgtgaaccaccatgtggttgctgggatttgaactcaggacctctggaagagcagtcagtgctcttaaccattgacccatctctccagccctgtcatcattgattattgtagttagagattggggaaggaagaaagaaattttctaagatgaggaaagaatgcaatactgtgccaacatatttgggagggggggggatgttcaaattcatattgccaaggaaaattaggatttttagagaaaagtaataggcagacatgaagtgccataataacagaggccagtccactagagtgctgcttccaaactaactcatttaggtcctcttatggttcctttgccacctcccacagaagtacataaactcctcaactgaaagttggctttcatcctaaattccaggaaactttgaaaggatcacaacttcttaatgatttgcagtcttctctctgaaacttagctgttagaaaatttcgagtcagtatgcagatggcctcatctttttctaacgcctctgaggtttgtaatctgtattttattttgttttcctgttacccaggtttgctctgtccaggaaccttcttcttgctttccttttgttggtgtatttcattttctgaggttattcatcagtacttagctggattgccatcttctctttctttgattttagagcttaactaccattctatttagagtttcaaggtttgttacatgtttagaataaaaggtggtatacaaatatggatagcaagaacaaaaaactttgtcaccttataaagatgtgttcatctctagttatgtatgtattttgtaaggttatatccaagttatgaaagatattactaataaagttaagttactgtggaccattaggaactttgggagactgaggttatagtctttaaagcaacctctgaatcatttttcaaatttctgttaaaattgtgaattacaaaatgcttacagcattttgatccatcaactatattaagtaatcttttaggaaagctgaattttattcatatttctatagctctgagttacttagggtgagggcatggtgtgggaatgcataggatttgttgtttctggtaaaattaaactgttcagtaaatgagattgatatactaaaaagtccaattgaaagcttccaacacagtgttgttcttatctaggttctcacatctgttctttttaagtattgtgcttgcagattagatatgtttgtgtagagcttaatattatttctgatagcagtttctattcagttaaatatactgctaataggtaattcctttggtgtctacaaaagaatttcatccccgtaactgtattttgatcagatgtttacaaatttcagtaaataggaccgtaattaagatcgaaaggcaaagtcaaacaaaacatcctatatgtttactaactcgggtaaaggaggaagaaacagcttgatcacttaagttgcagtaaaagcaaaatgtgaaacatatattcttaagattcattttctggccgggcagtggcggtatacccctttaatcccagcacttgggaggcagaggcaggcagatttttgcgttcgaggccagcctggtctacaggtgagttccaggacagccagggctatatagagaaaccctgtctccaccccagcccttccccccaaaaacatttatttcacattatagctgtaaattaaaattaggattatttgccttggtttgttacaacagaatgaacttggaattgactattgaacagattatagtaattttaaccaagaagctcaatatactgtagtcattttgtggtactatactattcccctccttgcactgctccccacaaatcctgggatagttatctgattttggggggccttttaaataggcatctgaacttttgatcaaatgtcattttttttagcattgagatactgtttttttccatttttagcctgattgtacagttacaatatactaatgtttcaaggaagaaaatagctttggttgaggtgtgaatagtttaaaaccatttgcatatcttcagtttattttaatttagtttatatgtttattttatgtgtatgtgtgttttggctgcctgtatgtctgttcgttgagcgcatgcctggtgccaggggaagtcaaaagagtatgtcagatttcctggcaggagttatagacgattgtgtgctgcccaatggcttttggaagaatacccggtgctctcttaactgctgagacatctctccagctcctttcaagttttaattggtatttttcttagcttttatttattataagaactcaaagagaggagtccaaccattcagaacaattatgtaattatcaaggataacatctgttaagatcatttgctaataagacagatagctttgcattatatcagtgcctgcaagtttcattattaatgatctgaatggaagacaagagacatacaaaattgaagcatcaaacaaaattttcattttgtgaacagtttgaagtggtttgaaaagacattgtttaataatgacttttttttggattttaccatgtaaaatgaaattattcaaagtattgtaacctgaagaaaaaatgcaggcaggattatgagtactatattgaaaatttataggatgatagttgacaataagcataattttaatacagtaaggtagcagtaattttcaggctcacttatgtattttttccacctataaaacatccggaaaaatattaagcaataggcccatatctcagtgtgaatgtaaaggtgatacatggtcaggattaataatcacagatatatatgtctaggtgatatatttaaatttaccaaacctgaaaaggatggcaaggtatgctttgtttccactccactgttagctcttgtagttacaattttctattgaggctcttacttatccagtcaaaggtctgaatgcaagaaacaaattatacttccagtggctttccttttaaagtgaatatcaaagccataggccaaatagaattataattgagattagctcaatttttgctagtttgcagtttttgctgttttgagtgattatttttgatataaatgtgtgtgtgtgtgtgtgtgtgtgtgtgtgtgtttcaaacactatttaggcataggaaggtgatttttgtttgctgtgacggggttctgcattgcccagccagcctacagtccccatttttcctgcctcccaagtattgacccgggcaggcgatttttatcatgagaaagaaattgaagctttattcttggctatgctatatgttctgagtgtaattttaatgtttttacagttataagaatactttttaagtagtgtttgtgccagtacaatagagtctgtgctagcctatttaaggcttaaaaaaataatgtttataagaacattttgatgggactcaatccaacacaagatggactcataaaaaacttaaatgcattaccagtgacaggaattatatactcctacaccaaaactatattgtcttccatccaaataatattgtttcttaatgtttccttcttggatttccctgttttgtcaaaagcacctatattatttaaaaatcacaggaactaacactactgtttttttctaattttttatttatttatttatttatttatttatttacattccagattttattcctccctccccgacccaccctccaactgctccacatcccacacctcctccccacaccccggtctccacatggatgtctgcacccctccaccccacctgacctctaaactccctggggcctccagtctcttgagggttagatgcatctcctctttttttttaaatttttttattaggtattttcttcatttacttttccagtgctatcccaaaagtcccccataccctcccccccactcacctacccacccactcccacttcttggccctggcattcccctatactgaggcatataaagtttgcatgaccaatgagcctctctttccactgatgaacagctaggccatcttctgatacatatgcagctagagacacgagctccggggggtactggttacttcatattgttgttccacctatagggttgcagatccctttagctccttgggtactttctctagttcctccactgggagccctgtggtccatccaatagctaactgtgagcatccacttctgtgtttgctaggctctggcatagtcacacaagagacagctatatcagggtcctttcagcaaaatcttgctactgtatgcaatggtgtcagcgtttggaggctgattatgggatggatccccggatatggctgtctctagatggtccatcctttcgtctcagctccaaactttgtctctgtaaccccttccatgggtgattgttcccaattctaagaaggggcaaaatgtccatactttggtctttgttcttcttcagtttcatgagtttcacaaattgtatcttgggtattctaagtatctgggctaatatccacttatcagtgagtacatattgtgtgagttcctttgtgaatgtgttacctcactcaggatgatgccctccaggtccatccatttgcctaggaatttcataaattcatcctttttaatagctgagtagtactccattgtgtaaatgtaccacattttctgtatccattcctctgttgagggacatctgggttctttccagcttctggctattataaataaggctgctatgaacatagtggagcatgtgtccttcttactggttggaacatcttctggatatatgcccaggagaggtattgcgggatcctctggtagtactatgtccaattttccgaggaaccaccagactggtttccagagtggttgtacaagcttacaatcccaccaacaatggaggagtgttcctctttctccacatccttgccagcatctgctgtcacctgaatttttgatcttagctattctgactggtgtgaggtggaatctcaaggttgttttgatttgcgtttccctgatgattaaggatgctgaacattttttcaggtgcttctcagccattcggtattactcaggtgagagttctttgttaagctctgcaccccatttttaatggggttatttgattttgaaggagtccaccttcttgagttctttatatatattggatattagtcccctatctgatttaggataggtaaagatcctttcccaatctgttggtggcctttttgtcttattgatggtatcttttgccttacataagctttgcaattttatgaggtcccatttgtcgattctcgatcttacagcacaagccattgctgttttatttttttattaggtatttatttcatttacatttccaatgctatttcaaaagttccccacacgctcccccacccactcccccactcatccactcccacttcttggccctggcattcccctgtactgaggcacataaagtttgcacgaccaatgggcctctctttccactgatggccgactaggccatcttctgatacatatgcagctagagacacgaacgagctccagggggtactggttagttcatatttttgttccacctataggtttgcagatccatttagctccttgggtactttctctagctcctccattgggagccctgtgatccatccagtagctaactgtgagcatccacttctgtgtttgctaggccctggcatagtctcacaagagacagctatatctgggtccttttagcaaaatcttgctagtgtgtgcaatggtgtcagcgtttggaagctgattatggggtggatccccggatatggcagttgcatctcctcttaaatgaacacagacccggcagtcctctactgtatgtgtgtgttgggagcctcatatcagctggtgtatgcttcctggctggtggtccagtgtttgagaaatcttggggttccaggttaattgagactgctggtcctcctacagggtcacccttctcagcttcttccagccttttcctaattcaacaacaggagtcctctgcttctgtccattggttgggtgcaactatctgcctctgactcttttagctgcttgttgggtcttccagagtgtaatcatgataggtccctttgtgtgagcgctccatagcttcagtaatagtgtcaggccttgggacctccctctgagttggatcccactttgggcctgtcgctggaccttcttttccttaggctcctctccatttccatcactgcagttctttcagacaggaacaaatatgggtcagagttgtgactgtgggatggcaaccctgtccctcacttgatgccctggaggtaggctctacaagttccctttccctacttgtcaagcctttcatccaaggcctttgagttctgagagtctctcacttcccaggtctctggtatattttggagggacccccaacttcctacctcccaaggttgcctgtttctactctctctttgccctaggggctccagtccttttccctcacccagtaccagatcaggttcccctctacttcccaacccccagtccacattccttctaatttgtaggttgccaatttgtcttattgactatgtcctctgttttacagaagctttccagtttcatgaggtcccatttatcaattcttgatcttagcgcatgagccattggagttctgtttagaaaacttcctcttctgccaatgagttcaaggctctttcccaccttctgttagattcagtgtatatggttttatgttgaggtacttgatccatttggacttgagctttgtgcaagatgacaaatctgggtctattttaatttttctacatacagacaaccagttagaccagcaccatttactgaagatgctttcttttttccattgtatatttttggcgtctttgtcaaagatcaagtgtccatacgtgtgtggttttatttctgagtcttcaattctattccgttgttcgacatgtctttctatgccaataccatgtagtttttatcactgttgctctgtagtaaagcttgaggtcagggatggtgtttcccctacctgttcttttattgttaagaattgtttttggctattctgggttttttgcctttccagatcaatttgagaattgctctttccgtgtctttgaagaattgtgttgggattttgattggtattgcattgaattatagattgcctttggcaggatggccatttttactttgttttggttgggtccttgtgtggtttaggtaccagagtaattgtggcttcatagaacgaattaggtagtgttccttctgtttctattttatggagtagtttgaggaaaattggtatcaggtctttgatggtcttgtagaattctgcactaaatccatttggccctgggctcttttgggttgagaggtttttaatggcttcttctatttccttatgggatggatgtgggcctgtttagatagttttcttgctcttgatttaactttggtatgtggtatctgcctaacagccatccatttcatctaggttttttttagttttgttgattatagggttttatagtaggacctgatgattttttgaatttcctcagtttctgttgttatgtctcccttttcatttctgatattattaatttggatactgcctcttggccctttagttagtttggctaggggcttatctatcttgttgattctgtcaaagaacaagattttgtttttacatatactagagcattagtttgggcgttctagattcagtgaatatatatatatatatacatatgtatatatatattatatatatatatagtttatatttatatttatttatttattttggttttcccgagacagggtttctctgtgtagccctggctgtcctggaactcactctgtagaccaggctcaaaagaggtacaagaagtattagaaatatatttctaactgactttagggcagtagactgtgcaagagcattgggaaactcttataaaatcaaagaatgatagtttctttgtagaaaagtgtgatcatttcattaataggatttgacttctaaagttataagtaattatttcatgtttagaaataatttgtattgtgtgttctattctctgatatgttagttgacacaatgatcctcagaagttttataataaataaaatatttccagcctattatttttataagttagagttttgagctgcatttggactatggccgaaataatatggctggcaataaaatgcagtgttgtttgtataagatgccctccaaaatttcatcaaatgagttgacagaaggttgattaattttaccacgtgttttaagggaaccaaggaattgcaattagttgctcaactaatcaaacgggatccagatatctataaacccttttgcatttgtgcagttagttttgttttaaggtgttctgttttatttcgggtttttgtttgtttgtttgtatttgagaccaggctggcctcaaactcctgatagtccttttatatacttatatacaagtgtgaactaccactcagcctattataaacttgctttataggtgtttttgtcggggtttctattcctgcacaaacatcatgaccaagaagcaagttggggaggaaagggttttattcagcttacatttccatactgctgttcatcaccaaaggaagtcaggactggaactcaagcaggtcaggaagcaggagctgatgcagaggccatggcgggatgttcttagtggcttgcctcccctggcttgctcagcctgctctcttatagaacccaagactaccagcctagggatggtcccacccacaaggggccctcccgcttgatcactaattgagaaaatgccccacagctggatctcatggagacactctcctttctctgtgataactccatcctgtgtcaagttgacacacaaaaccagccagtacaataggggatgagaagatgaagaatgtgacaatttgaggaataacaaatgagtttaggtggatggatgtgtctaggacttacactgtgcttaataaattattgtttgggagaattgaatgggcctgcataggaagtagacaaaacttgtgtcaaaaatctgttcaagtatagtttattattgaatattctgtcctgaaaatatgagattagttaaagaaaatacacagaaaagaataattgcaattactttcttctttggagtatccagcacagcatcagagtaaacactcttacaacatcttttcacgagcattattattaaattatcagcatatcatagtgctatattttgaggtaaagttctctagatgcctttaattgctttctgtaactatattagaattgtactgttggctttagaccagttcgttcaaacaatagttttgctaggataatttgttaacctggtaagagatttgtggattttcatttctagacagggtttttaccattccctgttcctccgattcaccagaattctaagcttggtaaaaacatggagaaacatggtgaaaagctgaccttttccttctttcttggctagtgtgctggagaagagaaacgagttggtacacgcacagtgtttgttggcaatcatcccatttctggaacagaaccttatattgcgcaaagattttgtgataatagaatagtctcatctaaggtaagtttgttttttttaattaattatttacaacccaatcacttctccccagtttcccctcacataatccctccccagtaacccctcttctcctctgagaggattccttcctcccacaccctatatcacccaaccctggagcatcaattctctgcagggtcaggtgcatcctctcctactcaggccagacaagatagccctgttgggaaacagattccatagacaggctgttgctttagggacagcccctgctccagttgttgggggacccacatggagactgagctgcacatctgcaatgtatgtgccagaggccttgctccagcctatgtgtgtcttttggttggtggcttagtccctgagagctcctaagggtccaggttagttgactctattggtcttcctgtagagtttccatccccttcagggcctgcaatccttcctccaaaagagtccccaagagccatctactgtctaattgtgggtgtatgcacctgtctgaaccagctgttgggtacagcctctcagggacagttatgccaaactcctgtctgaaagaacaccaacatccttgtgtcagggattggtgcttgtccatgagtctcaagctaagctggttgtttgttggccattccctcagactctgctccatccttatcctcgaatttcttttagacaggaaaaattctaggtcgaaacttttgtgggtgggttggtgtccttatccctccactgggggtcctgcctagatacaggagtggcctcttcaggttctattttcccactattaggcttaggtaacccctatagtcttctgggggcttcccccattacaggtgtctggaacttcctaggaatctatagaaagtcttaaaaaaaaactcatgagaagttcatacaaagttggatatattcatttatgcttctaaagatgctgatgcatttatatatgtatacacacatggtcatgtacaaatcagaatgccaactgtgataattaataccctgaacagtaatttactttttaaaaagcctatcacttgcctcccattatgattcacagtgcctgttgatggtgcatattacttcaggccttaaaatgtgctacaagtaataattattgtgctggggagaggtgtttctcagtggtagagcatttgccaacatgaggacttattaattatttacttgtgtagagctttctgagttgcccttgaaaggattagactgtaccggatttacattcttctggagggtgcttagtgacttccatttgcatctctcctctcctccatcttgcttctgacttgtgattctaggtcctacagggtacattttgcctgtatattgcttggcctataaaatttaaccacaataggcatggcactttttgaataatggtcttagtttagtatggtctaagttgagagcagggtcctacaagtttgagtacttgtatttaaatcttgacaaagtatttattagctatatcaccttagttaacttaatgaatgcagcctatgaaatgactaatacttcatagatggaagcacttcttacagctcctagcacccagtagtcatcactctgctagtataatttactgatctttattgctggccaaccaggaaaggtgctagaatagtagatacctggtttactacagtttcttatagcaaggagcatagtttgataatgttcttgacttccaaatgcagtctggcaagagagagctaaaatgttggtgacatttaattcagtgcacatctgcagtgacttaggctctaaaattcttcctttaacaatatagcatattcttatattcaaatattcctttagtttctcctttaggcaatggcataatggagattattttcagttcaaatgttaatatgtaaaatataaacagaagcactcagctctctgggttctaggacagctgggattgtattgagaaagaccttgtatctataaaaagaaagaaataaaagattaagatgtaaaatatgaatgtgaaactgagaagcccaatgaacagatatgtatgtaagcctgtagaacactgtaacaatcagataaaatgctgattttctttttctcttacacattgttgcagaacttttagtcacagtcaggagcttatatacttgtatgtggggtagtgaatagtcttttcagtatagattttgacttactctatgttacccaactaagcaatcagttatagacctttggctcagaatcatagacacaagaactaaaaagtcatttgaggttcatcttgttgacttagagatagagaaacttaacccagagaaagctcccagtttgataagcaagcacttgagataaagccagcaacagaactactgtgtaaggccctataactttgaagaaaaatcccttttcatattatgctgtttgtgtaccatcctcagctttcttttctcctccatcaatatgaaagacttatgacgttcgctagtgtcctatctgtgcgacagtaaagagctgtgctgcgctggtggggactttcactactgagtggtgattctttgttgcactttagtcctcaggctttatggatttagtggatgctttttcaaagtttatataacatccagttttgccagcatctaaagcaatgcaataacatgtttttgtgttttaaagagcatgtgagagagttaaaatgctatttctaaacaaaaccaccatacagatgtgaacattttgtacacagaccaagatacctctaggcaccctcctctgaataccatacatatagtttttctaattaattgttttattttttaatgaaaactgttgagctatacaaagaagaattgacaatacagtaatttcagaaagaaaggctgacctcaattcatttgtgtatgtgtgtgtgtgtgtgtgtgtgtgtgttgctactacctctcaagtgctaatgttatagacatgcatcactatactaggtttagaaagaaatggtaatggtagtgtgtgtttttgttgatgaggacctcatttctgtggttttgggggggttgtttgtttgtttgtatttttgactttgttggctttcttttgtcttactatatagctctagctatccttaaactcagtctgtagaccagactgacgtcaatgtcacagaaatctgcctgcctctgcctcccaagtgccaggtttcaaagcatgtgctaccttacccagtttagaagttctgtgaggaaggtagagtatagtaagtatacttactgcctacagaaaagagagtagataggaacttgaatacagtaatttagccaactgagcagttaccaatataaaacttactgacaattaatcttacttttctattctattgcatccagatgattctactaggtagggatggttgtgttctttgtgcagttcagtttactgataactttataagttactttttaaatagtatttcatttttacctgtgtccctgtccctccttttttgttttttgtttgtttttgacaaggttttgttattttcccctatgttggcttgcctatgtagttcaggctgtccttgaactcctggcaatcctcctatcttaccttcctgagtggaaagattacagatatgtgctgacatacctgcctttgtttaactgttgcttgtattattcaaaatattagcgcttcatcctccccgtcagcagttttattgctaagtgaaaaacttggtggacttaacataaaaacggccatttccactctcttctctggagcttgggataaaacataaaactacagctatgctggataactactcattcactgagctataccacatacttcgggcacaaatcaaataaagcgcaagccttcagttgcttagttcatattcacttcagcttacctacttttatatttctagatttatttgatagaaaatttggttttagttgtgtttagatggtagatgtttgagtcagtaacacaacttttgatataatacaagttttagaagctctgagtgtgtgtgtctacctctaccaattatttaacacactacaaaataagtgaaaatacttatcataaaaaatatatgcagtgctagtattttatgtagaaacattttaaagcatattcttaaatctttggactgatttttaatttcatggctccatattaaaatagtttaaggaaaaacacctcaataattaagagcatttgcttgtcctggcacccacatgaaggcttaggcaacaggtacatgcatagtgcatagacatacattcaggcaagatacctgcatacaggaaatataaatacattattttttaaatagcacaattatcttcttggcaagaacttaggacagaaaattcattttatcactatatttaaaacaactactatatgtgctttcttctgtgattggcattggttttgtttctgtagcagcaaaccaagtctgagagtccagtttttagataaacaagtgaactttaataacttcatgtatatgtctaatgttccattttgtttctgattagaaaactctttggaaatgtttttctttcagtagtatgattttgtttgtttgtttgtttgtttgttatgggtgatctgtcttcacatacatccagaagagagaatcagatcccattatagatggttgtaagctaccatttggttgccaagaattgaactcaggacctggaggagcagccagtagtactcttaactgctgagccatttctccagcccaatgtttcttaatctgtgctaatattggttttagtttatagaacagttgagtgtttcttaatttactttttttcttttacttattcacgttgcatcccactcacttcagtgatttaaatggccagatggccagtacacaaagtttactgtttttttttttttttggattgatttagaggtatcagttgtcttttaacaattgtggttctaggactcggcaggccaaagcaggaggattgccctgagtgtgagattagccttagctgtaattagaccctgctcaaaacaaacatcctcatgtttcttgtcaaataccatgtcggacagttatggtaaaggaagttataacaccctgaggtcttatctcaggtccttatgaagagaagaacactggtttccaatgaagagactaacaaaagttcggaaggaaactgctaatttggtacagtaaaacggtagcagggcgtggagtgtacctacttcagtagtgtaggtagtggtatgtctttgtaaagacctgattgaatccttagtattgtaaaacaacagtagtgataagaggactagatcaaaaaaaggttccctttgatctgttaatactacctgtattaagtaaggacttttgcggggccttaatgcgtatttgtttagtttttaaaaaacaaacatgtagtttgagaacagaaggtcagtgtcccagaagtccagctgttagtttgactttactggaatttatccttcatttatttatttacttgaaattggtgggacagttaaattctggttttagattgtattgggtttccaagtgacaatatcaatgcttttaaatgcttattttctttttttagtcacaagccactttgagaataccattaaaaaaagtgtgaattatttttcccaaatgctcagtccgcacttgggaagtttttggatgctctgttgttgattggttggttggttggttggtttctggcaaaatctcattcaggaagacctgaaactcataaagatcctcctgcctctgtgtctcagtgctgggttttaatgtgtctttggcatttctgtgtttactttaaacaacatgtttattttgttagtgtgccatctcccaccactctggttctctttgaggtacttattttgaaccttagaaataatgttttgttggctattgattgttttcttagttttctttctattactgtgataaaacacagtgaccaaagcaatgtgagaaggaaagaatgaactttaccttacaatttatcctcacaaatggaaatcaaggcagaaactcaaggcaagaacctggaggcaagaactgaacaccttgtatgaatgcagcgtactgacttgttcctcctggcttgctcagtttccttgcttgcttatacaccccaggaccacctgccctgggatggttaaagttagtctggtgagggcgttttctcaattgaggttcctgtgtttcaggtgactctgtcttgtgtcaagttgacaaacaacaacaaagaaaccaaaaacaaaaaaaacaaaacaaaaacaaaaaaaacacactgtccagcacaattatgctctagctgtccatttgacttctttctctttagattctctgaatcttgagaacttctaagccttgtttaaaggaggtgttgtggccaacaagatgtcacagattgtaaaggggcttgctatgtaagtttggcaacccaaatttgatacctgggacccacataagggtttggaaggagaaaaatgatgcctcaaaagtatcaactaagctccacatgcacaccatagtggattcactaccttcctagccacaaaataaatatttaacattgtttaatataaatttaaaaattttttaagttattagcagtaaattcccatataccttgacatgctctaagactttggctttccatctagagactgccatatccagggatccatcccataatcagcctccaaacaatgacaccattgcatacactagcaagagtttgctgaaaggaccctgatatagctgtctctcatgagagtacacaggggcctagcaaacacagaagtggatgctcacagtcagctattggatggatcacagggcccccaatggaggagctagagaaaatactgaaggagctaaagggatctgcaaccctataggtggaacaacattatgaactaaccagtaccccggagctcttgactctagctgcatatgtatcaaaagatggcctagccggccatcactggaaagagagacccattggacttgcaaactttatatacctcagtacaggggaacaccagggccaaaaagcgggagtgggtgggtaagggagtgggggggagggtatgggggacttttgggataccattggaaatgtaaatgaggaaaatgcctaataaaaaattaataaaaaataatttaaaaaaagacgttggctttccagcagctatatccgtggatatatctcgtgacatgcaaatgattggaatagtgactttccaagtataaattcagacttttgccttaaaaggatctttttcattctagttttaagtcttctgtattataatatgtcctacttctgatatttttgaattggcccagtccttgagcttaagctgttattaacaaattacatggtatgcactcaatttgtgtatttgcttcttcatctttgcacatattctcagataggtggtcctgatagagacactgatctgaacttagtgtcttgacaaagttaaacttgacttttgatcagaaagatgagctactaacaaaggtggaagagcaaggacctaggacaagttcacttgctttgtcttctactggagatggcagctgtcttcttcccgttgcttagggtttggcctcacagtctatggtgaatggctcatttttaaaaggggcttacaactctgcaaacaaaagttttaccaaggcaggttgagagatgaaaacatttgcatagggttttacaaagtgggggagataaaatgattggaactctttaatgataagtcttagtgttttcagaaaaaggctaatatgtaatgttttgtccaatattgattgctatcaaaatatatatactatgagagcatatggcacgtgtcttagtcagaatttctattcctgcacaaacatcatgacaagaagcaagttggggaggaaagggtttattcagtttacacttccacactgctgttcatcaccaaggaagtcagtactggaactcaagcaggtcaggaagcaggagctgatacagaagccacggagggatgttctttactggcttgcttcccctggcttgctcagcctactctcttatagaacccaagactaccagcccaaagatggtcccacccacaagggccctttcccctttgataactaattgagaaaatgcctcacagctggatctcatggaggcatttcctcaactgaagctcctttctctgtgataaccccagcctgtgtcaagttgacacaaaactagccagtacagcacggaatttgttttagattgtgttggactattaaaatgtaggactaagatgcctaatagaataatagaagcagaaggtaccctacccaattcattctatgaagccacaattactctgatacagagtagacccacagaaagacccaacaaagatagagaacttcagaccaatttccctgatgaatatcgatgcaaaaatactcaataaaattcctgctaaccgaatccaagaacacatcaaaacaatcatccatcctgaacaagtaggtttcacctcagggatgcagggatggtttaatatatggaaatccatcaatataatccactatataaacaaactcaaagacaaaaaccacatgatcatcttgttagatgcggagaaagcatttgacaaaatccaacacccattcatgtaaaagtcttggaaagatcaggaattcaggcccatatctaaacatgataaaaaacaatctacagcaggccagtagccaacatcaaagtaaatggcgagaagctggaatcaatcccactaaaatcagggactagacaaggctgcccactttttccctacctattcaacattgtacttgaattcctagccagagcaattcgacaacaaaacgagatcaagtgggatacaaattggaaaggaagaagtgaaaatatcactttttgcagatggtatgatagtatatatctaaatgaccctaaaaattccaccagagaactcttaaacctgataaacagcttcagtgaagtacctggatataaaattaactcaaacaagtcattggcctttctctacataaaggataaacaggctgagaaagaaattagggaaacaacacccttctcaatagtcacaaataatataaaataccttggcatgactctaactaaggaagtgaaagatctgtataagaacttcaagtctctgaagaaagaaattaaagaagatctcagaaggtggaaagatctcccatgctcatggattggcagatcaatatagtaaaaatggctatcttgccaaaagcaatctacagattcaatgcaatccccatcaaaattccaactcaattcttcaacaaattagaaagggcaatcggcagattcatctggaataacaaaaaacctaggagagcaaaaactcttctcaaggataaaagaacctctggtggaatcaccatgcctgacctaaaactgtactacagagcaattgtgataaaaactgcatggtactggtatagtgacagacaagtagaccaatgtaatagaattgaagacccagaaatgaacctacacacctatgatcacttgatctttgacaagggagctaaaaccatctagtggaaaaaagacagcaatttcaacaaatgctgttggcacaactggcggttaacatgtagagaaatgcgaattgatccattcctatctccttgtactaaggtcaaatctaagtggatcatggaactccacataaaaccagagacactgaaacctatagaggagaaagtggggaaaagcctcgaagatatgggcacaggggaaaaattcctgaatagaagagcaatggcttgtactgtaagatcgagaattgacaaatgggaccacataaaattgcaaagcttctgcaaagcaaaagacaccatcaataagacaaaaaggccaccaacagattgggaaaggatctttacctatcctaaatcagataggggactaatatccaatatatataaagaactcaagaaggtggactctaaaaaatcaaataaccccattaaaaatggggtgcagagcttaacgaagaattctcacctgaggaatactgaatggcagagaagcacctgaaaaaatgttcagcatccttaatcatcaaggaaatgcaaatcaaaacaactctgagattccacttcacaccagtcagaatggctaagatcaaaaattcaggtgacagaagatgctggcaaggatgtggagaaagaggaacactcctccattgttggtgggattgcaagcttatacaaccactctggaaatcagtttggtggttcctcagaaaattggacatagtattacaggaggatcccgcaatacctctcctgggcatatatccagaagatgttccaactggtaagaaggacacatgctccactatgttcatagtagccatatttataatagccaggagcttgaaagaacccagatgcccctcaacagaggaatggatacagaaaatgtggtacatttacacaatggagtactactcagctattaaaaagaatgaatttatgaaattcctaggcaaatggatggacctggagggcatcatcctgagtgaggtaacccaatcacaaagaactcacctgatatgtactcactgataagtggatattagcccagatacttagaatacccaagatataagatacaatttgtgaaattaaaaaagaacgaagagcaaagtgtggacactttgccccttagaattgggaacaaaacatccatggaagttgttacagagaataagtttggagctgagatgaaaggactgaccatctagagactgccatatccggggatccatcccataatcttcctccaaatgctaacaccatttcatacactagcaagattttgctgaaaaaaccctgatatggctgtctcttgtgagactatgccggggcctagcaaacacagaagtggatgcccacagtcagctattggatagaacacagtgcccccaatggaggagctagataaagtccccaaggagctgaagggatctgcaaccctataggtggaacaacaatatgaactaaccagtacctccggagcttgtgtgtctagctgcatatatatcagaagatggcctcgtcggccatcagtggaaagaaaggcccattggttgtgcaaagtttatatgcctcagtataggggaacaccagggccaagaagtgggagtgggtgggtaggggattgggtaggggagggtatgggggacttttgggatagcactggaaatgtaaatgaagaaaatacctaataaaaaaagaagtataaaaaatatctaagtaaaacactgttttatataatacctatgattcaatataaatataattgataaatctaaaaaaaacttctcaatgaaccgtcatttctgaaaaaaagttctctatctctaaatatatatgcaaataatctatattatataaatataaataatatatgccatgtaatgtgttattgtgttttcaattgttggatatactaaatacactttatatggttctaagatttttttaagtttcttttttaatactgcttttgattcttatctcttttatagtatacactttggaatttcctccctaagaatttgtttgaacagtttagaagaattgcgaatttttatttcctcatcattttccttgtacaggtaagaactccatgaactgctactttaacatggagaaattttgttctttcaaggaatttatcttcttaaattatcctgtgacttaagagatttgcttagtttttaaagtagaaatacaattgcacttcaaaagtgtgtaatgttaaagttttctaaagttgtattttaaaacttgttgagatttttattgctacttcaattttcacagatttaatatctggtcttagagtatacattgtattacagcttagtgatttagcatatatcaaaattgaatgtagtttgagtttaattttgttaaagaggtttagcttattttttttgagtcctgctttctctgtgccccactcacctgcttgcttgtggtttgaaagtctaataagtcaacgtgcttctcagcattccttctactgctttctattttaaattttagtcatttttaaatcatatcctatattttgagctgcataggttttatattttttcattcatttataaaatagtaactgtaatgatactcctcatctttttaaatgaagcagaaaaatgactatgaagttgctcagatgctttggtaactttgagagcttttgtttaagaactctgaggctttgactaaatggtatgataatttaacttatgcctgcctgctccttgaaaccagtctggaacaagtaaatttcagtagaaagatttttttaaaagtttctttataaataatacttttgattcttacctcttttatagtgtacactttggaatttccttccaaagaatttaggagagagtcaatttcagtagtaaatgaggtgtttaggaatgaactcttatatccatggtcagatgtcttagaaacatgaactacaataaaaaaatctttttgaatgagtaattcagtgtatttaattaaattcatttgaacaaatatatgccgactgcctattgtgtattgtgcactagtccccaaaacaaaatatgatcaaaatactgcttttctctacccttaaggaatttataacaacgttgtattttcacttaatttaatgtagtaaaagccattaaagattcagcaaactactaaaactatgccatgaaagttaaaataaattttaactgaagaagaacttaaaagggcttcaaaagtgcatgatagttgaactgaattttgaagaggtttctgtggcagataatgcaaggcaagcatcccaggaatagagaggaggttgcataaaggccttgtaaaagtcttctgtgtattcctctgtgtgtcagggataggtctggctggatgttggagatgctagtgtaataatggaaaggcagattgtagcaaaaatcccatccccaaatctagttctccttccatttttctttctttctttcttttttttagattttttttattaggtattttcttcatttacatttccaatgctatcccaaaagtcccccataccctcccccccactcccctacccacccactcccacttcttggccctggcgttcccctgtactgaaaagtttgcatgaccaatgggcctctctttccactgatggccgactaggccatcttctgatacatatgcagctattttagtaaaaacagcattcactcaagcatgttaaccaagcacttgcaagacatctactatccatagttatagctcattacttaccaatggtaccgtctttctttctgaatatcttcagtatttctttccatatttcttctaccctgatctatctttcacttgtctcagggcaatagcctcccaagtagactcctagcctccatctttattcttttttagtctatccttcatacagcattgagaataaattttcatgttatcattctctgtgtaaaatctttcccattgtggaatgaatagttaacagccaacagctttctctgtatggtttgactcatgcctgcctccccagcctatctcacaccacacttttttagcactatttttctttatttccttgaacacatgtcacttccccttctaaaagagaaactttgtgtacattgctcattgtacctggaaaagttcctttgagctagttaactcctaactgccccacagatcttagcatctgtatgctagttttatgggaaggcacggacttctttctttcttcattagccaagatctctagaggctggatggtaaaagtacagggccttgcagaatgcttctcagatattagctggtaaatcaacgtgaacattgctgaaaatgggatcatctaagctgggtgaaaactagtgctaaattttcttaaactgttatatagattgttttattataattaaaattaatattcatctcactagtagaatatattttatctaaaatatttgcagcatataaattctaaacatgagttaatagctaattttattttcaatttaatttctctacctaggtcacagtagacacaccaaccagcccagttaccagtggacttccactttttttcgttataactgttacagcaatcaagcaggtaaatttctcacataaactatgcctgtcctttaatgaaagctaatttgaattttcttgtaagtattctttttcatatttatatactgtggacaatattttgatggttttagtttatatttgattcctgttgaaaacctattaaagtaagctgataataacatttttaatttatttactcttttcctcgtgtgtgcatgtgtggtgtgtgtgcatgtggtgtgtgtgtgtgtgtgtgtgtgtgtgtgtgtgtgtgtgtgtgtaagatagaagcataatagaaaggacaagtagaaagtccatctcagtagagaaacaggaagtgggatttttactgttcattcttaaaatttcctactccaatgaattttaattgttattgtctatcgtacagaatttaatacaaatacttcaggctagagagatggctcagctgttaagaacactggctgctcttccaagggttcaattttcagcacttacatgatagcttacaactgtttataagtctagttctaggggacctggcattctcacacagacatacatgcaagcaggtgggtggggggatggatggacggatggatgggcggacagacagatagacagaccgactgactgattcaggtaagctggccccgagggcaagagtgcaggagagttggccctctaattttctgtcatgagatagtatgggggcaggggcaaggctctccctacctcccaccgctagtagtgagaactggccctgagaccatgagagttggagggctagtcttgccccctcgaagactgcagcactgggagagtgggccccaaaccctgacttggcagcacattgaagctgactctggagtagtgcatgccagtgagccagctcctgagggcacaagagcaagagaggtgaccctgcctcctgcagatgacagcattgggaggcctagctggagcagtgctagagagcttgccctggtggtgtggataagggagagctggtgcactgactcattgcagtgaacattatttgcagatgaagatgtgtggacagagggataaactgtgggacgcattgtgatgtactgcagtttccacagtgagatgccttctatgctttgggtgtgtgtgtgtgtgtgtgtgtgtgtgtttggggggggggttgggtttttgtttttattttggggagaggttgcaagggcagagggtagatatatgaggcagggtgatgagtggaactggggtaaatgatatgaaactcacaaggattcaataaaaagatttagaaagaacacaaataacttgaacttatcactactactattgagcagggtgatagatagggaagactatctctctcgtcagagttggtaagctctcacagatgatgttgattgtctttgaagtattttgaccattgtgtgtattaatacccttaaaattatccaaataaaattgaaattttcaatagaaaaccttaaatgaggggtgcatttcctatatttagagacagaccgcaggatctgcttatttgcaaacacatttttaggtagtaccttaaggaaacttgtaaattgaaagaaaaaggttacctttcctcctggggttttctgatcctctctcttgcctaccaggaattttataaatatcatgtatttcattgctaaataaagacttggaatgctctttccctttggctaataagattattttccttattataataaatttttagttccaagaatagcatgtatggctttcaaaagggctttcttactgattcattttactcccaatactaggtcatgttctatctttcctttcgtcttaagcaccagagaatgtaccctataaaatgcctagtattttcacgaagagggacagaataggaatgaggaccaaaaaaaaaaaaagggggggggagaaaagttgaccaagagattgttctgttcaagcatatatttgaaaaggcacagatattacaatgaggggcaaaacattggatataaaaaggaggaagtcatgttcaaatgaacatcatgattccttagcccttttagcttaaatctcttccacatgaaaagcccaaaggaaaataaaccattaaatatctctatgattattttttaattctaaaaagtcaccaatttctatttcctttaaataagttagtggagaattttaattgttgtctctataatatgtaaattctctggcaaaacattttcaaaatgttttgaaattttctactttctacatgagaagaattacatttctaagtgattagatttattcaaaaataaaaagtaagaacatttatattttcaaattaaaagagagagctgctggagagatgactcagtggttaatagcactgtgctcttgcaaaggacctagttctagtcctagcacccacatggtggttcacaaccatctggaactccaagtccaggagaccggatactcttttcttgcttccttcccaggcactgcacagatatggtgcacaggtatatatgaaggcaaaacaccaatacataaaataacaatgaatacatttttaacaaagtagaagtaattacaatgttctttaattttttagatacatatagaaaacaaacgcattcattagagcattataagcataaatcgtagattttctcaatgaagaatgttatggctgtaatgcctatgttacctataatatatatctgaagaattaaggaaccttataatacaataaagctatttgcctaaggaatatgtttataaagtgtgccttaaattgtctaagaatatgtgcatcaatgtatctgtagcattctatgttgaaattaacactataaacttaaaatttttcttttcttataggggtatgaagattggcttagacacagagctgataatgaagttaacaaaagtgctgtttatattattgaaaatgcaaagcgagtgaggaaagaaagtgaaaaaatcaaggtactactttactagatcactctcttttaaaactactcttcttcctggtgtgtgtgtgtgtgtgtgtgtgtgtgtgtaatggcatatgtgtagttcagaagacaactttttggagtcagttttctcctgacatgagttctgtggttcagaatcaagatatcctgctggcctcccactcaggataactgcaaaaagtcccacatagtaaaaatgtacacttcaaagtatatgaatagggtggtagtggcttatgcctttaatcccagtatgtgggaggcaagtggatctttgtgagtttggtctacataatgcattctaggatagccaaggctttaccgagaaactctatctcaaccctgtctcttcacaaaagaaagtaagtatacaaattagtatcatttatttacatttacaatgctataaaaccatcactatttacatgagcagaaaaggaaacaccttactcattgtatattatttcttcaacccaagtattgtaaacatgaaccttttcattctcaatgaacttacagttttaatattttacacgaatttgataatacagttcctgaactgtattagaatattttagagctatttgtgttgtagtatatgtcaataattcattgttttgatggctagatgataatatattctatttgtataccactttttttttattcgctagctaatgtttctgtttggggctgctatctatactgctgctctgaacattcaaggacaaggttttgtttgaatatcagttttcagttcttttgggtatatgcctgtgttagtatttttatccttatggtaatttttaatgaaccataaaagtgtttttgcatagagagtgtactctttatattttcagagcaaggtggtatttatattttattcaaattaagcattgtttacttctaccaagtaagagctctacaaaatgacatttatatttgaacatatcaaacatttttggttgctaataggtgtttttaaagcagtaagctttgctgtttacaacagttttatgttcacagcaaaatttaacagaaaaagtctagctgtatagccagtgttctgtcccacaagaatctttttctattatgagcctcagtaaacctcctttggcacataaagtttagtttatattagagttcacttttagtgctgtgaattctatgaggtttgacaaatatatgacattgtaatatcatgcaggataattttactttccctaaaaatttatcttctgtactttctctagctccttcattaggggccctgtatgactgtgagcatccacttctatatttgccaggcactggcatagcctcacaagagataggtatatcagggtcctgtcagcaaaatcttgctggcatatgcaatagtgtctgggtttagtggttgtatatgggatggatccgcaggtggggcagtctctggatggtcttttgttccccattctaagaagaagggaagtatccacactttggtcttccttcttcttgagtttcatgtgttttgcaaactgtatcttaggtattctaagtttctgtactcttttttttttttttttggtttctcgagacagggtttctctggatagccctggctgtcctagaactcattttgtagaccaggctggcctcgaactcagaaatcggcctgcctctgcctcccgagtgctgggattaaaggtgtgcaccaccacgcccggcctctgtaccccatttttaatggggttatttgagttgttggtatctaacttcttaagttctttataaatttggggtattagtcctttgtcagatgtaggattggtaaagatcctttctcagtctgtaggctgctgttttgttctattgacaatgccctttgccttatagaggctttgcagtttcatgaggtcccatttatcaatttttgctattagagcttgagctactgatgttctgttcaggaaactgtatcctgtaccaatgcattcaaggctctttcccactttctcttccctgatatgtagtgtatccggtttttatgttggagtccttgatccacttgaatgtgagttttatgcaggatgataaatctggttctattttcatttttctacatgtagacactcagtgagaccagcaccatttgttgaagatgctttcttttttccattgtattcttttggcttctttaccaaaaatcaagtgttaacagttgtgtgggtttatttctgagtatttgatttgattctcttgatctacctgactgtctctgtaccagtaccatacagtttttatcactattgctctgtacagttagtttgaggtctgggatggtgattacttcagaagttcttttattgttcatgattgttttggttgtcctgggttttttttgtttttccatgtgaagtggagaattcctttaaggtctataaaaaattatgttggcattttttatgggaatcgcattatatctgtagattgcttttggcaagatggccattttcactatgttaatcctacctattaatgagcatgggtaaaattctcctttttctgatatcttcttcagcttatttcttcaagaacttgatgttcttgtgtacagatcttttacttgcttggttagagttaaaacaagatgttttatattatttgtggctattgtaaaggttattgttttccctaatttctttcttggcccatttatcatttttataaaggagggctactgatttctctaagttagttttatatccagtttctttactgaagctgcttctcagctaaaggtcctctctggaattttgtgggttgcttatgtatactgtcatatcatctggaaatagaaatactttgacttctttcttttcaatgtgtatcctcttgatcttcttttattgtcttattgctctagcttgaacttcaagtattatattgaatagataggagagagtgggcagcccagtcttttccctgattttagtgggattgatttgtatttttctccatttaatttaatgttggctattagcttgctatatgttgtttttattatgtttaggtatatgctttgaatccttgatctctccaagagttttaacatgaagggatgttgggttttgtgaaaggctttttcagtatctagtgggatatcatatgatttttttctttcagtttgtttatatcgtggattatattgatggattttcctttattgaaccatcctggcttccctggcatgaagcctacttgatcatgatgaatgatgtttttggtgtttacttggatttagcttgtgagaattttattgagtgtttttgcagtaaggttcataagcaaaattggtctgaagcgctctttatttcttgagtctttgtatggtttaggtatcagggtgtctatggcctcatagaatgaattaggtagtattccttctgtttctgttatgtggaatagtttgagaagtattggtattagctcttctttgagggtctggtagaattctgtactaaaaccatctggccccggggcttttggggggggggggtgtgctgagagtgcttatatttccttgggaattgtaggactgtttaattaatttacctgatcttgatttaactttgtcaagtggtgtctgtatagaaattcatctattatgttaatattttccagttttgtggagtgtagggttttgtagtaagatctgatgtttttgaatttcctcgatttttgttgtgtttccctgttcattttttattttgttaatctggatactatctctgtgccttttagttagtttggctaagagtttttcaatcttgttggttttctgaaagaaatagctcttggtttcattgattctttgtaattttttttctgtgattgatttcagccctgattttgattatctcctgcattctattcctcttgggtatgcttgttttgttttttcttctagagctttttggtgtgtgtttaaattgctggtatgagaactttctaactttatggaggcactgttgaggcttactttgtacctgattatatggttaatttttggagaaggaaccataagatgctaggaagaaggtgtattctttttgttttgggataaaaggttctgtagataactgctggatccatttgattcataaggtctgttggttttattgtttctgtttgtcttctgtttcaatgacctgttccttggtgagaatggggtgttgaagtctccactattatgtgatttgagcttatgaatgtgggtagatgcccttgcatttggggcatagatattcagaattgacactacctcttgttggagttttcctttgatgagtatgaagtgtccttccctatgtcttttgataacttttaattgagagtctattttattggttattagaatggctactccaacttgtttcttgcatctgtttgcttggaaaatctttttttagcactctattctgatgtagtgcctatctttgttgccaagctgtcttcctcatatgcatcagaatgatggattccggttttgcatccattctgttagcctgtgtctttttattggtgaattgagtcaattgatgttgagagatattatgattattagctcctattatttttattgttggatgtgatactgtgtgtgtgctcttttgttttttctgtgagattattaatttcttgtgtttccctgggtacagttacctccttgtgttggaggtttccttgtagtatcctctgctaaactggattaatagaaagatattgtttaaatgtcatttagtcatggaatattttggcttctccatctatggtgattgagagttttactgggtataggagcctgggatggcatcttagggtcttcaagacacctgctcagggtattctggcttttagagtctctatttagaaatccagtgtaattctgataggtcttcctttatgttacttggtctttttctcttgtggcttttcatattatttcttctgaacatttagtgtttcaattattatatggtgggatgcatttttttctggtctattctttttagtgttctgtaggcttcttgactgttttagggaccttttcagtttagggaagttttcttctatgattttattgaagattattttctggcactttgaacttggaatctttactctcctctattcctatcattcttacgtttggtctttttatagtgtcccaaattttcttgatgttttgagttaggaacttcttacatttgatattttctttgaccattatatccacttacttgtatggtatcttctacacctgagattctgtctcctatctcttgtagtttgttggtgatgcttatatctgtagttcctgttctctttcctaggttttccatttccaggattgcctgcacttgtgtttttttattgcttctatttccatctttatgtcttggactattttcttcatttacttcacctgtttgtttgcattttcctctatgtctttaagggatttgtttcctctttaagggtttctacctggttgattgtgttttcctgtttcttgaagatatttatttatatcttctttaagggcctctatcttcttcatgagatgagattgaaggtcagtcttgctcttcaggtgtggtacaatatccattggtttctgtagtaggagggctgcattcttatggtaccatattgtactaactttttgctatttggttgtttctgatattggctggcctggtatcccttgagagtagtaagcctctgggactggctgtcccagatagccgaggacctctggagaggcaagagagctgtggctggagatgggtgtgctgatcctctattgcaggtggaggtgtgggccagaaggaagatggagctctgatatggccaggcagagctcaaagcttcccagcttgtgttcttttttttttttttaaattattatcacgtattttcctcaattacatttccaatgctatcccaaaagttccccacaccccccccactcccctacccacccattcccattttttggccctggcgttcccctgtactggggcatataaagtttgcaagtccaatgggcctctctttccagtgatggccgactaggccatcttttgatacatatccagcttgtgttcttgatggggactggtggctgtttaggtgtggctctctcacctgtgtatcttgggttagagcaggcctcactggaggcatacagagctctaggatgaagaacagagtgctaattcaatattataggtagaggtgtgggaccagaggaagatggagctccaataaggcagggcaggcacattacttaatgttttctttgtatcatttcaaacatgcatcttctgcagtcattgtaatcatctaagacttttacctaaggtcatatcatttagtcacaaatctgagacatgaactagggctttgttctctgcatcattgaatggttcaaggtttcatctctcaaggttttcctcttgttggggttagcatacttgctgataagtgattattattgctctataaagtgattcttctagcttatatgagattttattgttatataaagtgagtcttcttaatagatgaattattggaaagctaaattaacatatggaaaagtccaccactcccatattatattacctgaggttttcaaacactagaaggaaccgaataatcacaactacagacaaaataatgctgacatatatgtggttcaaaatgaagatgtggagggttctgtcttgaagtacctaatttgaaacctataggttttcttgttttattcttgaaatggcaatgataattgtcttattatatgtcaatgccagaaatagcagagaacagaacatggatgtcaggatatttattacacaacagtgctaagatactctgaaagcatactaaggcctatgaccttaaacaaaattctgagtgcccaataatagattcatctctttgcatgtggtatatgatgcttagatactctccaagcctcagatctataatgtctattaacattttagcttaaatgttaggtatactaaatgctttgtttaggatttaaaatatttattctgctgttttaggttggtgatgtagtagaagtacaggcaaatgaaacctttccctgtgatcttatacttctgtcatcctgcacaactgatggaacctgttatgtcactacagccagtcttgatggtgaatctaattgcaaggtaatggagattaaacctgttgagtgttttattttcagaatggttaataagacagtactgtctcctaacactttttagtcccttaactcattttatgaaaggtttgtatttgtagacagctattatgtaattaccttagcttctaagtaaatgcccaattgggagaataggattgtgttgtttgggcccctacaaaagagccattacaatttttgtagtaccacttaaatttaatattgatatagttcaattaacattttatttaggctttttgttagtgtttttgttattgtacttaggactgagatctaggctcacacatgcacagtagaactaccactgaggtacatctagatgtttatagttgagaatacttgtgagctaaaactacataaataccagaatggcttcaagtactataactttttaattgatctacttttatttttaaagaattgtgtaattttgtttaaaagattaattctgagtctggtggaatagctccatagttacgggcactgactgttcgtctagaggcccaggttcaattcctagaacctacatagtagctcacaaaccatctgtaattcaagttctaggagatacaattctctgaccttctccgacaatggggacacaagtggtggacagacatgcttatatcccaaatgcccatatacataaaattagatagatagatagatagatagataggtaggtaggtaggtagatagatagatagatagatagatagatagatagatagatagatagatagatagatgtgttacctgttactatttactgattctgcgtttcaaacacagggcactaaattattggtgtctcaactgttcaaaaactgaattacattttaggaattatcagaataaaatacagaaatctacctaaagattctctaacatggaaaatattgtgtagagaaagaaattttcagttttcttttattcattaagtggtaataaatcagagagcttaaagtcagtcagtagttttaaatttagagcaagaagttctctaatatctctaaagactgtcaccagctttcccttgtacataatacttgaatttgcactaacgtttgctcacagtttataaataggttcattggaccttgtctttcatttggataaattaagagtgttttacacacacacacacacacacacacacacacacacacacacacacacacacacacaaagtgtcttaatcattgaacataagacattcttttcctgcttctatataaaatatacccatgttgaacagtttcaaaatcattacttaaattgtttgtataagaaaaatctgtttgtgtaatggaaccattaatgatttcttcaaatcttcatggggatttcagttaactatatgcatgctacaaatgcaatactctcaactgtcagtttcaaggaaagttttaagttgtttttcttttccctttgaaatccttttgaggcagagataattatctagttgttggtagtttaaaatagtatcctatatttggtgggtaatatccatcaacatttgtaatattcgctgatccctattactgttaaacattgctgtttctggaaccagttttatatagttataaaaaaagaaataatttatatttgattatcttctgctgtcatatagacacattatgcagtacgagataccattgcactgtgtacagccgaatccattgataatctccgagcaacaattgaatgtgagcagcctcaacctgatctctacaggtaagaagaccttgcttcaccttacttatgtctgttgtctctgcttctttttcctaccagtgtagcaaagaaatacccactgcttatttaccagcttgctctttgtatgtttttataagctgttcttattccaaggaagggagatgaatcaaattagccttgctcattaccagcttaagataaatcattatggacccaagcgtcctatgtttttcttttcttttagttacttggatcagttttttagatggttaacctaagcttcatctattagactaatagagtatctagagttaattaaaacaaaaataaacctttcgcatcttagccaacgtgatcaaaaaaggagaagatgggacagtccaattaataggcatgtcatcctttcttgttagtgagtatgatgaactgaagattacaaataggctatctgtggtccaccttaagccattaagttcaaggaccaataaaatgttatatttttcttctggttcttggatgtatgtttctgataaatattcattgtggttgtcaaaaaaatttgacattagaatctaagactcattagtttgattagggtatggtactgccgaagatatagtaatagtttttaactaatttcattctataccactgttgcacataacatctgctatgtaagcaatccatcatggtttgttttgttttgttttggtctttcaagacagggtttctctttatagccctggctatcctggaactcactttgtagaccaggctggcctcgaactcagaaatcctcctgtctatgcctcctgagtgctgggattaaaggcgtgcgccaccatgcctggctgcaatccatcatgttaattcatgctggaagactaaatgtctggaatttgttttctctgatatggagcagtagagaaaattatcctattatgagaatgttgccttccctttcattctttgtttcctctttctctttgttatgttcaccttgacactaagaactagagccacagctgggcagtggtggtgcatgccttagttccagtacttgagaggcagaggcaggtgaatctctgcgagtctgaggccagatgatctacagaatgagttccaggatagccagaactgttacacagagaaactctgtctcaaactaaaaccaaaccaaaccaaacgtttctccacctttaaggagaaaaaccattcttctccacatgaatctaaaataaaagccacattatttgtagaaaggtgtcataggaggtattgtgtatattgataaccaagtagaattttagttgatttaaaatctttgtatatactcctaaaacttgtaatattattttaaaggttaggtttaagttttatataatttataattttgacttttttcagaagcttagtaaaattttcaatgaattttcaatttattcagaattttattcttttattctttttaatctgatgaatttccaattgctgctatttggattttatacttgctagtatgttgtcttgttttgttttgttttaacaggtttgttgggcgaatcagtatctatagtaatagtattgaggctgttgccaggttagtttgatattccttttatctatccttttgaaaggagggatatttctcttttaaacccactaaattagtcagatgcctttctttaaatatattgaaaagaagatagctaagtaaccttttgactagtagggttgtggtggtagggtttctctgtatttgggtagattattattgaaataaatacatagggtttccaaaaacaaaaacccaaacagagctccatgggaccagccaaatgtttcaaccaataaagatacttgccccaaatctctagaacccacttttttttctctctcttttttttattaggtattttccttgtttacatttccaatgctatcccaaaagtcccccataccaacccccccaatcccctacccacccactcccccttaatccccagaacccactttaaagttgaaaggagagaactgactccaaaaaaccttatcctctgactgctactcatacacactctgtggcaaggtacatccatacaaacctaatcattatagacatgagttttcattcaaaaatataaaagagcagagctttgtacctgctttcccaaacctgttctagacattgcatatattttccctgcttgtataatggctgagaaggatgaaaataacgttgaagaaaagtggtttatgggagagcaagtacggctctagacagtgaggaaagtgctagaagaattgcttggacctaagtaaaatataaggttcatcatttctgaggcaatgcatacgaacagggtgctttctttcctcctttatcatggaattaagtgcctcagtttttcactttgccttaatcccccagaaatcaattttattcactacaaagacatcattgtggttttgcagcttgtcatttgccttctcagtcttttatctgtgatcctctatttctcacttcttgtagctcttgttttgccatctatgaatcataagcttttgatccttctgtaccttttttttttaacctttgcttgttgctggctactcctggactgcttccatctgtgctgtaccctcaagtcacatcagatggaaggagggatccgtctgctcatcctggggagtaagcatatggtggaaatagatacattttgaagccctcggagataggtgtatgttagggcaaaaatctgtccccagtgttgatgacattatatacattgtttaaataaagtgtgcttcttttttatttaggtctttgggacctgaaaatcttttgctgaaaggagccacacttaaaaataccaagaagatatatggtgaacaactttaaacatatgctgttaaaatgtttattaaaatctatggagaaaaaaataatgcatgctaaaagtgaacatggcagatacctgccttttattctcaatgtatatttatgtgctgaaaatttaattaacatgactgacattgtatcctacttaaattttaatataattaataatatcaacaatgagtagaaagaaaactttgaattctcaccatcatagactgaaaaatgcacagaaccaaataggcagggtgttggctaacaaatttaccaataactaggtttttgttacattctgttattctttaggagttgctgtttacactgggatggaaaccaaaatggctttgaactaccaagggaaatctcagaaatgttctgctgttgaaaagttagtatgaaccactattttattttagtcaatgttgattgaaatagttacttcttcagtaactccaaatagcaatagcagaaatcagaacccacaataacagtaactaccattttgagcacatatttctgcttctgaagtggtcctcattaatttatttctgatttgatttgattcaatcctctaaataatcctatgaagttatttatattagaaatgaagaaagggtctccaagatggtacatgacttcaataagcctacatagtttttaaatgataccatttatgtaaagtgtaaattcttttccttctgttgctggatttggggtcatttagttgatatgtgtatgttagttctacattattgttgagatagacattggagtggtagagcaagtaaggtgacactaacagaggtttctcttttttaattttaattaatttttaaaatttaattcaattttaactaaatttttgtttgtgtatctgtgtatacaacacacgtgtgtgtgcgtgcctctctctctctgtgtaagacagacaaagagacagagagagacagacagacagagagggagagaggtgggggaagagagtctcttgcagcacagactgattttaaactagctacttaagctgaggatggtcttgatattgtaatcctcctgcctgccaatataaatccagctacgggggtttatagacaccaccatgccagacatactcttctctttgcaggaatggatatgattcattgtgtcttattcagaattatgctgttaaaaatgggattcacatttgctattctacctttaatttgaaatatttagtcttttggcggggagaggcaatacacttttcatagaggttaagtagttactaaaacatatggatatgtctatttccagttattttacaggaaccttggtaaaggtgtatttgactagccagatattgtgccttggggaacattagtgatcaataaacagtccagggctagattttccattttgccacttaaacagtgattcttcagctgtgatcattaaagttcttacataaaaacattgggctgtgattatatagcatacacaggagacgctttcgcttagttaagactaaagtagactcaaattgaacatttacatttctgttttgtttatatcttaagtaactaggcatacaatcttgtttttcagatctattaatgccttcttgattgtttatttatttatcttactgaccaaagctgcagtatgcacaactcttaagtatgtttggcaaagttccccatacaatgatgaaccatggtataaccaaaagactcaaaaggaacgggaaacttttcaggtaattgctttgctgtgagaagaattactctttgtgattagactagccttcactgaaacactactcagaaaaatgagaccttttgatttagatttgtttttattttatatatctctatgtttttttgattctttcattaagagatttgaaaagtaatgagctttctggcattttaattcaatatgaacttgtattcctatctatatatgaattttgaatgtttccatctatggataggaggaatttaggacttaatgaggtgaaaaagtattaaagtagaaagctgaaaaatatagataaaattcatagtgttctaaaatgttgttaatactaatacttttgaatataatgatatagtgtcattaggaagtttctttatattaatagtgtgttaagcattaaaacaaaagaaagccattttatattttattcatctaaggctgtgaatctaattaacatgaaccatctcttattttaggttttgaaaatgttcactgactttttatcattcatggttcttttcaacttcattatacctgtctccatgtatgtcacagtagaaatgcagaaatttttagggtcattctttatttcatgggataaagacttttttgatgaagaaattaatgaaggagccttggttaatacatcagaccttaatgaagaacttggtcaggtgagaacacagtttttgctttaattaaactactatagtaaaaacattttctggtctggaataccaatataagtaaccatttcttttattgacatataattcaaaggaatatctttagtgtagacaaataattaaaggtttgcaatattttcacaactgccacttcagttattgtttactagtatttttacaaaggataaaatgtatgcatttaatataaatattacagaaatctatataaaagttcaccaaacgatactgtcagataaaaacatgaaatgtggttttccttacttcctataatcaattctgaatagaatgaagtataataaaatattgctattttacacatgcatgtttgttaaccatagttatcctatattgatattttctggggtgcatttcttatgacattgaacatagacctagcaagctatgtgtattccggtataaaaatataaatgaaagaaaaacataaaggcatgtccttcctcctcaataccatttcccagtatatttgcttcatataacagggtaaccaagacactgcccttgtttctaacataggtgcctttattttctgatacagtgtaacatgtgatttaagcaatgacttcttaagtgcttttctcattagtggtttgtttttattggtcttgggattgaacctgagatatgaagaaaggtaggcacatgctctaccactgggttagaatatattctttctacttttaattgtgagacagggacttgcttaattgcacaggaactcatgtggtagcctagacaatttttccctttgtgatcttcctgcctcagcttcccaagtcaatcaatatagacttgagacttgacctggctttcttattagtattgagaaagatttcccctttgtctaaatttgctatgtattatctaatgtttatagttgaatggaatttttttctttcagttaattctcatgatagtttataagagtggtacaaatatcatttctgtgagtagaaaatgcaaattcaggcaatgaaatggtggctagaacaaagcctcacatttgtttgaaatggtgctattttgcatctgtacctcaaaactctctttaaatttagctcttcttctccttggactctctatatctacacattttaatttttaacctttatttttattttagtttatgagtattctggcttcatatatgttttttggaccatgtgtgtacaatgtgtttggaagccgtaataggacatcagattctcttaagatttagagttacaagtggttataagtgtgggtgctaggaattgaacataggttccctggaagataagtcactgctcttaaccactgagccaatctctccagcccctatttgcgctcttggcacaatcttggcctaaaccaaagtaccatttcacagttgacatggaaaagaacaaaaggactttgcacatgctattctgtttagaagtgacttcagatattggtagctcagaccctggaatctacattcctcattgattctggaagtgctgaaacagtacaagaaataagtgaaccagtgtcatttcccgtggatttcctaaagattcttttattgattaattgagctgccacagttaatgccaactttattttttttatttttttaaatatttttattacgtattttcctcaattacatttccagtgctatcccaaaagtcccccatatcctccctaccactcccctccccacccattcccactttttggccctggcgttcccctgtactgaggcatataaagttttcatgtccaatgggcctctctttccagtgatggccgactaggccatcttttgatacatatgcagctagagtcaagagctccagggtactggttagttcataatgttgtttaatgccaactttattaagccgtgtatttgcacataggcgcaaggttgaatagagttactttaatcccaatgagaagcttaagtctacaggtttttggcataagaaaacatataaatgcagaagctaccagctcatactgtccactaagtaaatatgtgtcatgtttgttgcaagcttatagggatttacttatccagaggcagaagtgaaggctagcttcaactttcaatgcaaatatgataactatcattccatagtttaaacttaatgcattctagaggcagacaggatgcctagggcagattcctcttgataggactcttgcctcattttttcatatttcctcttcacaagtatacatattacctatatgaatactctggctcttctagattgtattaagagtataggcaataaagtagagggttgggtaatgatctggtaaatttgctcagtggaaagaaactaccacgtttgtttccatttccattaaatttcccagccaaactgcatttctggatatggttatcatttcttcaaatcacaaagttaatggcatattactactttaattaatacaatgcctaaaccacttggaatcattattagcttgtatgtgtagaaagtacaagaataaaaatacaaagaagtcttgaaatagtttcttgggctatttagcactcaatggactgttacacacaaaattaagtgtaaccaatttcctatctttgagtaacaattcaagctgtagagctttttatgtttctaaatgtagtatcagtttattgccatcaaggccacagtaaatatttgctttagtgacacattagtatgaaaaaagtagaggaacatgtttattgggacagtttttggtgtaataaataaaagaacagattcttaattcaattataaaattataagatatgttttgataaagtaacaatctttcataaaactgaatagttttagtagatcttgaaaaagttgtggggaatatcctttcttatatcccttcaaccttgtggctatatctaattatatggcatcattcttaagctataatttgattcaactcatccaatacagttgttttgaggtcctaacatgtacctgagatgtgttctgcatattgaagttactgttatgaagttcaaagaaagaaaaaacctccaattacccactacctgcttggacaaacataatagattttactttattagtatggttataattaataagaaaatcggaaggtaatggggcaatagaaaaaatcttattaatatcagtcaaatgaatcagagtattctgtagagagaatatcttatgtatgaatgcatcacctgtcaagcaaatgacctgtggcttaggcaggaaatacaaggtgtggcacccaggaggcagaaagaattctgatatagagccaggtatggaagatttgccaggaagatacaacaagatgatactttaacacagataaccaaccatatgatagaatgtaggctagaatagatgggatattttaaattatatctagtcagagaagagcctagccaaatggccaaggtatttgtaaatatattttgagtctgtgtcttatttctgggaacatgggaatgggaggtagaactggacctaacatcaacagtattcatcaacatatatgtagtaggtgggacatatttattgttaagctttacctatagtcattatagtcttatacatcaagtattttactttatagaaaaattaagacatttttatcaaggtttataactgataagccagagctctagtctaagggttcctttaggttaaagcatttgatatttgttttgtttaacttacaaaataggtgacttcatgtgtttagtctagttcaagagttctttttaaaaaatatttatttattttatgtatatgagtacattttagctgtctttagacatagcaaagaggacatccgatctcattacaggtggttgtgagccagtatgtggttgctgggatttgaactcaggatctctggaagaacagtcagtgctcctaacccctgagccatctctccagccccctcaagaatattttaatccctatataaccaccaacttcaccaaaagagcagaaaaatttaattttttcctccactactcagagtaattcaacacaacactgtcacaatatgacaccaaggcaaattcttcagtgagttccaattctaatactgtctacttcaggatacaaattgaagcctaagtcctacagtactgtcatcattcaaacaccaatcacaagtgcatgtgattttggtcatacagttataaatcaagattattacagacccttgattgaatttcagtaatttgacagcatgatctagaaaactcacagaaacataataatattgcttatcattatatttaaatagttattaaaatggatatagaggaataaccaaatgaaagatgtgcatagcacaaggtacatgggaaggagtgcaaaccattgtggcaaccttcaggaaatctccatatgatcagatactttaaaagttgccttgttttggtttggtttgagggttcaatagaagtaacaaaacgtaacataatgatgaaatcatcgaccattggtgatcaccttaacctttagctcttttaccctccccatcaggggttatgagatagagatgaaaattccagccatttaattaatgtcttgctttcttcagtgactttcccctattcaaaagggtatctaggtatatagggccaccagtcatctcattagtatatgaaatatatggatctctttctaggattaccaggggttttaggttgtgtttgggagattaatagtaaatagatttttcataatatataatagtcttgtcatttttgacacccatccttttacataaagaggatatacaacctcaaatgatagtaaggcattactcaaattgtactcaatcattaataatttttctagtacattatccacaatatctcccagagtgagaatactgagaaatacaggctttatctaaaacttgtacagttctaaaattaggagtaagaggcttctatttgattgaactaggggactgtcatctctttctctgagtcccttttaaggtattaagtagtattggattgccctcactgcataatccatttattcatttgtgacccaaaactttgattcctcctttgctagatattcagactttctcacattgggaagggtgattaggcttgtctgttgtgcacatctagactgtaggcaagtagtccagaggaacccttccccttctttcctgttcagataggctgaagttgtgtggagatgtgatcagctatctgtacagttagttccaagcgcagtaaaggtgcaacccatttacatcataagctcctttgaagttttaaaggtttttaaaacataggatgtgagggtgtactttagtatgtagtatttgctttgcatttatggaaccttgagtcctattctctacagaaggaaatgaaaaacctcaagtttcttgcttaggaattttctgtatatccagcacttgtagggtttgtttggtttgttgttattgttcttgttattgtgtgtgtttgtgtatgcttttatatatggttggcttttcagtgctggaaattgaaccaaggatattacacatgttaaacaagtctcttagtactaagctttatctctagcatgtttcttttttgagataggatcttactaaaatattcatgctggccttgaactcactctgtagctcagacaggctttagtaataccccaaccttagcctccttagtagctgagatcataggcctgtaccaccaggcttatcactcagtagtttcaccatgattctataaccattgcatcggattaaaaaaaaaaagtagaagaagaaaaaagaaaaaagttgtgatggtctgagaaatgaaaagggggtatagaaacatctgtgttagcagatacatagtcctctattatcatctaccagaaaaacaaaggactatctagtggggacattccttctgtcacaccatgttgattataagcaacacattcagccatttatcatctcaaaatgatgttcttactgctctggtgtgttagaagctatttcagaaaacagaagcagatcaaatgtgtattttctaatattcaactaatgtaggcttcccatccataaactgatgagcttgtatttgctgatagagagaagcctttcatccagctcaaaattgtcattgtagaagaatctctttaggcagagcccaagagcaagctgtccttttatacctgtttgttaaatatgaaagtgcttaatataaatcacagctagccccctgtccacttttcctgaacacatagcatatgagaatggttctaaaagtactgtgattctagggccaacagaatcaatattcaggaaattagaactgaaaaagatgcttgttttattttatattttgttgccttagtgtttacttttactatctaaactattctatggacacaaaaaattgtacattttatgttgcagtttccacctttaacactaatgaagtggtgggggggcgggcggggctagaaatacagctcagtcagaaaagcggttcccataaaagcacaggagtattagttctatcactgggagctgtttacaaagggcccagcatgatggcatgcactttaacccaaatactgaggacatggagataggcagatccccgagcctccctaactgtgactgcctcacctagcttcctagagagtactaggtcagtaagagatcctagagaaggatagttcttagacaacaacatcctaagttctcttctggcctgcacatatatgaacatgcaaaagattctgaatggactaatcctaattgaaatgcatgatgtgaatcaacccaccattcttggaaaaataaaagtgaatatttttgatcaggaatagaaagccccccaaaatttcagtttatttagagaaatctaactgacacacaagtaataccactaggatcaatttaaaaagaatccaaactgggcagatgaatagggaaaaagaagactagaatgctttatttgtatcagtgttggtaccatgcaaagctttgaagaagaattcgaaagctactactgctggagtttattgcttttcctacataataaaaaccagactcttgtgcttaggcttattcctgtcagcccataatattaactatttaagcataaattagcaaaaaggaaaataaaattgtgggtttctaaaagccagatgttataaatagagtagataaaaactgagataaaatggaagtacttaaaatgatttattgcaatggaaaatttatttcattggcttattttccattatttttaaaaatatacctacatattctattttaacctttttttaaaatttggaaacagttttgagtagtatctgagaaagaggcatggaaaaatatttttttgcagtctcttaccaccttttacctgttgtatctcctaattaaatagctgttaacatttctctttcttctgtcttatatgttctatagttgtaatacttttatttcagtgaagtatttttattaaaaaatgtcctgacaagagaattccccaggtaaaggtgcttgtgaggcatcctgttgacctaagatggatctttggatcttacatgatagaaggagacacctgtcttctacaagttgtcctccaacctctctatctgtgtattggcatgcatgttatatattatggcacaaatacacccaatacatttataaaatgaaatataattttaattgtgcttttcaaggaggaagatattgtcatcagttttctttgattgtatgccaactgtatttttattgcatttcccccattggcttatatactggccagttgtaggcagtgctcactctattgttgtcctccttggaaaattaactttcttaaccttataaaaacattaaatgattaaagttgcttagcttcacaaaatccatagttttctgtcctgttagttttctacatgtaagtaagtttcagtgtctttgaaaatgctcacaattttctcatttatttgataacagtgcatctctaattctgacatttgacaagtcttagaagtgatttttgtggctatggaagtaggactgccttctagctgagtaaaacttaactatactaaagaatatatatatgtgcttatgcccctgtttctaggtggactatgtatttacagataagactgggacactcactgaaaatagcatggaattcattgaatgctgcatagatgggcacaaatataaaggcacaactcaggaagttgatggattatctcagactgatgggcccttagcctattttgataaagcagataaggtgacattttctctgttgttttacctgagaaatcaatctttgtaagcatgttttatccctatatagtagaaataccgaattttccaatgggtgcatgataacgagttttgaataattatttgctttttttttaactacacctttcttttattaatacttttagcatttgtagacaactagaacttagaagtagaattatgggaaatggcatttgaacaaaaatattaacttagctgtatgtgcattcacttaaaaaaatcagcttttctaagaatgttgtctcttcaaatcattaaagacctaatatttacatgttaggtaaatcaaagtcttcctacacatgaacaattgctagattgtgatacctaactacatcttaagccataaagaagtcactaccttaggtataggtgatactacatgtgaatttgaatgagttaataatatatatgagtacactgttagctgtcttcagatacagcttggttacagatggttgtgagccaccaggtagtttctgagaattgaactcaggacccctggaagagcagtcagtgctcttaacctctgagctctctctccagcttccaggaaccagtaattgtattcgttgctatgtagtcgtttgagtatttggaatttataaatttcagagagattatgacattctgtcaccttaatatttttaatttgttcactgtctgggttacctagtgatcaaaataaaaagaatagtaatttgatgcttctgttccacagaaccgagaggcactctttctccgtgccctatgcttatgtcacactgtagaaatgaaaacaaatgatgatgttgatggacctgtagaaggagccggattcacatatatctcctcctcaccagatgaaatagctttggtgaaaggagctaaaaggtaagtacttcttgaatttctgagaaagggaaagcagaagaggacaggcgtttgtttgatgtttttcatttgcttcagtaactcagtcatgtgcctctcctgttttgtaagttcaaacagaaaatggtgaggcattcgtttagtttgctttatgtattcatcccagtcattagtccaaattgtcatattatattttgtaaatcatctaacagcagcagcatttttacaactcatgttatttctaagtactgccagcaattttgatgcaatttgataagtgacaatctagtttacccatgaaattcaagatgactaagtacctaaaaggtcacatactgtttttgctacaaaattagaattacaaattgacttcctcttgaatgtagtagtaagcagttgttgtattcctctttgttatcaacttatcttgaaaggggaaataaaattggcgattgagatcgtttaaaagaggaaaagaatttagacagtatcagggcaagagaaaataaattgttccttgaagatatacaagacttttttcttgttttcataggtttgggttcacatttttgggaaatcagaatggatatatcagagtagagaaccaaagaaaagaaatagaagagtaagtagcactgtgttttgatgtttgtctttcttaacccaattgtaaacaataaatggaatcagaaaggaaaggaaacttatgtacctatcaggattgaactgtattttcccatttcagagtctgtatagatatagctggggtaggaaaggccatttgtcatagaatgtcctaagtatgaatttggaatagaagttccagtgtgctttacatgttgtcgagactgagtcttggtgaactatttataaaatgtagatgaaaatatttatttacatgtcctttccttttttaactcttctgtatgatttacatacatagacagatccaagtcatctcataatgtcattattatactttttaaccccttctctagccttactgttttaagataaaatgccacgtttctaaaacagcaccaaagttcccagttctcagcacctgcttattttctgtctttcatctcttgctattctcctatcattgagctttccaaactttggaaatttaaactctcttatgaaccatgtgctgccatgtgtgcttttatacatgttctttcctgtgctctaaaatcatacctccctccctttaacatgtcactcttttagaatccagcatacacccttttccaagaaacattctttcagttggctttttaaagatctgtgctctggtgtcacttttgagtgttttgattgaaggaagtatttaatgaacttggaatacagttattttctttaccttttgtgtcctttataatgtggttaagttcttagaaaagtcatcagcagattcatctcaattcctcaacacatgcatggcacagtgtctgaccccgtaataggcactcaaatcataatcccactggacaccccctccagatctggcttgatgggctagttctttgttttccatgcctatgtagtcattctttttgaagttatacagtgaaaaataaaaacaacttttactgctatcatcagaatgttcagcatacagagacatttcgaagaaaagtggaaagtaccactttttttttgtagtatacaaaactaactgtctacatccaaacaagaaagccttgtgtccattaagatggttcagtcacatgccttttctcatctcagtgtaactaagttatttcactttttcatctttcctaaggtatgaacttctccacaccttaaattttgattctgtccgccgacgtatgagtgtaattgtaaggacccaaaaaggtaggcatctttaaaatttgacttatttatctttttctatttgtaagggttgtttataagctttttgaggaaaaatattttatagagtataggattaattagtattacaaattttagcaatatttgaaataccaattatagcagcctagagttcagaaagttggtggttgtctatatttttctgacctctgttattctacaagtgcttgatactcttcggaagcaagtaaagtagagatgtatcgttaacctagatttctgggaaagaatattcttgtttcattccagagctaagggtcctgaaagaataaaacttaccttttcagagaaatgagtactgtcatctctaggttgctcaatgtctttggtactatggtagtttgcctcctgttcagattctcagatgtatgtatatgtgtgcgctgtgtttctttgaccgcacccccctcccagaggcttatttccaaaatagacttgatttattttagtattaaatctactgcaaattgtttagtgagaaagtgcaggcaaagccatggtgaagtatagttcactttacttgtatggtctgggataacagcaaactcaggagactggttttagtttttgatcatggaatttgtttataacttttaagcagacttcactgtgtaattggaaatgaaatatttagcatttaaatattttcatgtgtgctcatctatagctatattctgcaaatggcaaaatgtctgaaaaataacatgcaaagtattggtcccaaaactacactttaatttgttaagcacagctatttgctttataaggataaaatgtcttaatgctcaacaatatatgatccaaaacttcacttataatatcagcattatacaaaggaattttaaatacctttttaaaaaccttaaaagcccagtgtagctcaccaagcaagtgttcttagtttattcagagtggacttgggctttgggagtttttggtgtttggctctaggctgtgcctggctacattttgagagatactcacctggagttccttgacacagcctagtactctgtgatctactagaaggaattgtagcaagagtgcatggggtaggatttggcttatttattatgtctatagtattctaaagatggtgattgttctcacaaactaaagctctagatattttatttcatttggttgaacattacagaaaaaaatcaaaatatatagaagttgcatgagaaaggctaccttagagttaccgcttctttaaaatcctgctaccagtcttcacattctaagttgattactctggttctttattttaggagatattctacttttctgtaaaggagcagattcatcaatttttcccagggtacatagccatcaaattgagttaaccaaagaccatgtggaacgtaatgcaatggtgagcctgcaccccttgcttcaacaaataaatgggcacatggtggagatagctatgtttgtggtttctaaagagatattgatgttaattatggtttatttcatacttggaaatttggtcatattcccatattctttattttaacataaattactatcctagaccagtattgtgattagaactagtacttgaagatgtttcaaggattttttttccttgacgaaatattaacttttaagtcgcatgctattcatttaaagttaaacatcagcatttctctttcatacagatgggtaaagaaaatacctttcaagaatgtgcctgggctaggaagatgtctcagcagttaaaagcagaagaccccagtttggttcccagttcccatgttggatagttcatagctacctgtaactctagcactagatctcatgcctctggcctccatagtcatcagcactcatgtgaacataaccatacagagacatcttctgataaacacacaacacaattaaaaataaaccttcaaaaggtataacattcctttagctattacagagataactatagaacttctgctttgtttctaggatgggtatcggactctttgtgtagccttcaaagaaattcctccagatgattttgaaagaatcaatgcacaactagtagaggcaaaaatggccctacaagatagagaagaaaaactggaaaaggtttttgatgagattgagactaacatgaatttaattggagccactgctgtggaagacaagtaactagatattcttgttaacgtttttcccttccctttcctccctctaaaacctcccatgtccaactccactttgttctcttttacattcatgatttccttttcctttaagtgtatatttgtattcctaaatatataaatgcctgcctcagtctctataatgttatttgttttcagggctgactttttagtattggctaaggaattggtgtgcacttccctgggggtgggaaggacactatttctcttccctcagccagcattccttaactacctgtagttctttatctcttttttgggtcctattagcatgtcttttggtattgtatttcttcaggtgtactcttgttattttaatgacctgacatttagatatgtaccagattagtaatttatttacatattttgaaatctcttttagcattgtcgtctaaataaacttagattggtttattttaccaaatatggaaaatatagcagattttgaattctagaaatagttttaaagtaaatacatgtatcttagaaaaaaatgaatccattatcaatatggtcttttggatatttactaaatcatctaattgtttatggaacttttatgaaacaaccacagtatataagataggattgtagaatcattatttgaactggtgcctagaataatgggtaggattttggtaaatgaccaggaaggaaattcacagtaaatagctcaagaatttaatctaacctgcttctacaagccagaatatgtttttgaacactttaaaataaaatgttaaaaccttaaatatgtaggcttagctttttgagacattattatagaacttggttaaatatttgattaagataatgttttaaaccaccaaagccagacactatggcagataccaacaagattttgctgaaaggagcctgatatagctgtctcctgagggcctctgccagtgcctggcaaatacagaagtggatgctcacagtcatccattggactgagcacagggtccccaataaaggagctagagaaagtacccaaggagctgaaggggtctgaagccccataagagtaacgtcaataagaactaactagtacccacagagctctctgggactaatctacaaatcaaagaaaacactgggtggaacttttggctcttgctacatatgtagcagaggatggcctagttggtcatcagtgggaggagaggcccaaggtcctgtgaaggttaggtgggttggggagcaaggggaagggggaggagatataggggattttcggaggggaaactaggaaagggaataacatttgaaatgtaaataaagaaaatatgtattaaaaaaagataatgttttaattttttaaataaaacaagtttttcaaagatagcttcataatttagtgtactggttgctcttccagagaacctgggatcaattcccagcatccacatggtatccacaatcatctataactcgagtctggaattatccaattcctttttctgccattcttgagcaacagacatgcacatagaatacaattccatgtgcacagggaaaaatacccatacatatacaataaatttttaattactcaaaaagtaatagacatgtatttaaccaaagtattaaatttttccttgtttttattttgtgttaatatttattagttttttacacacacacacaatgtaatttagtcgcttcattccctctctcatctctctcatcgtagtcctcatcgtagtcctgctctcattgaacctcttctacccaacaagatcccctcctattttctttctgtttccttgtctgatttctgtttggtttttgtttggctttgttttgtttggtttggtttttgcagcccactgagttcagttaaggctgcttgcatgggcatgaatagtataagcattttcccaagcatgaccaatttagtggtggctatgccactaaagaaaattactatcctacccctgcaaccattaattgctaatagttcctcagagagtaactatgagccccttgtccacccatgatagaattggtaggtcctattttctgtaggtagatacacatgctggggattcaggagtgcagtgactatgacaaatccaaaagctcaaaagtccagaagttcaaagcattcctccccttcttccaccccctctttcattatgtttcctaaaacttggagggattacatacatttcccatttaagtttgagttgtcatctgtcacttttgaccagttatcactttgacttcattaactgtcacccacagcaaagtgaatcttctctaatcaagattgagaacagcactaatctataggtataaacataaatatttagaagtcagtttggcactatagtcacttagtttttaaaaaaaaaaaaaaaaaaaccagcagattacatcctagggcctagtacctcgagtgctatagacttttggctagtttgcagtaccaagcaagagttccctctcatggaaagggcttcaaatacagtttttaggtttttttgtgggatttttgtttgtttgggtggttggttcgttttgttttgttttccccacggggtttctctgtgtagctctggctgtcctagaactcactctctagaccaagctggcctcaaactcagaaatccgcctgcctctgcctcacaagtgctggaattaaaggcatgtgccaccactttctggccctcaaatacaattttttttggtcatcttttttcccccacattttttattagatattttcttcatttacatctcaaatgctatcccaaaagttctgtatatactccccctgccctgttctcctacccactcactctgacttcttggccctggcattcccttgtactggggcatataaactttgctagaccaaggggccactcttaccaatgatggctgagtaggccatcttctgctacatatgcagctagagacaggagctctgggggtactgattagttcatattgttgttccacctataggattgcagatcccttcagctccttgggtgctttctgtagctcctctattgggggccctgtgttcacttctatagatgactgtgaacatccacttctgtatttgccaggcactggcaaagcctcacagaagacagctatatcagggttccttcagcaagatcttcctagcatatgcaatagtgtctgtgtttggtggctgattatgggatggatccccgggtgggtcagtctctggatcgtccatcctttcgtcttagctccaaactttgtctctgcaactccttccttggatattttattttgtattctagggaggaatgaagtatccacacattggtcttccttcttgattttcttgtgtcttggaagttgtatctttttgttttgttttgttttgtttctatttttgtttttcgaaacagggtttctatgtatagtcctggctgtcctggaattcactttgtagaccaggctggcctcgaactcagaaatccacctgcctctgcctcccgagtgctgggattaaaggcgtgcaccaccaccttgggtattctatgtttctgggctaatatccacttatcactgagtgcatatcatgtgtgttctttttgtgattgagttatctcactcaggatgatatcctccagatacatccatttgcccaagaattttataaattatttttaatagctgagtagtactccattgtgtaaatgtaccacatttcctgtgtccattcctctgttgaaggagatctgggttctttccagcttcaggctattataaatagggctgctatgaacatagtggagcatgtgtccttattgccagttggaacaacttctggatatatgcccaggacaggtattgctggatcctccggtagtactatgtccaattttctgaggaactgtcagactgatttccagagtggttgtaccagcttgcaatctcactagcaatggagaagtgttcctcttcctccacatcctcgccagcatctgctgtcacctgaatttttgatcctagccattctgactggtgtgaggtggaatctcagggttgttttgatttgcatttccctgatgattaaggatgttgaacattttttcaagtgcttctcagccctttggtattcctcaggtgagaattctttgtttggctctgagccccattttttaatggggttatttgaatttctggagttcagcttcttgagctctttgtatatattgggtatagatgtaccatattttcttgatccactctacagttgaggagcagctaggttgtttctagtttctgactattacaaataaaacagctataaacatagttgaggaaatgtctctgtgggatgttagagcattatttgggcctatgcccaggactggtaatggctgcgtcttaaggtaaaactaatcccagttttctgagaaaccaacaaattgatttccacagtggttgtccaagtttgcactcccaccagcaatgaaggagtgtcccccttgctccactcctcaccagcatgtgctgtcacttgagtttttgatcttagccattctaatgtgtgtaacgtagaatctcaaattctttaagtgcttctcagccatttgagattcctctgttgagaattctctgtttagttctgtaccctatttttcatttgggttatttgggttgttggtttttaacctcttgagttctttataaattttggatattagccctctgtcagttgtagggttgatgaagatcctttctcagtctgtaggctgctgttttgtcctattgatcctttgccttatagaagctttgcaatttcatgaggtcccatttattcaattgttgatattagagcctgaactattggtgttcttctgttcaggaacttgtctcctgcaccaatgcgttcaagggtatttcccactttctcttctatgagatttagtgtatctggtttatgttgaggttcttgatccacttggacttgagttttgttcagggtcaaagatacggatctgtttgcattcttctacatatagacatgcagttagaccagcgccatttgttgaagattctttcttttttccattgtatggttttggctttatcaaaaatcaagtgttcataggtttgtgggtttatttctggtcttctatttgattacattggtcaacctgtctgtttctgtatcaataccgtgcagttttcaatcactattgctctataagtacattttggggtcagggatggagattcctcccaaagttctttcattgctcaggattgttttggctatcctagcttttttatttttccatatgaagttgagaattgttctgtacaggactgtaaagaattgcattggaattttgatagggattgcattgaacctacagattgcttttggcaagatggtcattttcactatgttaatcctaccaatccatgagcattgaagatctttccatcttctgagatcttcttcaatttctttcttcaacaacttgaagttctggattgttttggtacctggatttcttactgtagtaggtattgtgagcataggagatattgggaccagggtgaatctctatgatcgtggtgtagcatgcctctgatgagtgtctttgggttgtatggttccagatctgcaggtctgcatggttcaagagctggagatgagatgaaggtgggtggataatggaggttcttctgggctagcagagtgctcaaggcagcttggcttgttccagaggactcagccatagggaagatgggtggggaaaggaaggttacatgtattgttcaggatcagcaggtctgatgaaggtggggggagaatagatgtcccctaggatagcaggctcctcagggcagcttggcttgttccagaggactccaagcatgagagatgggttggggaagagaagcttatacctgtagggttccggctcaacagatctaataaattgctcagagaggtggcgagagaatggaggtctgcctgggctagcctgtacctgcatatattttaatcatattccttgattttattatttcttacctcctgtggctcccctttccccttctcctcttaaaagaatttcttttgtcaaattttattgatattctggtatctgaaaggaagccaaagaaagtgtcattattctatcctttattcttaaattctcaaggaaaactactgtatttcctttatttatttacttttctttttatgagacaggatcttagctgtgtaggcctggcttgcctggaacaccctatagagaccatgttagcttcagattctcaatgatttgcctgcagctgcctcccatgtgctgggattaaagatgagctacagcactcagcagctttcctaacattagaagttcctcaatgctaagagtttactaatatcccccatatctaattagaatgtttcagctctttccattttgccagaggcaacctgactataataaggattctagaattggattgctagtgagctgtaagaatgcttacttcaacagtccttcttctctcatgaattttagagattaacgaggtttctttgtgtttttaggctgcaagatcaggctgcagagaccattgaagctctccatgcagctggcttaaaagtctgggtgcttactggggacaagatggaaacagccaaatctacttgctatgcctgccgccttttccaaaccaatactgagctcttggaactgaccacaaaaaccattgaagagagtgaaaggaaagaagatcgattacatgaactgctaatagaatatcgtaagaagttgctgcatgaatttcctaaaagcactagaagccttaaaaagtaagaaagtacatctacttattaatttatacattgatccaaatgtaaataagagattatttttgtagaaagctctgtttgctgtgatttactattctgtgttgatttttttcttctaagttaaaaccttccctgaggacttgtctaattctccacttgagattatttgttgctgtatctctctcttaatgtaaaagtcaaagagatttcgcaagatttagtgtcaaaactcaaacattatttggcagtgctgtaaatcgaacctagggcctcacacatctttgacaagcactctaccactgagttatccccagctcagttcctttttttaaatgaatttataatttacatgtaaacaaaagcatataattgtacatattaataagttaatgtgatattttaatacatgtgtacactgtataacatttaaattatagttaaacacatttttcccaaaacacaataaaaagttctgtagaccaggctggcctcaaactcagaaatccacctgcctctgcctcccaagtgctgggattaaaggtgtgcgccaccactgcctggctactatttgtctctttatgtctggacttttttattttttagttcattattacacataatataatgagcttcattcattttgtccatgtagttgcaaatgacagaatttcatttttgtagctctgtagtattctaaattatgtatgtatcatatttttttctcttattagttgatagatacttaggtggtttccatctgggctcttgtgaatagtgttaaaatgaacactagagcacatatattttgacatgcattttgctcttgtatatatactcagtagtgaaatttctgggttatagcagtaacttttcatttttctttaaaaaaaacttttacagtagctgaatttgtaaacatttagaatctagacatataatcccatcagactctggaactgttgacacagtttttgaggttctagactattttccacgtgaatttgtgtgcttcagtactccaacaggaaccaaataaaccgagattctgtcttcaactagcaaaggaaaaaagatttatggagcctaagaatttccaggaaaatttctgattgacaataccttagtgcctagagataaggcatctctcattcttctcattgtctacattgcccagtgttttcagatttcattagtctacaaatagagctagtcatagacagttctttgaatataggtaggctagggttaagaacccctaggtgatataaaatggtatttatttaaatgatacatatatttatttatttatataatgttgtttaatgagcaatatatcttcttgatgttttgccctatttgaaaatcatgtttgcctggcagtgatgacgcacacctttaatcccagcacttgggaggcagaggcaggtggatttctgagttggaggccagcctggtctacagagtgagttccaggacagccagggctacaaccttgtctggaaaaataaaaaatgaatgaatgaaagaaagaaagaaagaaagaaagaaagaaagaaagaaagaaagaaagaaagaaagaaagagaaagaaagaaagaaagaaagaaagaaagaaagaaagggaaagaaaaagaaaaaaaaagacaatccctgttctctggatttcctttgttattcaggcaaagatgctatatttgtttgctcttaagtcattttgttttctctgtttccccagaagttttaactgatgagttattgaattttgcatcatttcataatagtctaactaattaagctgtagttcaaaagactaattttaaagttttacagtgcacaaccaccttcgtttttataattttcaaaacttagaatcaaccatgtgggcaatccttgctccccattgcactatttgccccctgatgcctgttatttgggttcttgttactttacaggtttttttaataggcaaacttgatgcaatcgattttgttcgttttgttttcttcctcatttctctactgaagttgacattatcaattacatcctccctgaaactctccttcttaggccagtgcactagttcatcatctaaaagcagttgctgcacaagccgtttgacttgagtttcatctctagaaccaattccagaatagccctctgatctccacacatgtgccatgcttgtgcatatgagcacacacacaataaaaatgtaaaaacaccaactctcttttaaaaaaagatttatttatttattatttatgagtacactgcagctgtcttcagatacacaccagaagagggcatcagatcccattacagatggttgtgagccaccatgtggttgctgggaattgaactcaggacctctggaagagtagtcagtgctcttaaccactgagccatctctctagcccccaactctctttcttggtgtctatcgcagtgttaacatttcctcccactttggcagtctgatatcttaattttctccctaaatatctttttctaaccagaactcactgttgttcttttattagagacaatttattctttgggacgattgaggaaggaaactagaactggtgacttgtcttatctggaatcctccccctcagtgattgagaaactcaaaatcatgcagggtatggaggtgtgtgcccgtagtcccagaacttgaggaatggaggcaggaggatcaggcagttaaaggacatcctcagctatagagacaattgaaggccagctggagctatgtgagatctgtctcaaaagaaaataaaaatcagggtcttaattatacatttttaaaaatctttttcagagcatggacagaacatcaggaatatggattaatcattgatggctccacattgtcactcatactaaattctagtcaagattgtagttcaaacaactataaaagtatttttctacaaatctgtatgaaatgcactgcagtgctctgctgccggatggcaccattacaaaaagcccaggtaattgaatattagttaattttttcatactggatcctctgtgcacatctcatttctctccctgaatttttgtgagcaaacagtgtatctatactgtaccttgtaccttcaagcttgctgacagttctttaccacttagacttctgtaataagtacttagtttctactgcctctgcctagtgttccttcctcttcgtggcattcttagttctatgtatcctgtcatctcttcttatcttactatcctactgtcttggttacagagaaacctggcccagttcactattcttttccttgttcctctactacagttagtgctatcacttacagtttcctcaaaatcgtccttgatttttgtgcttgtccaaaatgctatttcccttcgctttcccattgtatcttttcatttggtttcatcctgcatttttaatgttttattttattttgatgtgtgggagtattttacctgcatgtatagatctgcaccacttggcttcctagtgtttacagaggccagaaggaggttatcagaacccctggaactggggttagagacatttgttagctgccatatgggtactgagaatagaacccgaagcctccttctggctcattatcctagattttctatctgcttaatagatttttcccctatttgctttcacgttatagtcttagtctctccaccgccccctcaattcttccactgataaagctctagacctgactttttcttaagattaattctcctatttctaggtgtctgctagacattgccattttgattctctactatcacacattaaattatagtttcataagacagatcttacaattttcttgaacagtttgtttcttccctggtcttattttattcctgttactagagccatttttcttttgttccctaaatctcataagtctatttatcctacctatttttttgtcatagctctcattttcatgaaaccttttggtgttgcacatatttttcctccttcctagaacatatggtatcttgtgattcagaactcgaagtattttatctttgtcactgcagttagttttctagactagtaccttctcatctcttatatccatatagtttaagtcattaccttctgtctaaatttttgggattctacgtcattagtttcttacaaacccatcttcttgggattgttttttgttgttccaactctgccttctcacagcttaattatcattttttcttggcatttcttattgtttctataaccaagcttactagagttttaacttttaaacccaaatcctttattgacttcttatgcttttctagtacattttactagtcttttctacctgtttctttcttcagagctcattagacttcatctgtaagtagcctcctaacatctctgtttcctcatttttgttttctaccagtgccttctatactctgctgcttgtacagtatccttccatgttggcctgagtctgttatctatatgtgaacatttgttaatatgatcacaccagacatactttatcagtgtttgttatcttcacttccctgtgtgccttttttatgtcattcctttttctctgggaataccctattatttccctgcacacacaaattttactagaatttcatgatttaaattatgctagtgtaaactaatgcctaattgacaaatattttcctcttacttgatatcataagctttcttatatggaatttttttacattgatttatttattgtgtggtacatgtactttgttgcacatgtggcgataagaaaacagcttgaagaagtctgttccttcctttctccatgtgggtttcaaggatcaaagtcaggtcttaatacttttttttttttccattttttattaggtatttagctcatttacatttccattgctataccaaaagtcccccttacccacccaccccaactcccctacccacccactccccccctttggccctggcgttcccctgtaccggggcacacaaagtctgcgtgtccaatgggcctctctttccagtgatggctgactaggccatcttttgatacatatgcagctagagtcaagagctcagggtactggttagttcataatgttgcacctacagggttgcagatctctttagctccttgtatactttctctagctcctccattgggggccctgtgatccatccaatagttgactgtgagcatccacttctgtgtttgctaggccccggcatagtctcacaagagacagctacatctgggtcctttcaataaaatcttgctagtgtatgcaatggtgtcagcgtttggaagctgattatggggtggatccctggatatggcagtctctacatggtccatcctttcatctcagctccaaactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctaggtcttaatacttggtatcaggtgtcctcacccacttagccatctcaccagcttttatatggataattggataatgtcatgtactcctgtacatatagcatattttgttatctttattgttatctattgtttatacttctatttgtaactaatctatatttcatttacatgcttttcaatggctacagctcttcattttttatattagtatattattatgaatggtatgttgcacacatttatacttgatgaataaagctattagttaagtcacttgtttttcttgagagcgtcccacagttttgagaaaaactgttagtataggtaacttgaagaggtcaggggaaaactccatgttgaccgaatcctctgggactttattgccagtgaccacatatccttttgttttttcccacaaggacaaattaatctttcaacctaacctatacttttcttgcaaacgttgtcacccttgatgattttcttgccttccagactgcagtgtttaatccttgaggtatagagatcattgttgcacatggtatatggagtgcacattagttagccattattatagctcattaaaactgaatggggtttggatgttttagccttgtcatttattaagcattttataggaaccaaattaagaagagcgatcaagcaaaagctaacatttcacttcatttttatgttgaatgacactggacatgtaggagttttataatgcttttaacacaagtaaaaatcttagtcttatttaaagaaactactatggtgtgcattccttgcatagattatttataatctcttcatctgtattgaaaatgaattttatttatgctaaccagttagagaaatcattatttagcagctgagacatttatgtcttgttaaggctattagatcccaaggaatcttaagaatagatagctagcagtgactatctgaaagagaggaggaagacaactttaaccaaaacatttccacacgtaactttctgaggaggtttgggagaaccctaaagaagaacttgtttaacaacaccagaagtgaacatatttttgtaaagtatttgccctgaaaacaacagtaagccatactgcaatcactttcacatctagataagatactatttagaaagtaactgaatttgtacacccatcttgaatatttttcttcaactctcgcctcctttaatatatcccctttgaaatgtagctatctgaaagagagaacaaaccatattgagtagtgagaaaaattagtaaagtttatttggaagtcatagaggtacaaaattaacatttgttccataacaactattgaggtattttttccattaatatatttatttattcactttatattccaatcacagccacccctaccatccccccccccgacacacacacacagctcttctcccatcccttcttcccttctcctctgagaaggggaaggcatgccctggcacaacaaatcactgcaggaccagacttaccctttccacggaggccagaaaagacagcccagttagggaaacgggatacacagacatgcaaaataatcagttgttgggggacccacatgaagaccaagctgcacatttactacatatgttcaaggagcctaggtccagcccatgtatgctctttggttggtacttaagtctctgagactcctcaagtgtccaggttagttggctcttgttggtcttcttgtggaatccctatctcaatggggtattctaagggaaatgtcttcagaagagggaataggaggtaaccaaaactgttctgatttttccattcttcttctagtggctttgtacatgttacctcaaatccaatttatgaccgccacgcgtatacattcacaatataatccaaaaagatcacatgaaaaaatggcaaaagaagaaagcatggcaggaaatgttttgagcatttatgcatgtacagacctagaagcaaatgtggcgctggtggtgtgttttaaatgacttgttactttatacctgagaattcttttatatatatttctgtttacttataaatgacagtaaaccctagtgagttgttacacattctgcttttgacttttctgtctcttgtatttaatgtttagattgtcagaatggtgaagaacttgaaaggcagccccataacactgtcaataggtgatggtgccaatgatgtcagtatgattttggaatcccatgtgggaataggtgagaaatatttaatgtgatggcctctataaagtcttattagtagtattgctttgtaggttgaatcatgtttactctagattgttttcgttactaatctggattttgagtttggaaataattgttaatctaataaaagatttcatctaataaaaagcattccaagatcctactaatagtgtagttagagggtatttttatatttgccagacaaagtgagtttttcctttttctttattcttttgttttgttttttgttttgattttttatgtttttttgagacagaatttctctgtgtagctgtggtggttgtggaactctctgtgtaggccagtctggcctcaaactcagagatatacctgcctctgcctcccaagagctgagattaaaggcatgtgcctgaccaccacccaattacaaagtggctttttcaaacgtactagagccacaattaattgtgtagatcttattttgacagcgtgaatgatattttattaaatttttacacttctagccaagctgtctactctcttacagctctctttcttttgagagtattaactgttagaggttaaaagctgatcactaattggctccttttccacacagtggtatttatgaataccttaggctctggtgttgaagtcttatgttgatatacaccaacagtttttctcccaccttcatcaggttttcaccttcccaattgctattaagcattcaacctaacaccccaacaccattaggcaatggattgggagcacatagagaattaatgtcttggaaattgttagagtgacttttagcttcccagattacttctcccattcagaagtagaatgaatgagcatggaattccaagtttactcattgattacccaatatggaagtgacctgactcataaaacccatgtgtagctattcagcttcattcagggacagagagattcactgtcttctcattggtttcccagactgcaaacccagacttctgagttgccttaatatcacaatcggtttagtgttgtgcacaattaagcacatactgaaggccttaaataatattcaggtggctttttcccttccagataattttttttggtttgtacttgaaataatgactcttcttaattgttttatattattatattagcaaatagcttatcagttaaacagacttttatttgatgtgtcaatagccctgttaaagcacatttttatttttaaaaaaactaaaggtgcacacttgatttgtaacatttaagcaacttaaaaatataaaaacaaatcaggcatttggtcactgtaaaaaattgacactatatggagatattctctctttaggtattaaaggaaaagaaggccgtcaagcagccaggaatagtgattattctgttccaaagtttaagcatttaaagaaactgctattggttcatggacatctatactatgtgagaatagcacatcttgtacaatatttcttctacaaggtatgtggtcaaatatttataatttagctgttttgcaggggattatttttgaaacaggattttgctatgtaacccagatttgaatcaaacttcttttgtaactggggctggcacatgctcctctgccacagcctcccaggtgctagaattacagatgtgtaccacagtgctgaactgtgcagtttaatttctatgaatcaaaaccaaggtatttctgtggatataaaagacttgaagttattttgaagtcagcttttttaaagtataaatttaatattgtttaatcatgtataataatgttttatccattaagagtatatagatccaggccaaagagatattttgttcacctaagggtttatggaccttttttatccttttgaagaatcaaatgcttgtttcattgattctgatttttgtatatgtatttatcttttcatttcagatttttcttctattatttttcagatcgtaatatgattatatcatttctccctttcctttcctttctccaaactttgacacacacacacacacacacacacacacactttcattcctgactataacctgctcaatctggattatgttagttacataggtgttttcaaggctgaccattggtattagataaccaattagtgtgctcttccctaggaaagacaatttctcccactctcagcattttttcatcgcctagagttccttgtgtaggtttgaggctttgtggccttttgtccttgttcaactcatctttaggttgtcatattggtgagacgctataggtgtagcttctgataacactaaggggcacagtctctcaggggattcactgatcatctcactcttacaatctttctgctgcctcttcctcagtgctccctgggccttaggtgtggaagttgtattgtagctgtatctgttgggactggtcatccacaactctgcatttgattggctgtggatttctataatgtttgttatctttccatttctttatttatttctttatttttttttttttttttttttttttttttttagtttttcgagaaagggtttctctgtgtagccctggctgtcctggatctcactttgtagaccaggctggcctcaaactcagaaatccacctgcctctgcctcccaagtgcttcgattaaaggcatgcgccactagcgcccggcttatcttttcatttctaaaaatgtttccttgatgttaagcaagtgtttagaatgtagttagaatgctgatttagtaaattgatgcttgtctgttctcttccaagacctatgacttcgcgatctctcagtagttactacatttccagtaccaagcacaatgtccctcttgctaaacgggtcttaaagccagttagctgctagctactaacaaactctgtgccggtactgcacccttagtgttattatgcaattctggttctcaatatggtttatagacatcatagttgaatatcactgtaggttgtctccttcgattggaagcttgcatagtactttctgaatgctgtttctaagggtagaggcattcaggtcagttacagctcaggagcccccaggtcctttgtctaagtacaaggtatcttcagcaataggaatttaaaccttccacctcctgggggcaaccaaggacaatagcaatagactgtacgtttttggattctcttggacattgctgaccaacaactcaaaagggaccttctcatgcctattattggtggtttttattaggtggcctttggctcttggagctttgtcagcccagataagaaaatttcatttcaactatatatatttcatttatacacagacttacaattttttataggcttggttttaggtatgattagatagttaacagtatgattctttatgacattttccaaatattcttactataacttcacctgtctccttttttctcctgtatatatcttcccctttatccaaattagagccccacatttttctcatttccccaatcagatgacttgtacttgtattcccctttctgtggctctctaaaccccctacaccagcagtggtccctcattacttttgtggtttctacagttaatccaagatagatactcactttggtaatttggagctaagaacctcctataagagggaaaaaatagtgacaattgtctttatgggtctgggttacctcacctcaatatgatgtttttctagttccatttacctgcaaaattaatgatttgatttgattttttacagccaaatagtattccacagtagaagtgtacccacattttcattatccattcggtggttgcgggacatttaggttaggttcctagctattgtgaataaagcagcaataaaaatagctgagcaaatatctgtgaagtaggacataagccaaggaatgggacagctgggtcatttggtcgatttagtgttaggattttactccacactgacttcacaatggctttaccggtgctgagggttaccaaaaatatggagcactttacaaatttggatgtcatccttgtgtagagtccatgctaattttctctgtagacttccaattttaatatatgtgttgcaaaaatgaccactgtttatttcttgagaaaatttctcactctgtaggaatttactatgcagaccaagctagccttgggctcacagagattactggttttgattcacaagtaatagaattaagtgttagctaccacacctgtccatttcaataacttgtaactttaattctttttgtgtatgtctttggaatttagattgtacttacttttccaaggccctaaggtacattcttagttatttagagagctcagatttttccctcttttggcaacatctcgtgtatctcagacttgccttgaacttaatatgtacctgaggatgaccttcaacttaggattttttggtctctaattctcgggtactaagatttctggtgtctgcttttatgcacacaccagaatgtacagaatgtatttatgtggtgttggtgaatgaacacagggctttacatgcgctgaacatgcaccccagcccagtctgatgtttttaatgcagattcttacaggtttaaatttcactctcaggactacttagaccttgggttttggtatgttgtattttcattttcattcagttctggttttgtttttaactccctccttgatttcagtgtcccattcatcatcctttagaagcttttgtttggtttggttttatgttttggtttgttcttttagtttgtttttgtttttttatatttttttgttgctgctgttgctggtgctactactactactactactaataataataataataataataataataataatactgttgttggaacagggtctcaccatgtaattctggctgacatacatttgtgatattttctgctatcgttttgttgaaattgctttctgtttctttaacacagagttcttgacccatatctcatagttttggtctttccgtgtgtctttcagttttactcctgtgaatagacaccatgaccaaggcgagtcttataagaaacatttatttgtggctaccttacaggttcagaagttcaatccattatcatcaaggtgggagggagcatgacagcatccaggcaggcatggctcagaaggaactgagagttctacatcttcttctgaaggctgctagcagaatattagcttccaggcaactaggctaaggaccttaaagcccacatccactgtgacacacctactcccaacaggaccacacctgatagtgccaatattagtgacatgtgcaaaccaccacaccatggatctcaaatgttctgattgtaacttattagtttttaccttcatcaaaattacatttagagaatgtgtgtgtggcagcatgtgtccttactcactgagccatctctctgtctttatattagcttacctttgtcattcattgtcttatgttcctctgccttgtctttaagccctttgatccattctttttttaaaaaaaaatttatttatttattatatgtaagcacactgtagctgtcttcagacactccagaagagggcatcagatcctgttacagatggttgtgagccaccatgtggttgctgggatttgaacttaggacctttgaaagagcagtcggcgctcctaaccgctgagccatctcaccagccccccaccccccctttgatccattctattggtaaagctttttaaggagcttatcatttgacttactgaaaatttgtttccagtatttctatttattttctattttagtatttccaactctgctgaattctgttttcatatcccctgtttgcttatttcatttagctgtttgtcttaccttaggtattccgctttggaaacttgtctgtgtttacactgtctctgaccaggttttcacctagctgagcactaagaggttttgctgcaatgtttcttcaccatagtgtagaggtattctgctggccaggttctgcctgtagttcactttgagtttccagagaatacagaccaacattggagcccctggagccatcaactcagcaggggtcttttgaaatggtattctagaactgttccagttcagttcagccaaggaaaaggtgtttctcagaaaatcttttctctgcagctgccatgcataacttttacctcctttcttccttttccctttgtcttttactgggagtattatgctgattttggagggtctctcttttaagtattgtctcagtgatcactcacacagagaggagggagttccccagattatgctggtccttcaggtcagatttagtattttttctgttctgctgttcaagctttcctattttactttggattagactagagattttgtggctctcgcccttctaattgctgttatctagccttccttaggttattccctacatagtctatcagaccaagcctatatgatgtccaccatcttatctagcatctcctatttcatttcttcattcattctctcatctatgacccatcaaatgagtgatcatcagtgatcattcttgctacacagcaccagatgcccaggctcctatatatgcaattgttaaataaaaataaattaaagtgagccagttagagtagtacatacctttaatctcagcacttaggaagtaaaatcaagaggatcaattgcttatgagtttgaggccaacctgacttgcatgagtttgaaaacagcccgtgtgtgtgtgtgtgtgtgtgtgtgtgtgtgtgtgtgtgtgtatcctaagtttccagatttgcctgccaccctgtattaactgatttgggggctaaacattgagcaaggaagattacaatttagatgatgataatgaacccagtgtgtgtaaaacagattgttgtttaacagaagcattttattaattaattaatcctgacaagtctcttatgagttgtagtatctgtttttaaatatataaaaaatagacctcactctacccttagtctgtcccttctctccccgcttccctcccccctctctccacattcctgacttccctctactctcgcctgcccctctctgcctttctctattctctcctcaactcctttccccataccctaaataaactctattctatactttaaaaacacagacctcaggaaaatgctataactggtcttggttctacagctaggaagtatgagaaccttatgtccacagtaggttcaatctaggaatctcctccagagttaggttctgttgggcttggcatcactgattatttcttttgacctttccctaataggagggccccatgaagatttgtcatgtaaatttgtttggtaacctgacttttcccaaaaagcttgatttgcctccagatgcactttggcctgtaattcaagcgtgtaccacctgatggaatgaatgctctgttaaaagaacaaagcaagctttaacttaccaagtgttaaccaatggttagaaactgttatgacctcattcacaacacaggacattagagattatttctgtagatgacatcttctgtgtctgttatcatctatattactgactcagccctatttcttttatacagctgtcttttgtccagaaagaaattctaatcttgtaacgctctttggcttagcattaaaaatatatccccccttcttttttaagatatatagtcagtaatatatgtgtgtgggtatgtgcatgtgattggaggtgctcaaaggcaccatatgaccctggagctggagttaaaggcattgtaaattgcccatctggatgatgggaaggaaactcccaaaccattttcaaaacgtttccccattactggagtactttaattacaagtctgtgtttgtttctgctttcaatcttactcatataatccaaccagggtaccttagaatattctactttccaacttatctcttagaaattttactctctgttgtctgatcattattctgtcttttaaggtaatccctcactctgacactgtcttaccatacatggattttatgttgttttgttcgtgtgctggttttgctgttttaaatgtatacttgtgtttgaaacaggggttccctgtgtagaccagaatggcttcgaacttgccattgttctgcctctgcctcctgagcactaaagttatagctatgcagtattttgcctggctttaccatatatgtttaaaatgaatgctactttgtcttgattctgctatcccatccatccttaagaccatgatcatcccagaatgcaggatggttcaacatacaaaaacctgtcagtgtaatccaccatataatcaaactgaaagaaaaaaactacatgatcatcttattagatgctgaaaaagcctttgacaaaatccaacaccgttcatgataaaaaagtcctcaagaatttagggatacaaggaacattcctttacagcaagcctataaccaacatcagatttaatggagagaaactcaaagcaattccactaaaattgggaacaggaaaaggttgtccattctttccatatctattcaatatagtatttgaagctttagcagaagcaatatacaattgatagagatcaacaggatgcaaattggaaaggaaaaaggcaaaggatggtcattcacagatatatacatatatgtgtgtgtgtgtgtgtatgtatgtatataaatgacccccaaaattctaccaggcaactcctacaacttagaaacaccttcagtaaagtatctgaaaagattaactcaagaaaatcagtagccctcctgtatacaaatgacaaataggctgaggaagaaatcagggaaacagtaccttagcctcagataacaatttttggagtaactctaatggagcaagattagacttataacttcagcctggcggtggaggtacacctttaatcccagtactcaggaggcaaaggcaggtggatctctctacatttccagccaacctggtctacagagctagttctaggatagccagggatatacagagaaaccaagtcttgaccctcaaaaacaaacatccttcaagttattgaagaaagaaattgaagaagatagaagatggagaaatctcccatgcaaaaggttagggaacggttaacatagtaaaaagagctaacctaccagaagcaatctacagattccatgcagttgtcatcaaaatcttcatagatcttggaatgataatctttagcatcatacggaatcaaaaaaaaaaaaaacaccccaactccctaaaataatcctgaataataaaagacctgctggatatatcactatccccggctttaaattgtgctacaaagctatttttttaagtcagcaaaataattcataatagttaaatatctcttaaagatacatggaatcttctgaagctaaaagtaatatgcactcaaccagttttttaattttatttggaatattaaacatgatagaaatagaaatagaaaatctcttatgaagtcctctatgagaggaaattgtgactagttcctgattagacagaaactgtcccatcttcaagggagaatacacagcataactgtggcttcatagaatgagttgggtagtgttccttctgtttctattttgtggaatagtttaaagagtgttggtattaggtcttctatgcagatgtgatagaattctgcactaaacccatctggtcctgggcttttttttgaggggggggggcaagacttttaatgactgcttctatttttttagtggctttgggactgtttatatggtttatctgatcctgatttaactttggtactgggtatctgtctagaaaactgtccatttcatacaaattttccagttttgttgagtataggcttttgtagtaggatatgatgattttttgaatttccttggtttctgttgttatgactcccttttgatttctgattttgttaatttgaatattgtctctgtgacctctgatgagtctcgataagggtctatctatcttgttgattttctcaaagaaccagcttctggtttggttgattctttgtatagttctttttgtttccagttggttgatttcatccctgagtttgattatttcctgccatctactcctcttgggtgtatttgcttctttttgtcctagagctttcaggtgtactgttaagctgctagtgaatgctctctccagtttctttttggaggcatccagagctgtgagttttcctcttagcactgctttcattgtgtccctaagtttgggtgtgttttgccttcattaaattctaaagtctttaatttctttatttcttccttgaccaagttatcattgagtagggagttgtttagcttccatgtgtatgtgggctttctgttgtttttgctgttactgttgccttaggtcatggtgatctgataggatgcatgggattatttcaatcttctggtatctgttgagagttgttttgtgacaattgtatggtcagatttggagaaggtaccaagaagtgctgagaagaaggtgtattcttttgttttagggtgcaatgttctgtagatatctgttaaacccaattggtccataacctttattattttcaatgtgtctgtttagtttgtatttccatgacctatccattgataagagtggggtgttaaagtctcccactactgttgtgtgcagtgcaatatgtgctttgagctttagtaaagtttcttttttgaatgtggttacccttacatttggagcatagatattcagaattgagagtttgtggtagatttttcctttgatgagtatcaagtgtccttccttatccttttccacaacttttggttgaaaggtgatttttattcaatattacaatggctactccagcttgtttcttgggaccatttgtttggaaaattgttttccatccctttactctaaggtaatgtctgtctttaacactgtggtgcgtttcctgtatgtagcaaaatgctcgctcctgtttacatattcagtctgtcagtctatgtctttttattgggaaattgagtccattgatactatgagatattaaggaaaagtgattgttgcttcctgttatttttgatgttacttttatgattgtgtggctatcttcttttgggtttgttggaagattatgttcttactttttctagggtgtagtttccctccatgtgttggagttttccatctattatcctttgtagggctggatttgtgaagagatattgtgtgaaaatttggttttgtcgtggaatatcttggtttttctattctatggtaactgagttttactgggtataatagcctgggctggcatttgtgttcttttagggtctgtataacatctgtccaggatcttctagctttcatagtctctggtgagaagtctggtgtaattctaataggcctgcctttatattttacttgacctttttcccttactgcttttaatattctatctttgttttgtgcatttggtgttttgacaattatgtaacaggaagaatttcttttctggtccagtctattaggagttctgtaggctttttttatgtttatgggcatctctttctttaggttagggaagttttcttctataattttgttgaagatatttactggccctttaagttggaaatctttactcccttctattacctaatatccttaggtttggtcttctcattgtgtcctggatttcctggatgttttgggttaggagcttcttgcattttgcattttctttgactgttatgtcaatgttttctatagtatcttctgcacctgaggttctctcttctatctcttcttttctgttgatgatgcttgcgtctatgactctggatctctttcctaggttttctgtctccagggttgcctccctttgtgatttctttattgtttttatttccattttagatccgggatggtcctgttcaattccttcacctctttggttatgttttcctgtaattctttaagggatttttgtttttcatcttgaagatctacctgtttacctgtgttctcctgtatttctttatggaagttatttatgtccttcttaaagtcctttatcatcatcatgagatgtgattttaaatcagagtcttgcttttctggtgtgttggggtatccagggcttgctgaggtgggggaactcggttctgatgatgccaagtagccttggtttctgttgcttatgttcttgacctttcctctcgccatctggttatctgtggtgttaactggtcttgctgtctctgactgtggcttgtccctcctacaagcttgtgtgtcagtactcctgggagaccatttctctcctggaggaatttggttatggagagctatggcacagggtcagctcagaggtgcagacagaaactggaaggatccttcctgtctttagctattccttgattcctgtttcctgatagctctgggtgggtccctcttgggccaggattttgaacagaattggttgtcttacagatgtgtcagcactccttgtacaccagctctctccagaaggtatttcggtgtggagcactatagtatgtataggatcagctccacacgcagatggaaactggaaggatcctgtcccagggtgctcctcagctcctgtgccctgagggctccaggcggatccctctgagcagaagttgtggtcttacttgtgctcacaggcttgtcagcactcctgggagatctgctctctccgggcagtatttggatatggagcactgtggcacaggatcagctcgggatgcagatggaaaccggaagtgctacagagctattgtaataacagcatggtattagcaccagaggaaaaaaaatacatgttgttcaaattgaattgaaggcccagacataaatctgtctatatatggacaccttattttttttaaaagaaggtagaaatacatactggaaaaaaatacagtatctttaacaaattttgtggttcaactgaacatctgcatgtagaagaatccaaatagatccatatttatcaccatgcacaaaattcaactccaactcaaagacctcaacataaaactgaatacactgaacctgatagacagaaagtgggaaatcgccttgatcccattggcataggaaaatactttctgaacagaacagtcactaagatcaaaatacacactttgggtattatataagtctattgtgattgtataaatccaattgatatttaagggataatacagtaggtgttgtatcatgccaaatgaacttatttctttcctgtaacaagaatatagcaagccagccctggtgtcttgtgattgcaattccagcacttggaaggctgaaacacaaatttgagaccagataagagtatatagcaaattccagactacgttggattatagtgtgaggacttgtctccaaaagaaaggaaaaaaatcaataatagcaagaggttctcatatgtgagatcctcttttacttaggtaagggcaaaagttactcttcttagtgtgaattactcatttgaaactcatttctttacatctttgcaatagagagttattgcattcgaacattagaaggatttaagaatgactgtgtacacacccgtttaagttaattaagtaaaaatactaacttttgtcttattattttccagaacctttgtttcattttgccacaatttttgtaccagttcttctgtggattctcacaacaggtatgtgccattcttagcagaaatgtagagatacaagaagtataatgatggctggctcagaaatttggttagttcataagcactttaatgatgttgccaagctggtgtgactggagcatctatgaatgcattttcaaatttagagtcaagctttatcttgattctaaatgctagaaagtaatgtttttcttaggatattacaatattccaaacaaatgtcttatcactttaaaacttgcagtatagtgatgaagacgaggcagacacttaaacacgtgatgtggaatgctatattagtgctctgaaggaaaaaatataaagtttgtaaaaatataatctaataataaaatgatatactgtaacaaggtgagaggctactagtttaaaggagctatctagaacaatctcttaataagacaacattcagacagagaccggcgtaccctagggaagaaactaaacaaacatctttaaaatgttccaggtaaggagatggtcactgagtgggtgatataaactgtgttagtgctggcagcaacatgctgtattgtatgtttggagtacatatgtgtagtctttttcaattcatagcctcattagttactttctggaattcaaagtagactaggaaaatgtagaaattgaatctatttaaaacaaacaaaaaaagccctcgttttctttagtaaagctaggatattacttctttgttttttccatgaaaagaatatatttgtaatacctttaacaagatgactgtattatcaaataaaccttgtttgtagaccattctgtctcctcaaattatgcatttgaaaattgcaattaactctcacgtaaccttaaacttccatcctgaatcaaaagtagattgatgcttcttttgtttgaagcaaatataagactatattacacaccagccagtctgaggagttgctgttttaatttactcattagggaaaatagatagtttcaaaagcaaatttagtagtgtatatcatgaactagtactttcatttgaaaattagaaatatagcatattttatgctttttaatttactgcaatattttttgctgatcttaaatctttatatgtgaaagttgtctccatattctatgcagagccatccttttaatttcattgactatgctgaatatactatttctctcaccctttttgttgttggtggtggtggtgatgtttttgaaaccaaatagtgtcatgatcccttcctcttggtctactagctcgctttataaccccaactctacttactctttgtcttgaatttgaacaccttggtgaataaagggtaaatcatattagtcctcagtgcgtggcacttactatgctttctattaatggtttgatgtcaactagggaatgaactaaaaagttctgttcaagttgtttccaacgttttcacatgaactttcatgatacatggatgtgtacttcactggttaaaaatatgaagttgtattgattagtgtcacctttaaatgaattttattaatcagagaacacttacataaataaatgtaaaagtgtgtatgaagtatgcctttaattcagacaatacaaaatagttctatgatgatacgtagcagtgtatatctaatactaaactcaataaatacttgtacctgaatgaagttcataaaatatttaaaatttttttcaatagaagttttataggcatggtggttaaaagcacatattgctttagcagagaactgaatttggttactagcttccatgttggatagctcacaaccatctgttgtaactccagctccatgggttcttgcaccctcttctggcctccttggacacatatgttcacataaatttacccatacacagacctaaacatatacataacttttaatcctatagaatttttttgaaaagttttgtgtttcctgtatgacctttacaaataaggcatgacttctgagttcacttgtctagtatttactgaaagctttcaagattccctcctctgttttgggagctcaatactgtcaaaacactcaagacaaagatcaataaggcccatatttatagttgaccgagttaggtttattagtcattaggaagtgagtacacaaacaagaggaactgtcagaaaaggatgctacaatggctttctcttagtatttgagctttattacactatttgggattggaaaatactaactcaatatctataaagtaatatccagaaaaaatctgcaatatagattggctactccctatgatttagtttctctaaagagtcctggattgtacatatatggtcttttctaaaataactaaatatctacatttttagcaactgaaaaatcagttagtaggaaatattaagatcctgatcctattaaacggtcaggtatgttaattatgacaaagaatttttcagtattttttatctttggcaggtaaggtcacctaatttacaaagttttctttgttgccccaaaaagtatttaaaaaaaaaactatttagctagaagttttacaaatacataattatcttatagatgaatgacctcagtccattgttttcctgtttgtttgtctgtcttttcagccactctatgatgctgcttatcttacaatgtacaatatctgtttcacatccctgcccatcctggcttatagtctactggaacagcacatcaacattgatactctgaccgcagaccctcgattgtatatgtaagttggaaatatcatttatacaatttcccactctatagtccaagtttgtttggaacttgtggtgtggctcagactagcctaaaatttgtgaaatcctcttgtgttggtcttggtattaatggtgtctaactcactatgctgggcttttaagtagtgtgttttatttcatctacagataggaaggatacagaactgctcacgtagttcattaagtggttcagctaaaacagatcactcaacaagaaagtggtacatttcccgagataccagtcctggacttaatgcatatatttgtgatgtatggataggtcacaagttatttcatagtcttacacagagatgtaaaatataggctataacataactatgacccagcctaaagtgtaacttaccatcctaacattgtaagcagtgggtactcactttgatcaaacttgattttagcttgttcctagacaacagaatgttattagcttgacaactgtataaacatgggtctctaaagtgtcctattgaattttagccatgaacgttatatatttcacctttaggacttagtgactcagacattttgaaagatattgatgtgaaacatttggctatttttatatccttaatagacatttgaaaactgaaataattcttttgtgcagagagcaggtagctaacttcttgacctttaaagaacatcctggtaacatctcctgcatatcatatggagttactcaagctgtgttgccaatcagcctttatccagatagtcattcttggtttttttccttatgctttctttcatgctaggtcgcatacctattttgatttctaacagcttcttcatctaagtgtggctaagaaatctagctggtaactcagtataccatgatacccttgccaatttttcccatagatttttgcaaggacaggaatcactttctactcttaacctccttgccctagtctaagtcagtgactagaaaagtcacattggcactaactccaggggtctttagagagatatttttcctgtttctgagaaacagccacatctttcttctcccacttttctttttatagacaacatcctttgaatttcagatttatacctataagataaaaggttgtatgatttgacagtattacccggtgacatttctatagtattatcagtaggtgtgctatttaagtgattagatactctttgacacatggtaagaggaattagaaatagaagcaaaaaaagatccatacacaaacctatctttgttcagatctgcttcattagaagtaacagccttatttcactttctaatgttgactgagaagaatgtgctagttttgaagtgttcattttactctgcctacctgccatttatcaggacatcactgtacagcttcgaacatgtgatttgacttggtggaaaactaagacctacttaaaaaatgttacacttccagtaagaaatttaaagaaatatatgagcagatacaattagaaaacttgctagcattgttaaaaatatgtatacatttgttgttgtgtttgttgtttgtctgtctgtttgttttgagacatgggcttactgtatagctctggctgtccaggaaatcactatggaccaggctgatcttgaagagcaacctgcttctgctgggattaaaggcatgtgccagtacacccagctaagagaacatatgtttgaagttaatttaatgcaggcctttatattagttttgtgtcttactgagtgaattcctatacttagaatcacttgaggaactttaaaatactctgatgtccaggttatatatcatagtaataaaatcagaatgtatatgtaaatcagggatcagtatttattaacttataatacttgttgtttgtgtactatggtattttagttcaatacatgcataatgataaagtcggggcagttaatattttcatcttctcacataccatcatttttctgtgctgatgaccttcaaagtcttctgcttatcttgaagtgtccagctattgtaaactgtggttaccttactgtagtataccacattagaactacatctgactctctaataagtagtaactctataaagatataactttggtccatctatccttttactaaaaaaaaaatctaattattagggtaggcccttcattataaaaaagtcaaataaatgcccacttttcttgtttccttacatatttaagacaatagcttacagagatttattaatttttccctccatttcttaataggaaaattaccggtaatgctatgttacagttggggcccttcttacattggacatttctggctgcatttgaagggacagtattcttctttgggacttatttcctttttcagacttcatccttagaagacaatggaaaggtaaaatgaacatgcatttttccatgggcatggcatttatcacatgcatattcttgtggtattaatttttcagtattcattttggaaacttttttaacagttctttaacataaagaagttaatgacataagaaattccttttgtatgtgtatgtaagaagagaacttaagcaaaacctttgaaatcttaatttctctgtagtttttaggaagtgaagagagttcttgatactttagattttatccctgtgtgttgtgacatttaaaaaaaaaaagtcttttttccatgttactgcatagtctgaccatctgcatttctaattcatagttagtagatttctgtgtttggagttgaagcaggcagctaccgtgtctgtgtagtgttagaccagtatgtaaagagagaaatcttttctctcctccctgcttttcaaagtgggagtacagtgatgtttgtttgtttgtttgtttgtttgtttgtttgtttgtttgaagagttctgttggtgctgctcctaccttctgagaaaatggcaatagcagtgagaagctgcattgggacaattttgtcctactcatacaataggagaaaattactgcagcaagggaggaggcctgaaccttctgacttgcatgttgtttttattatgttctcctttgccatgtttggtactcttcttttatggtcattcttactaatcataaatatgaagcaaaactatgtttcaaaagtaatttattacatataatctgtctgaacctacataactaacatctcttacaaaaatgtatgcttaatgtatttgaatgatactttgaaattagctgttacaatcaggcccctctaagttagtttagtatgaatcccaattattagtcatagtataatgattaggaaaatattaattacccttagaatacatataccaagcacttgccacagatggtcctgcaaaatcccgggtatcgttggaaaactcacattagctttccaagtcagcttttgtggtctagtaattagaaattcagttttgtgatttctcagatccttcacctatgagtaattctgtgactttggctttttatttttgacacaaaaaatgtatagagctggctactgctgaaaactcctttgcttcagatttattttatgttcacattcattgacttagctaacgtaccaggttgaatcagtggcccagccttttctgtttccttttgtattttgactttatgaagtccaaattaagattttattgtatatgtcaccatcctttttaaatgttttctaaaattacataagtgtaagaattatcagcagctaaacccatgtatgatttggtcaaatccttttttcttctattaaccttattttgtttttattttgtaaaaacgttttacatctcattttctgtttcaatgttctgcattcagatcttgacagcgtttggtaagcatatgtgccattcattgccatcctttggatttataagtggtactgcttctctggtgtgcacatgctaacagagtgtttatagtcataaattagactccctttagaagtgtgagtcctttcgtgcttatgtgagaactctccttatattctaggacaaaaacatcaaactcattagtggcatgagttattattttgatgaatggtgcttctaggggaatagtattctttttcttccacctttatcaaaccagtgagctcactgtttgatgctgtatggtaataaatatagtcaccagtgtgtatctattcatgaaagtctagtgttgcatcttaatcttagtgaccagctattttcccaagtaattcataaaaagattgctgtcaatttccttcaggattaaacttgactttttatttcttcagcagacttgtgtattcatgatacatataattgttaaatgtttttcagatttatggaaattggacatttggaaccattgtttttacagtcttagtattcaccgtaactctgaaggttagatttttattcattcaaatatattttgtttaactttatcgcttaatctttgtattactatttgtcatccaccccttgtctgaatgcttactaaaaagtgtgtaatgataagggttttagcatttgtatactatttgtcactttgtctagtacatattctatgctattttgttttattattaagaaattcagacaccacacttacattggaaatctattccttcttaatcactgccattgttttgttttattattgaaaagaaatttagtatattctgatcatgctttcaccttcccaaatttctcccagatcctccttatcccctaagtccatgttttctccctccctccccttctctctctgtccctccctccttctctccttcttacactatgtccttccctctctccctgcctctcttcctttctgtcttcctctgtctttctcactctgtcccccccccaaaaaaaaaagaaagaaagaaaaggaaagaaacaaataaacaaacaaaacaaaaccataacgcaaagtacttggaaaccagaagcaggaatgggcatggattcccaactgctaacctaaaggccatctgtaattgacacctgcctgcaaatgtcgtttttaaggcattacactaaattatataaacagggtgagagctcacgaatatatatttataatagttccatgttaagtacttatatctggggactgaagagatggctcagcatagcacttgcagatgattgggattctgttcctagcccgcatattgcaaggttcacaactggctgtaatatcagctgcagggaggccagcagcctctttgggtatctgcatacatttgcacatacatataaaaattaataaatttatatctgaatttcttttatgtttaaaacaatagacagtcactgcttttgtcctttttgttgcagcttttacttcccaatgagaaaggtcctaaagcaagtgatataaatgtttatttgtgtgtgtgtgaatgctttgcttgcatgtgtatctgaacaccatatgcataaaatgcccactgaggccagaagaaaatgatggatctcctggtactagagttagagacatctctgagctgctatgtgggagataggatataaacctgggtcctttagaagaccagccggtgctcttaaacctctgtgccatctttctagccactttatcactttttatttttttaaaaaaattggatctttaagaggcccattggtcatgcaaactttatatgccccagtacaggggaacgccagggccaagaagtgggagtggggggggggggggtaggggggtggggggagggtatgggggacttttgggataacattggaaatgtaaatgaagaaaatacctaataaaaaatattttaaaagaaaaaattggatctttaaaaaaaatggaatctctataaggatcagtgggtgactttccaggacttttagtgatgaagaccttgaaataaatgtctgtatacaagacatggatgcaaaagaacttggtggtaatgtaattctgtaaattctattaattactaaaatatagcaatatgttagttaaggaagtatgtaatgatatatgacagcgatagacatgattatctttgtaatccctgtatttagaattcaagaccagtgtgtcttacatatatgatgtataaagatagttgcctctacttgtagtgactctcagctgttggtgcttttataacttgtatgtactcctcttgctactcttaccctctcctgctttttggcatacttgcctcaaggagacactttatcttctcctttattagtatatccctggccactactccctgaagacttgggactttggcctcctagttattactattgcttcacacgtcacctgtcattcaacactgagaaatctgtagccctccacctacaaatgggttgacttcactacacttccatgccttgctatagaatttagaaacctcagggcagcactcaacattcttactttagtactttaaaaagactagtttctgctcttttagttacacccccttctaaagtaatggctaaatatgaatcctcccataggtattgtatctgtataaattgtcagatatcataatatattacctggcatatttttgtgatatatagatatatgtttgcattgtatcttttcagctcgccttggatacccggttctggacatggataaatcattttgtgatttggggttctctagccttttatgtttttttctcattcttctggggaggaattatttggtaagcagctgtacctgtgtgagcaatattaactttatatgtaacttttaaagttttgattatatgtgatatataatattactaatctataaatgttaatggattagaggttacttatgccttataatattgctagctctaggtaaaacttcaaatatgaatttcttagtccatttattcaaaagacctggctttgcatagatagcctctgcccaaatatttacatttgtaggcatataggcagctctttcaaacacaacaataaatacccagaccttccatgtgatttccaatagaaaggctcaccttgtaaagtttctaccttataactttgaccaaacatatatcagtgtccatttatacctgtggttcacagcctggggatcatggcccctttgaaggtcatatatcagacatttacattatgattcataataaaataaaataataaaatagcaaataaaataatcttatgattgggtgtaatcataacatgacgaactatattaaagggctgcagcattaggaaggttgagaactactggcagaccctaatgccacataaatggtatcattttccttcagtaggaaaggcaggatcatcataatttcaaggtcatcttaagctacatagtgagcttgatgccagccatacagagacccagtatcatccttcatacctcctaaaaggggaaagagtttttcttttgaaaaactatttaagggggctggagagatggctcagtggttaagagcactgactcctctttcagaggtcctgagttcaaatcccagaaaccacatggtggcttacaaccatctgtgatgagatttgacgccctcttctggtgtgtctgaagacagctacagtgtacttacatataacaataaataaatcttttttaaaaagaaaaaaagctatttaagataaagtccttaagaaaatctactttaagaatataacacctaatcttttagagatgctattatacaactaaaccaaaatgtattaactaaatacaatataaagttgtttgtttacccagaattctgtgactctgtaatcaacatatgaaagttagacaaattttctcaataataaaatatttctagaccctaaacggttttgaacccttcctacagacttttcctcattgattaagtcatttaaaggaaaagttgttttgtttttttgaatctaagtgctccgtctgaacgtacacctgcatgcaagaagagggcatcagatccctttataggctgtgagccaccatgtggttgctgggaattaaacttatgaactctggaagagcagccagttctcttaaccactgagccatctctccagcccctaaataaatgaaaggatttttgtcatacctatttgcatttagtagtaatacctactgtaaatgaagtacaatagccttatttatggtttgatttgagggtttcaatttttctcaatgaaccatagactaataaatacatgaaaaactagaaataaggaatgcataaattttaaattgcagttttctttagtgtgataaaattgcatgccacccatctctgtcctgttagagacatgaaacatccctttgacccgtgtttacttctatttgggatattctggagaaaattattttaacatgtgtgaggaagattccttttaaatgcaaaagacagtttgagttaaatttctgttttacctgccaggaactgatttgattttacattctgtgttttctttccattccaggccttttctgaaacaacagagaatgtattttgtgtttgctcaaatgctctgttctgtatccacatggttggctataatccttttaatatttatcagccttttccctgagattctcctaatagttgtaaagaatgttcgaagaagaagtgccagggtaaggactaaatttatgttgtagcctaatatttggaagaggcttcactgtctaccgtgaactgaaaatcttatatagagaattacattagttacagcatgttaaacccctccttgcaggttcatcacttaatttcctcttctgcataaaaagtatagtaaaaacttcgttatccaatgcaggtggtaagtagattccttaatagtgttctgtgtcatctttagcaatccatatggagtatctcatatgctccatatggaatttttaaaggaaaaaaaagactttattttgtatttatctcagatttttcacactaggaatttccacaccaacatttcaactttgaccttagaaatttccctgtggactgtttgcagatgttttgtcagttgatatcctgatttgcctcttccaaagctgtccccttcctgtgattatagtgctgcttaatctctgtgctgcttctagccctgtctcatagcaggatagttgaaccaaagagaactgcttggatgtacctttaacatccttactcttcgggacacacttgtaaacattgatgatagcttataagtgtgtttttatttttaactactaaattactgtgaagagaagttatctccctctgtcacatctgataccttttgaacatttcttttaaagcttttaaagtgaaagggttagaattgcctgaaaaatgaaaccactggcaaatttttaccagcagatgaattaagtaaatcatattgctgccaacagtcattcctcttgttaaaataaagtcctacttctgtcatactgatagccactaaatcttataacacctctaaggcagtattttagagaaatagtcaagtaagtcctgactgtctgatgtgtttaattaaatttatcaacccattgaaccacaaaagtagtatatcatggagatctttctgaatattgaattacagaacccagttgggtgacattatatagaaacaaagatatgaaattattatactagaagtcttcaaccaagttttaaagaactaaaaatacagctttagtggtagcactttaaaaacattcatgatacctttaatccttagtaatg

SEQ ID NO: 715 - DNA, 168842 bp, mus musculus
  misc_feature (5958)..(6057): n is a, c, g, or t
  misc_feature (35214)..(35313): n is a, c, g, or t
tcggccgggggcttagcggcaggacgagcgtgaggcgcggggtgccgaggcgggcgctgacggggagccaggctgagcagcggccggtccgccatccctcccccgcgcgccgggctcgctgcgaggcgggctgcggcgggagcgcggggcggtgctggggccagataaggggagcgacggggccgccgcccccgaggcgggcgggccggggctgggggcgggtcgcggggagggcggggcggggcggggcggcgagcgcgcgggcgggcgggcggttgggcggccgggggcgggggcgcgcagaggcgaggagggcaggcggcaggagggcaggcggcagcgggctggcgacagggcaggcgagctagctgtccgctttgcgccgcgggcccacgccgcagtgtgttttgtggacggcgccttcccagacagcccagcggagcccagcctggcaccccgcagcctcggacgcgatgttccgccggaccctcaaccgtttggtgagtacactggccgcggctccacgcgtaccccggtggcccgctcgctggccccccgccgctccttcgcagtctctgggcgaggggacgagcgggacgcgccagccccctcccccgcctctgcgttttagcggaaacccggcgccccgggtggcctgggtggggaggcaggtggggctctcgggcgtcccacccctgccccgggacatttcagctgaggttccccgaggctctgaggaactctgcctccagcctggggaatcgcctcggagtgacagacgcgcggaactcggggcggggggctccccggggcggggggctcagtttcccaattagtggaagatggcgttgaattatcggggaggaagctttcttttgtttcctctgccacgagcacgtggaggtaaacctagacctgtcactgtggcccaaaagaagagctagggggctgagagaagcggaggctaaaccagggctcagcctcgcccgggccatggccgatgaccagagactgggcaaactttgaggactcagcctccaagctcaccttgagggtgacagaaagagcgagggctgtgggcacgatgggctggggccagcagcgacggcgggagcctgttccagctttacagaccctggggctcaagcctcgcagagcagcaccctctgctccaggcttggaatccacccggcagctgaactcctccgaccaccttctccacgcctctaaagccccccagaaaagggaattgtatttctgtggggagtgtggcacgggattgggagggagcgatttctggctgctattgactttttggattaacctgtttactcagagggtatgttaagaactgagtaaagtagagcagtttacttaaaggatgtttgtagcaactcccctaatttccagaagaggtgtcagggaataggattttatttctgccacggatattaaagaaagccatcatcctaaaatttttatttttttccctgtagttaagggggagaatgcagaatgcttccccattccgtcttaggatagacttaaggacttgacaatttggtaactttgtggagtcatttctaattaaatcattgctgacatatttttcataggtcagaacaatttgctgtcatttcccaccccccatatctgaaactttcacaaatgtcccctgcttaatcacacttaaggcatccccttttaggatatcagtatactaatactttttaggttttgccagatgtctgtttcactcagaaacatgcaaagggaggtggaggtaattattacctgtggcactgagcaggaaacggtgtgtacatgcaggatctcaagagccatgggcagtggattgtgttggatgctttgctgaagcaagtgactaacatttgttctcacatttcgcctgagactgtaaaagagcattgtacctcctagttctgtttcacataggctctcgtgatttggaagtgttgttttggggcgataaaaagggaaaggcgacacgaaagctaattgtagtgctcagcaaaagggtagcctttccacatgacactcatatgttagacactagctgctctctgggtcatattaaattcataaagtaaagatgctgacatcccatttttgaagactttggacatttggaattaaacaaacggtgttgacccaaaagcacttcccatttggtgttcttttgctaagagtgctctgcattgtatctgtaaaaagtaagcagtgctggcccacaaagctagggcatgcagtagaatttgcagtggctgttgaggtgccagcctgctgatactctgcatctctcccaagatttctgcagagactcacttttgctcatgctaaagggagctttgacctcattgtttcaactaagatgtccagctgttcacattttactgcacaaccctgactgtgataagtcctaggaatttgttccactgtcataagctagaaggttcttaggagttttgtctgagccctaggcctagagaaaggaattaaactgcaaatcattgcactgaatataccattaaacactgtcaaagtctcactgctaaaaaatgacttgaaatttgggggctggggtgggaaaattttaaatccctcaaactctgctattgtcatctacagggagtacattcttttagtagtacacacatttaaataactagatcagtaaattaaagatttaactgaaatgttcagacttacacagcccagtagatgtagtccaagttctgtgttatccttaaaattgttttaatattttacagatagggctatgaattctttggaagtcaattctgctgtttatttggcagtcatgtgtatctgaaattgactttgactattatataaattatagtagtgttggttacagttgctggtcattgctggcatattgcaatgaggctatctttgagtcttaaacctggtataggaggtcagaatcttgcaggaatcacatcatcttctgaagagctcagttatgtgtgttgagtcatttttaaaatgtcatttctgtttccccctctttctgagctaaaagagatagtgattaattgtacttctaaagacacagccgtgacattacatctttgccgctaagaattgtcctttctgatgaattacaacttttaaaaaaattaaggcagtgtctcatatagtacaggtggtcttatactcagtgaccttgggttcctgatgcatgcttccaccttccaggggctgggttgtaggatttttggcagctgccagtgtctgtttccttttgacagccttttgtggggttttgtttattttaaagaattatttgtttttatgtataggagtacacggtagctgtcttcagacatacaagaagagggcatcatatcctgttatagatgattgtgagctaccatgtagttgctcggaattgaactcgggacctctgggagagcagtcagtgctcttaacaagagccatctctccagccccctgtttttggttcttgagacaggatctcctacatagatagttccagccactctgaaacttactctgtagaccaacttggctttgaattcacagagtaccatcagcttctgcctcgagtcctaggatcagaggcatgtgccacaaaagctagctacttatttctttttgtagatagtctagtctggctttgaactctctccatcccgatcccttagctaatgctgagattacagacaagtcccgctatgcctgggttttgacagtttgaggtagactatcaagggatttgatagtacagcgttttgggagttaggcctgtgtgtgggggtcttaggagcactatttgtttctagtcaacatttccatcaaaataacaaacgtgagagtagttttgcctgttcaattattttgcttcacaggtaaatttaattagaagtttgaactagttgaaatttaaacttccaggtcaggggcttgggtgtcttcctatcttttagtaacatttgtattgattataggaattttatagtcttgtattgagttttgtaatctataggcttaaaggcttattgacagtctgtcataaatttctcccctttagcttattaaattatttcttgctaaagattcacataaaattccccaataagtagattaggtgattttattgagtaggtgctgtcaatttaatttgttggaggggaatctgacagttacagatcattgataataaagcttaacagtattgtggaaagctcaaactgcattggttctacaaagaaaatgttttatcagagactgggcaaattaggctgtatcaagaagaatggacattttaaataaggctgaaatgcaaactgcaaattaacaaaataggtagctaatttattacttactttgagtacagagtaagggcgctgtaataaaacagcatagagagacaataaagtaattcaggtaactgcttttttgttccaggagcaaaaagggttttggcttccttgtgaaattataagggtaattacaggttctttttcttctgtttcatttacctataaacttgccctgacattagtgagtgtcagacataccggttttatgttactgggttttgaaatctgtatgtatgggttataatatttttgtattcgtatagctcttaacacagatctataaacaaagttggtaagttggtatctaccagatagttctgacacttgtgggtctgacagttgaactaacccctccctaaaagcaacctttttaccatattacattcattataattacagatgaatttgttggctttctgaactagcctttctccagtgggaaagaagccctatccctagggcatatgttctatgtgatagattttcccagatggagaagaatccccaatagagaaaggctggtttatactgaaagtaattagggggtagcttttaacaccatgcttggtacttagtagatggttaatgaataactgttgaaaatacagcttttaaatgtttcatatagatgataatctttacctatgaggagtgatttatagtaaactctgttattgtttggagtgattaaagatggggatttctagttcctgggggtggaggatttaccaagtggctgttatataagaattatagtatatacatcaaatgctgaagctatactgaccataatattctcttttgtaaggtggtttagtcattttatggtattgggagtatcattttactcaacaaatactaagcactaaaatactaccactgactggacactgtgatagataccggggaatatattgtgagcaatgcagacaagaggcctatcctgagatgttttattgtatttataactatagctatagaggcacaatgactgcacttgtatactttgtactatcccaaaagatttaatcctcatgaataaattaatgttatataattactattaatgctgtatacttgctgtttgtcttaataccaaaaatagattatatgatttattattttccagtggctttgatgtcagataaaaatttggttgcaacttgatactgttgatatgcttgggaagttgttcttttgaaagtaggtggtaggctgacccttttgcaaagtgagaagcctatttaggagtggtctactacaacttgggggaggtggggggagataaattagtaattgtcttttctcccctccaccctctgctaccctcctgtctttgaaagagtctcatcaggtaaccctggttagcctattcactatgtactcctaggctagtctcaaaacttctgaaatcttcactcctgggcctcctgagtgctgagcttacaggcctgaaccaacatgtctgacttgaaataactctttatacagatagaaacagatttttctcctgaagtatttctctttttttaagggttatttatttattatatgtaagtacgctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggttgtgagccaccatgtggttgctgggatttgaactcaggacctctggaagaggagtcagtgctttttttttttgtttgtttgtttgcttgttttttgttttttcgagacagggtttctctgtatagccctggctgtcctgggactcactttgtagaccaggctggcctcgaactcagaaatcggcctgcctctgcctcccaagtgctggcattaaaggggtgtgctaccacgcccggctaaggaggagtcagtactcttaaccgctgagccatctctcctgcccgaaatatttatttattgatttaaacagtccaaaactgagagtgagtgacatatttttttattgatttaaacagtccaaaactaagagtgtttcctaaatgccttcagtaagcatttctcatttgttgattttgtttgtgttattgctaattttcttccttcacttttaaatttattcttattttcagtgtatgaatgtctttgcctctatatagatactgagcctgaatcttctggaaaacctgtcacagtctttggggtgtgtgtagaaatttattcaaatgtttacgatggtaaaacaatcttatgtgtaaatcttctattccacagcttccatccaaatgcttgtagaaaagatagccgttaggcccatttccagatcaggtagtattctaaagctgagccatccctttaggcttctgtgctgcgctgcgctgcgctgttccaatccagtccggtctggagtggtctagtcctgttctgtcctttcctttcttccctctctttctttctattttgagagagggtcttaatatgtagccctgagtgagttggaaattataagtagaccaggctggcttttaaatcatacagagccacctgttttctgagtgctggcattaaaagtgtatgccagattatttttcagtattttctaaattttatttttatgggtatgggtatcttgcctgcgtctgtgtctgtgaaccatgtatgtgcctgctgtctgtggaagccagaaggggtattaaaccacctctctggggcagtatgaccagtggcccttggaagaagccctttgtctttatgatgtttaaagaattagcttggtttgccaattcaaatactgttttgttgagtggaaaaaagtcaaggctggttgcttatcaaccatggttgatcagttttttcaaagagggcagacatataagatgcaaaataaacacattttttttctgatgttgtttgagtttcctgtacatgagtagtgctttaaaacagataacttctgatgtctggaatccctgaaatgggatgctttctctggttggatgaaagagaattctgacttttccaaggtaacggggtgcttcacaagtttattgctctcttaagatttatttcctctcctgatgtaagtgaaggtcagcagtgatcataaagcaaatatattagtacagctgcagcatatgataatactactgcagattaatgatgaatgagtgttcagcactgcagatatggcacaggatgccttattcacactggcagacagcccctcaattactgcagtgtatggatggattgccagtttggctgtcttcttgattataaaagatgcagtttttgcatggtgttagaccaagaatatctggtttaggacgttgttttgtagttttaatgtataggctatcattgatatcatgccctatacttacaatggaatatgggagggttgaagatgtgtgcctggttcaagcaggtatcatttgtttcttaggccacattatcttgaggtattaatgtggcagtgtcttcctagtccagtcttcttcaccaatatattcttgaaaaaattcaaacagtgttcttgacaatgattttacactagcacaggtaaactatagataagatgttcagtaagtacttttgaattgctttgaactgacttagtaacaaaagctgtctagttatcagttgaaaaagcagccactaagaggcctctgtgttttagaataggctttttattttaataaaagcatatagcagaaaaaatatcctttttattggatagtatgtgtcttagtttgggtttctttgctgtgaagagatactgtgatcatggcaactcttataaaggcaaacatttaattaggtgctggcttacagtttcagaggttcagtccattatcatcatggctggaagcatgatagcatccagatacacatggtgctggagaaggagctgagagttctacattttgatctgaaggcagcaaggaggagactatctcttgcatgcagccaggaggagggactcatctgcactgggtagagcttgaggactaaagaagacctcaaaacttgcctacacagtggcacacttccttcaacaaggccacacctcctaatagtgcccatgggcccagcatattcaaaccaccacaatgctacaccattattttgaatgaggaaaaaaattatgcaccccagtaggtggccagaaaaagtttgccctttattgaaacttttttctattcgtcagaaggagaacctttaaaccattcccttttcttggtgtttcataaaactaattaatatactatcttcagcttttaaaattctaagtacatttggatgctttttttgttaagtacagttgataaaacattttctttttaaaaaaatttttactagatattttcttcatttacatttaaaatgctatccctaaagtcccccataccctcccccccactcccttacccacctactcccacttcttgtccctggcgttcccctgtactggggcatataaagattgcatgaccaaggggcatctcttcccagtgatggccgactaggccatcttctgctacatatgcagctagagacacgagctcttggggggtactggatagttcatattgttgttccacctatagggttgcagaccccttcagctcttgggtactttctctagctcctcttttgggggccctatgataacacattttctaattcaactaatacatcaaatctactttgaagactaaaactgcagtgttaactctagcagagctttgtgttacttttgtttgtttttgagatagagttgtctttatagttcagattgacctgtactcattctttagcccaagctggcctggaactctgaatcctcgtgctttagcttctcaagtgatgtgattatatgtatgtgctaccatgcccatctgctttatgtcattttactcactgtggtaagtgtaatttatttgaattcaggataatccttagaatttagtactaagaatataagaatgtataggccaggcatgggggtacatgccaacaaacccagtgataggaggataacaataccaacttcagacatacagagttctaggctatagcttaggccataggggactccatttcaaatatcccaaactaggagcatgggagagaggagatgcatattatgaaggatttgcaattgtttgtgaaataaatctcacctttgtttgaagggtgctatatggtattgacattgaaaaaaaattacttttccgaggtcaataagctagccagccttggagttgattgagtctgtatatgctactaatagaaatcataccttttcagtgcttccacaaccatgcttccccataatgagtcatttcttttcatattgctgaaagcattccctgtttgtcacttgcagaagagcaacctccggtagtaaattgatgcacccagtgggggagccaggaagtattgatgtttctgccaggttagcgtcaacacttgctggttttctctctggagtatcaccaagttcgtggattctgtttgtacttctataactgctcagatctccatgttccatatatttgtccatgttttccaacattcatttgcacctttctcacatctcatcctgtacatatcttagttcataggcagtaagtataaatatcctcttaggcagtataattccacatagcaagcacactaatgagtatttttattataatagccccatatataaataaacatacatacgtaacacatacatatatggagagaaagaaagtcttgggataataaatttagggcaatatttgtaactattcttttattttgggattagttttgagttgaataatcaaggaaatccccagaaatatatttctggttagtctcaagtttcatgctatttactggtgtaaaggaaaagtaacaattttgcagcaatcctgtagatcaccagggagtagaagccagtagggaattgtcacaaataaataacagctggctagaaaagattatataaggtatacctgttgtgtgagcagtgggcatgtcttttaagcttcacaattaatctgctttgtggcaatgtggattaagttgtttgtagtatagtgcacaatttaatttacttcagctcattttcctttcattttaaagaaaacaggctggggagatggctcaatggacaaaagcacttgattcagatcctcagaacccacaaaaccagctagaagtggtagttcaagagtttgtcatccattcaggtgtagtgtcacaaagctttgaattccagcacttaggaggcaggcagatctctgagttggaggccagcctggtctacaaaccaagttccaggatagccaggactatacagaggaatgttgtctcaaacaaagcaaaacaaacaaacattaagtccatattctcagtgtagcctttcctactgggagattagaggctgagaccagagaatttctagaagtctactcaccaaagctggagcccttgtattgaagtaacatttgaaggttgataccccactctctctttctctctcttcctccctccccccctcttacacacacacacacacacacacacacacacatgggtggggagggattgacctagcctttcaagtaactaggactatgccactgtgcctactagcttaaatttcttttctgacaatattttatgagtcataagcttttatttgaatattcatgtcctgttaagggctatagaggattatacggtacaagctctgttcttgagatagaagatatacatgtaagatcaatctttatatgaagtatctgattgatactgactagttgagtcagggatgcatgtagcccaggtagcccaggctgatctcaaactcccaaatctcctgccttcccccttctcagtgttgggaatcgtggacatgcatcgtcatgcctggctttggcctcttgagtagcatgtgaagtagacacttgcaaagagagaggcatcgactcttcttcactttagttgaccaatactaatcaatttctcgtagttctacccacatcacctaatcaatttccccaaagttcttcataatatcatgatgagagctagacttcagcatataaatttgggagggaagggtcaccaacatctagtccataacatagctggaagagttgttcagtgctttgtttcctatgataaaatttataatttataaaaggtaatgataaaactggatatcaaggtgctttaggtttctacaactgcacaaaatttcccataaactcgtttctgaaatccatgattccagggcattactctgctgatttggaacagtaaaatggggaccggaatgaaattaacatttgaggcaataaatcactacttcatacaaaactatgtggttggatacttcaatggcttaagtaatgggtagataccttcagaaacttcatatgtctagggtagtgatttatttattatcttgggtgttggtggccatatttattctatttatgtatgtatgtatttttgttttatgtgtatgtgtgtgtgtgcatgtgcgtgtgtgcatgtgccctgttcccttggagagcggaagaggggtggattccaggagttagagatggttatgagctaccatgtaggtgctggaaattgaaccccagtcctctggaatagtaacaggctctcttgattgctgagccatctctttagccctggtaatcattaattttaaaaaccgagagtcagagctttaagagtacattctttaacatttctatttcaagtccattaggcaacatggctatgaataggtattcagtattccaagagtagagcatgaattgtgatttttttttaatgaccgttgtatcactacacatgaccggtggctttttgtcaaaactggcattctagtccaagtcgtatttgacttttccatatttgttgatcttctagttttctatgatttaatagatagtactatttcctgttcagtggtactagcaataaatggagaagccatcttttatactcctgtttcttttccttttttctgtctgtgtgtgtgtgtgtgtatgaggagtgctactcatatgtgtacaggtgtatatgaagaccagaggccaatattggatgttattctatgtttttttagagtcaggttctctcactgggccctagggctcaccaagcacattaggctggtaggctgagtggctggctggctagtgagctccagggatccacctgcccccacttcctcagcaatgagattactagaatgtgctactgcacctggcttttcttttgggtgctgggaatcaaagtgaaactctagtgcttggatggcaagcactttcctggctgagttacctcttactctctccctcccttttcatcctttttcagttactcattctgtcagcaaatctaatagtttctatatctgaaggtacttttaatagctgcccatttcttttttcatgaccaatactattcatgtctaagttggtgctctcatttatctggaccactgcaatagatgatcttacccattctgtactcttcagttatcctctataaacaccagagggatattttacaaatagatacctcaaggtcttcagtgattttacactgcttcctggatttgctggaattgttctcactgttccttgcatttctcatttccttgtaaaaattgagatagagatataaaaattcagcatttggagtatacatttaagtcgtttttagtatagtcaatcacttagagttatagtatagtacaaccatctaattccagtacatttccaccatttcaaaactgaactctgattatcagccgttactcccaattctcttcccacacccacctctgctaatccccaatttacttttcctctaccatttttgccaaatccatacattcacataattgaaatgatataactgagttttgtgtcgatacttgtaatcctagcactcaacaggctgagacaataggttagcatgttggaacaagcctggcttctatagtgagaccccaatgtgtgctctgttgtaacctttttctttagtatatttcagtgttctattacagcatgtatcatatattggtactttattattttaaggctgaataatattccatcataagaatataccacattttatgtgtctgttcatcagctaatgggtatttaacttatttctactcaattcattgtatttatttgtatttgtgttggcatgttttcaattctgaggagtatataggaatgaaatttctaggtcatactataattctatgttttaattttttagcaactgccaaattgtttttctcacagttcaaataccttgggtctttttttttttttttttttttttttgagattacgtgtcactgtttttctagctggcttggaagtcaggggtggaaagttgacctcagagttgtggtgatttcttttcctctacccctaaaatgctaggattctaggtgtgtactacaattgtcttgcacttgttttatgttttaagatagcatcttacgtagttcatgttggccttgatcttgttgcttctacttcccaagaactcaaaaccacaatcagcttaaatgatgggatttttttgtttgtttgtttgttttgattttttgagacagggtttctctatatagccctggctgtcctggaactcactttgtagaccaggctggcctcgaactcagaaattcacctgcctctgcctcctgagtgctgggattaaaggtgtaggccatcattgcctggctatgatgtttatttttaatagcagttaacaacataaaacataaagtttactaacataactgttaagtgtagtattgactagtgcaacctcttagctcctcattttctcttcctttatggtttttattaacaaatcttgatataatggatgggcgttgagaaatgtgagatgcagagatatggaatttcaggctcagctctttcacctgtgtccctagttccctcatctgagactgataagagctccttggtgatttatatcttaaatcctttctcagctttataattctttgaatttgacagtctaggagcagattgtttttactggtttttgacttcttcacctgttcctgcttaaaatattcaaatcttgatttctctttgactatactctgcaccaaatttcagtttttccaccagaagtaatgagtttgaactttgaacgagaaatttgacaatttttagaaaatactgttcatgggcttttaataattatactttttcagttttacactggcctgaatgattggaatgcctttgctacttctgttgtattaaactcagccctattatattacttgcttggcaaatagtactaatgaaaaggactgttttgctgctacaatattgtgggcaggttttcaagagagcaagactactgaaattatttccaagagatactcatttctctgttcatggatagtcagctgcaaaatggtggttagagagaggcaactcttggattggcaagctgcataacaactgctaggtggttaagtacgtaacagtagatataagtaaacagtagaaagcaagtggattgttgataatatgtatgcacttgagaatcaataattcattggagaattgaactccatgattattgtggtgtaattcatacaaaatgatggccaccataagcaaaagtctcacttcatgaactagattctgtaaatacattctatttagaaagttgttgttgggcctggagagttaagagtgccgactgctcttccgaagatcctgagttcaaatcccagcaaccacatggcaactacatggtggctcacaaccatctgtcataagatctgacgctctcttctggtgcatctgaagtcagctacagtgtacttagctattataataataaacaaatctttaaaaaaaaaaagaaagttgttgttagggctggagagatggctcagcagggaagagtattggctactcttccagaggatccagattcatttcccagaatccatatagctcacaactgactgtaactctagttccaggggaatccagccccctcgaacagatatacatgcaggcaaaacaacaatacaacataaaataaaagtaaatgattgttttctaaaaagtcattgttatttgtgaaacgaggttatatgattgaccttgatgaaaaataactagaatagctgtaaaggagtgtaattaaatattcttgtataaatttagatgggttacttttcaaagatactaatgaggcagtgtaatcaaattaaaatcaaatgtaatcaaatcgaaagatataattgatttttagaatccatgtttggaattaataatttgagctaattatgaaattttcattgcattagcaagtgtctgtttggtttctaatatgtatctagtattacacaagttttttcaggtaagggacagggcatattttttaatgttacacaaactacccagtataaacctagagaaaaatcacttccatttgaaagatagagtctttaaggttttttaaacctttatttttaatttatgtttatgagtattttgcctgtatgtatgcctatgtatcacatttgtgcagttcccacagatgccagaagaggatgttggatcctctgggctggagttttagagttgccatgtgggtgctgggaattgaattggaatcctctggaagagcagccagtgctcttaactactgagccatttcttcagctttagatattatcttttaaaaactgtaatatttggcacatatagaagagataaaatgcataataattaatatttaagtgttaattgcctaacttaagtaattacagtgttatttacctataatgctactgtcacatcacatatctcactgctgtcagaaagctttcagattttgttttgccagacagggtctctccttagctccagctacatagaccaggctggccttaaactcagttatttgcctgcctctgcctcccaagtgctggaaataaaggtgcgcaccaccactgccagtgaagctttcagcttttaatccattctttacacacagctacttgttttaaggaaggtgtgctgatacacacccataatctcagtactcaggacgaagcaggagaaactgactttagtgttagcctggtcacatgctaaatttgaggtcattttgggctacatactgagatagcatctcaaaaaaaaaaaaaaaaaacacttaaacacatttatgtgcaagcttgcttaaaacattatttggcttcttatttagagctttatcaaaatgcctaatgtactttttaacttgtaatatatttttataagattttatttatatgtgtgtatgtgcattgtccatggaggtcaggagtgtattgggaccccttagagctggtatttacagatgtgtatgagcttcccgatgcggggatgcgggtgggcattggaatctgaactctttggtcctcacaattgagtaacagattctctttatgtcctgcacactctctcaagcccttaaaaagttctgtggggttttgtttgtttgtttaaaatataggtatagtttatttcttctatatgtacccaatttgggaagtgtactagttaacttctcttcttgctgcaagaaaacatctgacgaaagcaatttaaaagaagggttgattttggcttacagttctaggagatagtagtctatcttacttggatatgtccttcctcttcctcattttggttgtttttttttttaatatttaatcatttacttagtatgtgtagaggggagtacatgtgcatgtgagcacatgcttatctaggacagaggttagcactgggtatcttcagctggtttctatagtgtgtgtgtgtgtgtgtgtgtgtgtgtgtgtgtgtgtattcacattcatgaatgtgtgcctcctgagagcagtgccctccccagtccctccatattattttttaagataaggtttcactgaacttgggacttgttgatttggctagactagttggccagtgagcctcaaggatccttttgtttctgcttaccatgactttttacagtgtgttatagatcaaactagggtcctcatgcttgtgtgcccagtactctactgactgagccttctccccagactcttgcccatttttatttggtgaaccagtgttcttcaagatttttgttgttcttaagatcagcatttatgaacatcatgtttttagttgtgtgtatgtatatctgtaagatttatgcttatatacatgtacactcagacttacttgtaagaaatatcatacatcctagtaatgatgggtcttagactcataagaagctgttcagtagttatatcaatatgttatcacagtggctatgtatttcccatttcctcatagatttgtgggggtggtttgaaacagggtctatctacacagccctggctgttctggatggaactcactatgtagaccaagttggcctctaacttacataggttcacctgcttctgtttctcaagacagatagttttctgtgcatcatatgtgtactggtgcccacagcttgagaagagggcacccgattccctggaactggagttaaaggggtggttgggggtgctagtaatcaaacccaggtctcagtaagcacctttaaacacctgagccaactctccatcctcttgtttgtctttctgacaagatttcatatagtccatgctagtcttgaacttgctaatatagccaaatttggtcttggactcctgatcctcctgcctctatctacctcctgatatttttgggggattacaggcatgttccaccacacataactcattttgattgtttcctttgatgtattttttctgatactgatttatgagacattattatgttcaaaacattcctttttttgtttttatgttaccagtatcttatttaagtttgtagctttgtatatttccttaccctccctctctctttgcttttgttgatgctgaggcaaacacactctaccattgagctacacacattactagatcttactgttatttaaaaccttttcataagcaaatgtgttagttagttacttgttgctttgataaaattcctgacaaaatcatcttaaggagacatttgctttgacaaggaaagtcttagtgacagaactgtagagtagctggtcattgcattcacagtctggaatcaggaagttctggtctccctttttattcagtggagatagggggaagtctcatgaagttgtctgttttcagggtgggtcttccctgcttaatcatttctgaaaacactctcataagcacatttagagttgtagtttcatgatgattttaaatttagtcaagttgacagtgaagaataactatcacagcaagtttctgttttttctatttgtttattttgtgtgtgtgtgaatatgggtgaaggattgccatagcacaggtgtgcaggtcagaggacaacttctgggagacagttatttcaccctgtgagtctgaggctccgactctgatcctgaggtttgagagcaagtaccttttgagccatcttgccagtcacctacccctgttttaacttttattttttccttttttgtctctatggggggtgttgttttctggatgaggggttaaattgtcttgcttatgttacccaggctgatagcaaaccatgaatgatcctcctgccttagcctttctagtgctgtgattgcaggtatgtactactatgagtttcacgtgtttgtgtgtgttgaggggatatatgtaccaccactgcatgtgtgcattggccagaggtggtcttctttcttacactcctagaatgaatgctaggattataggtgtgtaacacaacattttcttatgtttattttattttaggtttttagatggtatttcgtgtacttcaggctagccttgaacccctgatcctattgtactaagtatctgttcttcttgaaccagagctaggctggctgccagcaggccctagcaatcctcctgtctccaccctaaacagtgattcagttacaggtgttcatcagtatacctagctttcttgtaggtgctttgaatttccactcacgtccttttgctagctgaccaagtacatgttcctgcctacttagccatctccccagcctgaatttctaatttctagagtgtttttctttccttattaaaacataatttatttatttgcttctttttttgagaactggtaatgaagaaatttatagtttcagtctcttctctaaccttggggggaaataagaaaaagctgtactgggtaggagcactaggcatactcatgtcaaccttgtaggatgaattgtatcttaacacaaatcacatttttatgaatctactatatagatgatttcttctgcataaacttgacttgtagtagatacttgctgagtatttgatatccatttactatcttgccccagtgtcaaaatcttgctgtgactttcttcctttttttttttgaaaatagcaaattatctctgtagtttattcccattgttaagatttgcagtgatgttgggctagtttaccaatactgtcataatactcgtgagggttccaacttcctggtttgaggaaggaggaagaatggggttcacataaataaaacaactgtccacacatttcagaacattttagatgaagtcagggagtccttgaatggtttgtttttgttctatagcacattcctatgtttttatataggctatctctcacagcctttagaaggatgtccatttttcccttggtgttactaggagtcccctctggcccagagaggcagcagctgaagattgggcttggtgggagaatctagagtgcctgttttgaggagacctctgaaaggtcttttctgctgaccatagcttctgaaaaggggagctgtagcatggtttcaggctcctccacaaggttactctatttctgtctgtgtgtgtgtgtgtctgcgtgtgtgtgtgcgcccattcatgttcatgcttgtgggtgcccacagagaccataagaaggcctttggttcccctggaactggagttctgggcagttatgggtgttgggaactaaattccaatcctctggaagaagagcaagtactgttaactgctgagccatctcttcagctccaggagtttctttatggttagtgctatatatagtttaagcagtctctttttctaccaacgttagtaagctggtatacatgtgtgtacatgagtgtggaggccagcagttggtgtcaatcctccctaccttattttctgagacattatctctcactgaacttggctagatttgcagtgggttccagggacttgcttttctctgttcctctagtgctgaggttacacacattggctgcttttacatcaatggtagagatctgaattcaggtccccatgcttgcatggcaagcacttttttgattgagacagctcccagtcccaattgatctttttttaaaaattgaagtttggcaaattattttatatttcattatgcattttgtctgtagtagtggatataacaacctacatgtgatataaagctgtattacatgtacaaacacacacaaatgaatagaaactgaaatctccattttcaggtctttaaaatgtgcagattcaatttacttcataataacccattactcagtggagattgtggaatttagagtatggtttgtttacacagatttcagtgttttaaattttatttcactgtagatatcagaggacaacttgctaaaattggttctccttgcagtatgtgggtccaggggttataactctgtcagttttgatggcaagtgacttaacccactgaccaatctccccagcgggggcttgtttgtttgtttatttttttcactatgaaaatgtatttattgaaataaatacaaacgggaattttaaccattccaccgctctttatttttatctatttttttaattaggtattttcttcatttatacttcaaatgctatcccaaaagtcccccagaccctcccctcccactactctccccacctactcccacttcttggccctggcgttcccccatactgaggcatataaagtttgcaagaccaaggggcctctcttcccaatgatggtcgactaggccatcttctgatacatatgcagctagagacacgagctctggggggtactggtcagttcatattgttgttccacctatagggttgcagtttcctttagctccttgggtattttctctagctcttccattgggggcactgtgatccatccaatagctgactgtgtttgctaggccctggcatagcctcacaagagacagctatatctgtattctttcctctgtagattccaatggagtgttgattttcttgctttcatttccattctcttcctttcttcttccggaaaataagtgactgaatcctggaacatcatcaagtctctaagttgaaatggtatttgaatgtaaatttatattgaggtaactacatatacataaaattataagcgagtatagagatgctatataacttttgtctagtttttctcagtagtagtttacaaaactggtataatgtcattctgacatttgtttcgtttatgtgtgtacttgtgcatgtaatgggcagttttatctcacatgtagcttgttgtgtccactactaaagacaaaatatagaaggaaacaccataatttataattgaaaatttacatcacttgccaaatgtggtggcatatgcctttaatcatagcactcaggcagaggtaggcagatctctgtaagtcctaggccagccaaacaacaagctccacgacagccaaagctacacagtgagacctcaaaaaaaaaaaaagccataatttaaatccatgtcaatttgtgcttccagactgttccagaatttccagtttggctgatgcccagttctaaaagatcatctcaaattacataatctacaagcaaagtgatgagagaaaactttgacattaaaaaaaaaaactagaggaacattattagtcctttgatgttgagggatgccgattgcctattaagtatattatacatgcccatatgatcctgtgtttgacatattagtgaaagctgtcaatataccagtaagaatcttgaaaaatctggtattggtggtatgtgctattaattccagcatccacggggcagaaaacagcaaacgaacaaaaagaatcacgaaaattcttattaccagataaaaaatagtagtggaatggaggaaataagtgtgctgagagtaaataggaacatgtgtgggggttttgtgtttgcacatacatgcggacaggcctgagtttgacataaggtgtgtttcttgattcttacctttgtatagtgaggcagtctctcacttgaatacatagcttgcttgtttagtttggttagctaaccagattgttagaatcccctatatctgcctccagtctcctggaattcctatgcccagccagcttttatgtaggttctacctttacacagatccctcagcttaaatgtcaagctcattgcctgcagagtcatctcccaagccccaaggatctaggttttggttttgcttgtttgttcagacagggtctcttaaaatagcccaggatgtcttgagactcactatgcagatcaggctggcattgaactcacagagacctgtttgcctttgtcccccaagtgctggggttaaaggtacgcactatctgcccagctctagggtatgtttgtgactggatgtgtaggaaaattgtaaggagatgtcattgaaattcataatacagtgaatgagataaactaatttaatgtagagtgtttcactatatagcccaggttggcctccaacttgtactccttctttctgtcttaggctctcacatgctggggttacatgtgtgtgctgtttcatctgtgtaccatttaggttttgtgaagtaagcttcttgaagtaatgaatatggtttgatgatgtggttataataaaaatgtatgtttaatcagttcacatgtttgtgaaatttcctaccatatgccatatattgtcttctacttgccagagatgctttggtgagcaaatcagacaagtttactcttggttaccttacattctaatttgagagacaataccaggttaaagggtaaactgaagtagcaaagaattataaaacagtggcctgaaaaaatgtgtttgtttgtctgttatgtaagttggcagtctccagactatgaggccatctggggttatttctgctttctttaccatttggttttcaagttctaggaagcaggatgaatgtctagggcaagcaaatatctctaggaaggtgattaggaagttccatattatcactttattgcacatataaccttaagtaaacatcttagctctataattcatcctagccataagggaaaccgactctctgggtctccctagatctatctgagaatcccaaattccagataaaagcaaaaacaaatttggaaggacaattaggaaacagggactcaggcagtaaacaatgtcatatgatatgaaagagatagtaatagcatgggaaaccgttaataatgaaatcctaaagggaaactaaaccagaatgaagacagaaatgcctggttggagttaatcatagtgtgacaaaagacctcttgagaaagtatcttttaagctgggtgtagtggcacctgcctttaatcctagctattggtaggatgaggcagaggaaactatgagtttaagccagtttgagtttcatagtgagtttctggctagcctgagccacagtgagaccctgttctttttttttttttaagtgttggttaaacagaattgtggactggtgagtaagcaactgttctggtttgttataccacaataaatgattagttttagcactccagaatcttccatctcatctgaaagggtttagttagtataaagccacaatcataccacaggttcactcacagcaagcagtacaaaaaggctttaaataatcaatggtatattggtgaattatactgtgaggatcaaggttgaagtatttatgtaagattttcaactgattaactccacctggtgctttaatagatgctaagattactcccctaaaaagtgagtaagattctggcctagcacaggatccagagggctgggtatatgttttcatgtaagtgtagaaattatttatgaccagaccttgctacagaattttcattgatgttggtctgtcattgtcagtgtacttttaagacttggtgacataaagcagtggaaatattttcatgcttgctcataattctacagcactctttcctactcaatagtccttccacatactagatagatagatagatagatagatagatagatagatagatagatagagaaggcagtatttttaaagcatttaagctttatctttattaattatatatgtatatatctatgtgtgttttggggaatgtgagcatgagagtacaggtgcttgaagagtctagaaaaggacattttgattccttggagctggagttacagagccagtttgagtgctggagactgagcacaggaccttggaagaatagtacacacacttaaactcttagccatctatctcttctgcccctacatttttctttaattgtatttgagcgttcctttaaatctgaatgtaaggaagaagcacttttctactagtttttttttttcttttttaaggacaaagcatttgtgtaatgggacataatttcctgcctgttcttttaaatggtgtttctagcttcaacacatctatgttgaagtacacagatttaggctttcttattttttcttaaaccgtaacttttcattagggatcataagagtttagagggagaagatatataggtgtgtaatgaaaatgcatgacagaaagtaataagtgctattagagagctaaaaataaggttcttcagagacagtggaatgagatgaattactgtcagtttttgcttccatggctatgaagagacaataggttaactttgagcttaaatataatgttctcaaaaagattttctacccttaaaaaggagagacatttgattcatcattctactgtcttaagtatttttataagcccagtcttttcctaggcacaaataaaatccatttttggcctcatgctattccatagggaaaaggtcagatcagtctagaataggctaataatcaactcagcattttatagtggcatggaagttaatctagaatcatttctcctctcatcttactctgtccacttctaaattctgctcataatctgtttcttaaaagcaactaaagcttaaaactcacattaagttattctaagaatatttactactatctttattcttactgtgtgcctacctgtgtgacatttgccttttctataccatattcatgccatcctactcttcgattggactcccctactgcattccattttcaccatacatgcaactgatatggattgctttgccttgggaccctgtttgtagtctttcagagtaaaactcagtccttggggaagtcatcctgaccatatataaggtcagaccactgagtctcacagatgtaccttgtacttctcttacatagtgatccaacaattataattaataatgaatcatatagaaccagttgttagctgtctcctactctacagcaaaacttgaaaggattatgttttcacttattcactacacacctaataccagtgtctaatacagtgctcagaactggagtaagatctcaaaaatatttgttgtaaaagaaaaaagagaatcctctcatcacataaatttggtttgaatcttaaaatttaagttcttacgtttgatcacgttgttttaaatgttgaaatgtttagtaataccattatgtagaggcattgaaaatatgactctcagccatctgatttagatctcctatatcagaaactctgggaattaggcctagcagtgtgttttccaacaaacttcacaagttacagaatgacagatttaaataacagtagtttccatatctctctttttaagtgtatagaaatacaagatcaagggtctggtagatatggtgtccaataaaagcaaatactgtccacatgtcagctaaagtagagggatactaaactctcaggcctctggtcccattaacaatggattgactttttttttccagtggaggaacattggctcccccctgccttttattgaaaatagcccattcttccttacaccatatatccataattatggttttgcctctctctagtccttccagtttctccccatttcccctcccatctagatctctttctgtctctcattagaaaacgggcttctaaacaacagtaataaaaataaaatataagataaaacagcaacacatcagaataggataaaacaaacaaaagaatgcaaaaaagacaaaagaaacatcaacgtagagacccacttgttggtacactcagtaatcccataatagcataactggaaaccataaaatatacccaaaggacttgtaggataaaaagagatatgtataattaggctaaaattaaaagtaagattttaaaaaagccttgacatgacatgagacaagaaacccccaatgatgtcactgaactcattttctgttgttggccatctactggtgggcatgtagcgtacccttaagagttgtttgtttcccagtgagacccccgcttagagaaaaagtaaagtttcatctgcaaggagttattaattggagagatcttctggtgtagggatgaggacatgtgcacacgtttcagtgctagggcctcacgtggtgccgacccatggagacccatggagaccctgtgaactcttcttcagtctctgtgtaaacatgtgcatcggacatgctggtttagagggcctcatgttcttggtgtcctccttcccctctggctcttacactctgtctcctcttccacaggcttcgctgagctctgaagggagggatttgatggagacaactcatttcgttagggctgagtgttccaaggtctcttctctctcttcagaatgcctggctctgggcctctgaatttgttcccatctgctgcaggaggaaacttctctgatgactgagcaaggaactcatctaagggtatagcagaatgtcattaggagtcattttattgctatgttcgtgctctgcaacagaagcagtaagagtttgtctctactaagaacatagtaatctgaagctaaaggtacataccaatggctaagggtgtatgtttggagaagaatatggggaaatacccttctgactattccagaagggtatttgactttacccttggtactgggcaatctaatctcatgttcttagttaccaagcagtgtcacttatggatttcatctcatggagtgtatcttaaatcagatacagagttggtttaccacaagctgggtaggtatttacatttcatgaaggccccaggtcttgtgagcacattgcagaataagtagatgttgtcagatgtcatctgaaacgtaaacaaggtctacatactcaacacaaatctggaggtttaaaaaatatcttccatttgtgattccttagtctagattttaacattaatcttgttaaacaaatctagaaaatgattgtaaaactaataatgttcatgatctttagtaatggttggagcctttgactttacattttttgttcattacaagtgaaatgtctgttttgtttcgttttggtttttgttttgctaaagcttactgtattgtggtttcattaggcatctttttttctttttatctcaaacatcatcaaacaaaaaggttttcacgtatatatttttcgctctgttgagacatctgggctgcagcacaccatcaggttgatggattggattccttgttaaaggtcactcatccccaattctgtcatcgatcctatatttgcttcatgtttgattcaagggcacaattttgacaaaaccatttctacctgaatgatgttaggtgacccatagaaaattaattaggttttttctttaatataacaggcatctaggcctcactgattgttgttctgattagaattgggaagagctaactaggaaaaagatttcgttggtttgttttcattttatttttgtttgcatgagtgtctgtgtcccatatacatgcctggtgtgctgagagttcaaaggagggcatcggatcccctagaactggagttatggatgattgtaagctgtcatgtgggtgctgagaatcaaagtcaggtcctctgcaatgacaagtgctttttaactgctgaaccttcctaaagtaaaggtataaaatatgtttggggctgaggagatgtaagatagagatagtttagaaattttccatatatcctataaccagttttagtaatatacacatgacattaaatgaaccaatcttgatatattactttaaaataaagactatattgatttgtattccctcagctttcctttaatgttatttttgtctctgcattccagaataattaggtcattttgtctcttcaggctttttgttggttttgacagtttcccttcaatttgatgaacttgacagttctgtgaagtatgttgacatttttgtttcttgatcagaattttatttttaaaaaaccattaaataggctttattgggcttgggaaggagttaaagtgccatttatgtaatatcatatcaaggtacacatcaccagcatgagttattactggtgctatctgtcctagttgttcttttttttctggtgccatgataaatcactgaccaaaaccaccgtggagttagaaaaggttcatttgatttacacttccatatcacagtccatcattgagggaaaccaactcaagcaggagccaggaggtaagaacctaagcagagaccatggagagacgcttctgacttgctcatcttgattttttatgcaactgtcacttacccaatgtgccaccacccactgcatgctggaccctccccctttagttcatctatgggttattctggtggtggcaattcctcagttgaagttctatcttcctaagtgtctattttgtgtgaagttgacaaaaaccaaaccaccacaatattgccccccaatcacctatctaaaatagtatttgccagactcatttactgaaaagatactttttttttctatttctataccatatttggaatcaagtcactaagcatagcctaagagtctgttgtataaagaggttccaatcaatgactgttttgctgagaacttgtatattgcttttcactatctcctttaattagggaatagttgtatgtagttagtatgtttaaagcatttatttaaattataaagtataggggctggagagatggctcatcagttaggagcactggctgatcttttagagaacttgggttcaatttccagtacccatgtagtggctcacaactatttaactccagttccaggagatgacaccctgttctgaccccagtagttaccaggcacaaatgtggactacacacatgcatgcaggcaaaacacctatacacttaaaataacgattttttgtaattgtaaagcatattgtgctgttgaatggtttttaaatgaaaattgatattttagtgactcttctggggtgcttgtgggaggacttgatgcagtttcgcatatgttcctgtccacattgattgttatcccctcagctcccaagtcttttctgtgtgcctgctagtggagtttagttgactgataagtatgttttaagtatattgcttcttccctgtctcacaaaaacaacaaacaaacaaacaaacaaagtatgttgtttctttgtgagagggaggggaggatgagacatttcttcctgtagcccaggctgtcttgagactcaatcagtaggaccaggctggccttgaactcagagattcaactgtgtgtgctttctgagggctgggattaaaggtgtgccaccatatccttgctgagtctttttgattgagaagaatgccttttgtgtattgtgcttcttttgtcaaaatagatatggcacaaaaggtttgcttgttttgttaatgtctttgttttgagaagatatctccaacctgaaaatgtgcattttgtacaatttgataatcttatttgaaaaataacattgctttactttgcataaatttggggctgttgtaaaccaaggaatatgtggcatgttctatgaagaaggtttattctctagtaattatcagattcacagggagcaaagaatgagaggatagacttcatatttgcacaaggactgttgaccagggtcagatgtgtcataggaacattatctctgtcagtccatctttcctttatattcactctattcataattcatgttttgattcatagtgttcacttaacgtgcttcccagaaagactgttctggaaaaaaaagcttacagtaagtaagcaattaacttttcattgaagctaacctttagtttttattagtaattttcaattcctccttaattcaataaataaggagtaataaacctcactgtgtttagatatatatcaaactatgggaggtttcattcaaataatatttgtcctaagaaagcaaatagacaaaaatagggatttttctgcatagattaatctttgtagctactgaggtcttagactccttgaatttgaaagaaatgctacaaaagggaggttgagaatgtttatgttttatttagttactttttcagtgttgctatccagtatctaattgcatatgtttactgtatagaagaatctagtactaatttttaaattttatttttattttattggtatatttactttatataattgttagtttgcaacaacatctagttcaccttgttatttatgtcttactagattaatatatgtgtgttttatatgaacaaataacaagttttgctttttagcattttctatgtgtacaggaggatgtgcatgcttgcacatgggagaaaatgcacatgtgtacatgaatgtgtggaagcttaaggttgatgtcagcagtcttgttcagttgctcaccaaaactctattcactgagtcatggtctcagttgaacgttgagctccatgatgtgactagtgtggctagcctgcttgcttgagaatcctttttcttcaccttctgaactctggtattacaggtgagctgccacaaccacctaacattcacactgaatctggggaatctgaacttagttctgtccagtattctaaccaccaagcaatctctttttaaatctttttaacaaggtcttattatagagccctggctggacaggctattatgtaaagcctgataggccttgaacatctagcgattctcttttctcacattttctgggattattggtatgcactaccatgccgacctaatattgatgtactagtagtaacttaacatcacaatttattaagatttccttagtccctagtaactcttttctattaatagtcctatctaaaataacatcatatttagccatcatggagttttgttttgttttgttttgtttgcaacaggttttcactgtagccctggctattctggaactgaacctaggtcttctaaggagagaagccagtgctctgaaacactgagccatctctccagccctgctaagaaatactcataggccgaagtgatttttcactttaattttattctgcattttccccagtaactaatattttattacacctcactttagtgtgtgtgtgtgtatgtacaaatcagagaaccacatgttggactttgttctcttcttcccctatgtgagtcctaaggatggaactagggtagttaagcttaatggcagatacctttacctgctagacgatttttgagcaagtgtttgttaacattattgttttacattgtgtatttttttaattagacagttttgagatttctagatatatttgtcaatttatcaaatatgcattttaaaaatatttccctgtttatggcttgtctttatattatttaactttgtttgttatatttatttatttacctattttgtgtgtatttgtacatacagatgtaggttctggggatcacactcaggtagtcatgctggcgttattcactaaaccaccttactttgccttgtttgtttgtttttgccttgttattttttaataatttttcaaaaggaaaagttttaagttttaggttgctttttatttttcagtttatatttttcagttttttcttttacgttcaggacttttctgtactaagaaatatttccctgacccaagttcataaatatttcagttctttgcagaaattttatagctcctatgcccatatttcagcgaatagtccacttcaagttggtatttattacagaaatgggttaatttttttttaatttggattttgttttgttcagttatcccatcattatttgttggaaaatacctttttttctgttaaattaatttggtattttctgtgacgaataaaaggtctgtatgtattgatttctagacaatctttgctttttcattaagctataaatatttgttttcttgctaatatcactttgttttgagtattgtaaagtatttttaatcaattgatatgagtagttcaatttttttttaataatagtttgagttgggcaggggatatatttcctggtagagttcttgcctagcatatttgaggtcttgggtttactacccagtaccacataaaaaattgtgtgggctcttagatacttgtttctactataacttttagaattactcccattaatttctgagaggggcctggagagacggctcagtggttaagaacactgactgactgctctttctgaggtcctgagttcaagtcccagcaaccacatggtggctcacaggcatctgtaatgggatctgatgccctcttctggtgtgtctgaagacagctacagtgtactcatatacataaaaaaaataaataaatcaagagagcctgtttaaaaaaaaaaaagataccaagcaagccagtgaggaggttccttttaaaaaaaagttttctgagaggaggcagggagaacaaacacttttaattgtgatctataagtttgggctttgggtatcttttagctgaagtatcagctctaccatttacttaaaatttttatgacactaatctctcaggaccaaccaggttaaaaaaaattcattataagctagtgatttcttatgccccttttaagaacagagtctgttattgactttgactagattggcctggagctaactatggagcccgggctggcctgaaacttgtgacagttctacactacttccagcaatttgggagtattatgaggaatatagatagtatatgtaaataacttcacacatagaatgtgttcaacatagtagtacctagtaatcaaattggtttttttcctacaatgaaatgtgtttcacaactgaaaataattaaattataaggattgccaaatgaaacttttagaatgattttaaggctatttatttttccaaagtagccttgagcaattcgaacatggtttctttacctcttttaaaacagtgtcagatacacacacacacaccaatttggaaggttatttgagacagagtttctctatgtatcctggtttttttggaactcactctgtgtagaccaggctggccttgaacttgaactcacagagaaccacctgcctgtgcctgccaagtgctgagattaaaactgtttaaagccatgctgagtccaacttggaggaatttaaaaagtacagttgagtgctttgtgcttttctactggtaggaagcatttatttcaacccagaggactgactgcagaggacattttatttcctgagtcatgtaggtgtgattgtttatgactcctgaggctctattctttaaggaacacagaccacttcagcctgtctggtggtaatttccagtaagattattttggttatcacaagtggagcccaagaagtttctgttgtcttagtcatttcaaggtaagtaagaatcaggagaaaaaaatgagtttgagaaagtgcataaagcctacaggaccaggacattaggagaagagttgtctctaaggttatcaatccatggccttctgtacattgattacgtcattacttgatttcatagtagtattcttccaatcaaatgtatgctgcttgagacatgacaaaatggaaaatcaattgtatttgaagattttcttttgtatagaattacattatcccttgatgctgaaaatccgtttattatcagtagtcggtttagagtgcatttcttctattaccacagcccttaagtaaatatgttaaacatattgcccaaactgtggttcaagcaaccttatatcatagtaaatacaattccggagttatgtaactcttattgtttgtgacttctgagactctgctctttaatgggcacagaccacttcaaactgtctgaggtaattacttttcccagtaattttttttttttatcacaagtagagcccaagaactttctgttttctcagtcagttcaaggaaggtaggaattagggggggcgggatgagtgagtttgagaaagttctgttcatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacttcatcagatatttgttcagaaatccagaatttaaggcaatatttactgtttggtgcttttgaattctctggttcccaagtggagtatttattttgtaaaacaattcattttacattttggcagtggggtgggggagcagactgtgtagcatacctcagggtggtcttaccccaggctgtggatgatcttgaacacctgatcctagtgtttctacctctgatgtacttggattagaccaccttgctttgttcttggggtgctagatatcaaactcagcactttatgcatgttcaacacctattctatcagttctcctatcccagagacctaaccttcatttttgctgaattgaaagcacatgaatgacatctctttatttcattatttccttttatagcagttgagaataagtcttgcttctatttcttgcttttgctttgaaatagttttttataaagatttatttatttattttatgtatatgagtacactgtagctgtacagatggttgtgagccattatgtagttgctgggaattgaactcaggacctctgctcactccagtcctgctcgttccagtccaaagatttatttattatatgtaagtacactgtagctatcttcagtcacaacagtagagggtgtcagatttcattatggatggttgtgagccactatgtgattgctgggatttgaactgatgagcagtcagtgctcttaaccactgggtcatctctccagcccttgaaattggtttttatgtgttccagcctgacctgaaactcattatgtagccaagactggccttgaactctcaattctcctgagtccacttcccagttccacattaggttctaaagagatttcctttttttgcactgattatcattgactatttagttatgacttaggcttgattattatttttgttccttgttctttagatataaattctttgaaccttgaaaatgttctgactcttaacctcatcgatgttgtcgatattaaaaaatgaatatctaggcgggcgtggtggtgcacgccattaatcccagcactcaggaggcagaggcaggcagatctctgagttcgaggccagcctggtctacagagtgagttccaagacagccagggctacacagagaaaccctgtctcaaacaaacaaacaaaaaagaatatctattatctatctttgtcctcataattatgacaaagatgattagctgttcatctttcaaagagttcacaaaataacaagttagtaaaagagataaaatattgtgattaactttttctaacttgtcaaacatgtaaatacccctactaaattagctgaacaatgagttccagggtccgagcaagaatgtccagatattggttaactaaacttgtgagtaactttaactaaaataagtgaggcctagtcttacacattcaggagaggctactttgtgttccatgtaattctaaacattttaaagaaatgaacaaaaataaaattctattacccgaggattctacaaactaggagacaaaaaagaagtgtgtatagagattgttgtattttctgcctcatcgagtctagcctccataatgtttcagttttggttggtttttgttgttttgtttgtttgattttaaatcatgtcctttcctacttgggtgtgatttcatcacaaatgctagcatgattttttgtggctcttggagtgtccatgatcaattatgctccttgtagttggaagcctttgatttgcccccacttgattgccttttcttcttttcttcttttctttacttgttcttttttttaaaaaaatatttttattaggtatttttctcatttacatttccaatgctataccaaaagtcccccataccctcccccccacccgactcccctacccacctactcccactttttggccctggcgttcccctgtactgggacatataaagtttgcaagtccaatgggcctctttttccagtgatggccgactaggccatcttttgataaatatgcagctagagacaagagctcggggtactggttagtttataatgttgttccacctatagggttgcagatccctttagctccttgggtattttctctagctcctccattgggagccctgtgatccatccaatagctgactgtgagcatccacttctgtgtttgctaggccccggcatagtctcacaagagacagctatatctgggtcctttcagcaaaatcttgctagtgtatgcaatggtgtcagtgtttggaagctgattatgggatggatccccggatatggcagtctctagatggtccatccttttgtcacagctccaaactttgtctctgtaactccttccatgggtgttttgttcccaattctaagaagcagcaaagtgtccacactttggtcttcgttctttttgagtttcatgcatttagcaaattgtatcttatatcttgggtatcctaaattcctgggctaatatccacttatcagtgagtacatatcatgtgagttcttttgtgattgggttacctcactcaggatgatgccctccaggtccatccatttggcgaggaatttcataaattcattatttttaatagctgagtagtactccattgtgtaaatgtaccacattttctgtatccattcctctgttgaggggcatctgggttctttccagcttctgactattataaataaggctgctatgaacatagtggagcatgtgtccttcttaccagttggaacatcttctggatatatgcccagaagaggtattgtgggatcctcctgtaatactatgtccaattttctgaggaaccaccaaactgatttccatagtggttgtacaagcctgcaatcccaccaacaatggaggagtgttcctctttctccacatccttgccagcatctgctgtcacctgaatttttgatcttagccattctgactggtgtgaggtggaatctcagagttgttttgatttgcatttccctgatgattaaggatgttgaacattttttcaggtgcttctctgccattctgtattcctcaggtgagaattctttgttcagctctgagccccattttttaatggggttatttgattttctggagtccaccttcttgagttctttatatatattggatattagtcccctatctgatttaggataggtaaagatcctttcccaatctgttggtggtctttttgtcttattgacggtgtcttttgccttgttcttaaaagaaccactataaatgtttcttttaggaaacatttccttgaaagaaagtcttagtgttcacagtgatcacagtcctacaatgattacccttaatatatagctgagtgattcctcagtttgtgtccttgacacctgttataagatcaaatatctgatagctgcttgggaaaaattgaaggaatgcattttgagggcacatgcagttttagggtaataattgaggcagagtgcactacttaagcaaaactatgcatggaaggaaaagaggatttagtttttctctcttttttcttcttccctctttttctccttctccttaccaaataagtttatactattttcaagttgtcattttagggaaagtatgttatgatgcaaaacagtgagagaaaggagtatgttcctggtaattgaaaatgatttgtgttttagaattttgttaaaaacagtgaatatttgtgagggaacttgagagaaagcaaagctcatggaaatgtaattttatttttgccaagaaaattgtgataaagtttaattctcatataacaactactaccagaatggaaatttccatagagcaaagagatttcagacttgtagcacatatatattttagtactcagtgtagaacaataattcggtaatagaatttgacaacttttgacaatttagtttatgatatatgaattaatgaaggcccattcatcatgggatttggtgactctgccaattttggccatatttttgatggaaaagaacagctagttgtccagaagcccaaattttcactatgatctctgtaccacttcaacagaatgccaaaggacataaacatgctgcaggtaagacttgagaaaactccatcagcaagtagagatttggcccctggttggtatgaaaagttttactgtagcctgtggtgtgtttgtatgtccatttccccacctatccatttaacagaatcaagtttcttggtttgtagcatgaggatgaataaaataacacctgcctcattggcttgctatatggatttaatagagaatgcaggggatggattcaactgtgctcaataaacagtacttatattttattatgtagcagaagcagggggctgagtaaattcttctttttaattaggtattttcttcatttgcatttcaaatgctatcccaaaagtccctcagaccgtcccccccactcccttacccacccactcccacttcttggtcctggctaatattactagttgagtattatgatcaactttgctcatgtattcattgaccattcatccatcctgtgataattcagcactgtgttctaaagactgtcatgacctggactgcactttatttaacacgcaatttgttttttcactttatttgatgcccatctcttctttcaactgaggacaacttgttttgactcacaggataaaattacctattcctccattgtattcaacttagtacagaataccccctttcccctcttcctcattgacttatctctcatgtttatatttaatgttcaaattagtagcgtcttcaaatttcaattcttttgattttatgtgcttagttccagaaagtcccaggcatgtgaaagaaatgtatgatgcctgagttttgctgtttaggttaggatatactttgaccaattagttcttctctatcttcttttcttttactgctattgttcatacaagattaccttttttacttttgtatttgaatgtcaacagagatgatcatttctccatagagcttatccttttttataaaaagattatttgtttatatatatatatatatatatatatatatatatatatatatatatgaacactctatttatatgtatgcctgcatgacagaagagagtatcagacagaagaaggcatcagatctcatgctgtgagctaccatgtggttgctgagaattggactcaggacctctggaagagcagtcagtgctcttaaccgctgagccatctcaccagactgagcttatcctatatatatccctttatatttatacatatttcgtctaatcactgtcgggctttgttttgtactatgcattttaaaaaaagagctcctcactttcagcccacttaagtaaaaaaatatgaattgaatcatgactagtagggaatatagtactgctatttatacacatgtgtatcaaggaaaggggaagccataaattaaaaaatttggaaagtaatatttgaattcccagaggtgtcttttactcagaacttccaaagctgaacttgcttcttgaatcttctcctttaaactgcctcttcttggaacccctctagacatttgtagcagtcaactctcaatgtgcttctttcttttgtttttttaattaggtattttccttatttacatttccaatgctatcccttcaaagaatgtgcttctttctaaagctggttgatttttgtctgagtctggtccttgacctcacagagatctacctgcctctgtctcccaagagctgggattaaaggtgcttaccacctcagccagcttcaggcccaccccacccctgccgcctcttttgataaggtctcactgtgtagccctagctggcctagaacttgctatataggtcagactgttctcaaactcaaaaagatccacctacctctgccctctgagtgctgggattaaagtcatatgccatcactctatactgtgatggtgctatttttcagattttcttcattgtgtaaaatggcacaagaatttttttttttaaatcaaagaaatgtgtaacttgtaaataatattacaacttgcaaacatactagaaggtattattcatataaattgttgctagtcatcccagatatctttccatgtactctcttaatcaacattgaaccttgaatttgaattgatagtcagtcagtcttctaatatgcctcttttaccagagcatcctgattttattgagtgctttttatatttcagttctggtattgtccagtgtcaagctattgagtcattagaaaaataccaatgagatagatggtgttaatgttcttatttataagaaactaaggttcagggatattaagaggtttgtctgaattacatagttaatttggggtacagcaggaagcttatcaaaatcatttgctctagtgtcaactctattctcactgggccataggtgcatggatttggaatgactgactgctgtctccagcattgtttttggatctagctagctttcaactcatgtttcagaagagcagcagagatgactcatttatcaacaggatctaagttcaatttccagcacctatgtcaggtggcctaaaaccacctgtaactccagctccagggcattcaacactttttggcttccatgcataccaatatacatatagaatatgctcacagacacatatatacataatacataaataaaaatgaaaagaaatcttaaaaataaacatttttgagttgcgattgattgattgattgattcatctgtatttttgagaagggtctcatggaatccaggagggcctctaattttcagtgtaactgatactgacattgaacctcctgatcttcctacttccacctctgatgtactgggattatagatgtatactatagtgcccaacttaaacattattttaaattgtgataaaatagacataataaaatttaccatcttaatcacttctaatggcatggtactttggtaataagtttattcatactgttttataactattactaccattcattactagaaatgtttttactttgcaaaatgaactttttaattggatattttatttatttacatttcaaatgttatcccctttcctagttctctctctctctctctctctctctttattagatattttctttatttacatttcagatgttatcccttttcctagtttcccctccaaaaatctgttatcccccccctgcaccccaatccacccacttcttggtcctggcattcctctatactggggcatggaaccttcacaggaccaagagcctctcctcccattgatgacctacaaggccatccgatgctacatatgtagctagagccatgagtcccaccttgtgttttctttgattggtggtttaatccctgagagctctgtgggtactggttagttcatattgttgttcctcctatggggatgcagaccccttcagatccttgggtattttctctagctccttcattggggaccctgttcttcgtccaatgggatggctgtgagcatccacttctgtatgtcaggcactggcagagcctcttaggagacagccatatcaggctcctgtcagcaaaatcttgttggcatcctcaatagtgtctgggtttggtggttgtttatgggatggatccccaggtggggcagtttctgggtagtcattacttcagcctctgcttcacacttagcctctgtaactccttccatgggtattttgttccctcttctaagaaggaacaaagtatccacactttggtcttccttcttgagtttcatgtgttttgcaaatcatatcttgggtattctaaggttctgggctaatatccacttatcagtgagtgcatatcatgtgtattcttttgtgattgtgttacctcactcaggatgatgccctccagatgcatccatttgtctaagaatttcataaattcattgtttttaatagctgcatagtatttcattgtgcagatgtaccacattttctgtatccattcctctgttgagggacatatgggttctttccagcttctggctattataaataaggctgctatgaacatagtagagcatgtgtggttattacaagttggagcatcttctaggtatatgctaaagagtggtgttgctggatctttcggtagaattatgtccaattttctgaggaactgccaaactgatttccagagtgtttgtaccagcttgcaatcccatcagcaatggaacagtgttcctctttctctacatccttgccagcatctgctgtcacctcagttttttatcttagcccttctgactggtgtgaggtggaatctcagggttgttttgatttgcatttccctgatgattaaggatgttgaacatttctttaggtgcttctcagccattctgtattcctcagttgagaattctttgtttagctctgtaccccatttttaaatagggttatttgtttttgttggagcataacttcttgagttctttgtatatattggatattagccccctatctgatttaggataggtaaagatcctttcccaatctgttggttgcctttttgtcttattgacagtgtcctttgccttacagaagctttgcaattttatgagctcacatttgcccattcttgatcttacagtgcaagccattgctgttctgttcaggaatttttcccctgtgcccatatcttcgagactcttccccactttctcttctataagtttcagtgtctctggttttatgtggagttccttgatccacttagacttgagctttgtacaaggagataagaatgggtcaattcacagaagtggatgctcacagtaatctattggatagacacagggtccccaatggaggagctagagaaagtacccaaggagctaaaggggtctgcaaccctataggtagaacaacaatatgaactaaccagtacccccagaactcctgtctctagctgcatatgtaggagtagatggcctactcagccatcattgggaagagaggccccttggttgtgcaaactttatatgccccagtacaggggaacgccagggctaagaagtgggagtgggtgggtataggagccgggcggggggagtgtataggggactttcgggatagcatttgaaatgtaaatgaagaaaatatctaataaaaaattgaaaaaaattaaataaaggattactaacattgaatatggaataataaagaatgggtcaagtcccactcccccccaccccacacctttaatcccagcacttgggaggcagaggcaggcggatttctgagttcaaggccagcctggtctacagagtgagttccaggaaaccctgtctcgaaaaaccaaaaaaaaaaaaaaaaaaaaaaaatcacattcttctacatgctaaccaccagttatgccagcaccacttgttgaaaatgctgtcttttttccactggatggttttagctcccttatcaaagatcaagtgaccatatgtgtgtgtattcatttctgggtcttcaattctattcaattggtctacctgtctgtctctataccagtaccatgcagtttttatcacaattgctctgtagtaaagcttgaggtcagggatggtgagtccagcagatgtccttttatcgttgaaaagagttttgctatcctatgttttttgttattccagatgaatttgcaaattgtcctttctaactcgggaagaattgagtcgtaattttgatgggaatttcattgaatctgtagatttctttcagcaagatagccatttttagtacattattcctgccaatccatgagtatgcagttttccctcttaaactgaacttttttatccattaaaccataagtccccatttccctctcctaccaattcccaaaatctccccagcccctctcagtgtcattattatttcttcttcctttttcataatctatagagtcccatttgtgctgccatatactcatgagtatgaggctactatccactaaagggtggtcaatctaccagggccatacccttaaaaataactgagtctcccttctccataagccatcgactaagatagtcgtgtgtgtgtgtgtgtgtgtgtgtgtgtgtgtgtgtgtgtgtgtgtgtgttgtttcattttgcattgtttttttgagacagattttctctgtgtaacagtcctggctgtcttggaactctctttgaaaccagggtggtttcaatatcatagagatccaccagcttttgcctgtgctgggattaaaggcatgtactaccttgcccggcagcagtctcttctttctttgaaggtataatatcaatcctcatagtcaacagctttctgattaatgtttaaataaaatattgcaaattcaacttggatttacaaacatgcactctagtattgaatcaggaactcagacatttttagtagaatttagaatgtttttaaaattatgtgattaggcacatggtagcacatgcctttaatcctagacttcctgaggatttctgcaaagtcaatggatctctgcaaagtgaatgccatcctggtctatatattgagttttggatcagtctgagttcataatagtgactctgtgtcaaacctacaattataaaattgtgtgattagaggctggggagacagctcagcagctaagagcacttaactgcccttgcagagtagagtttgtatcccagcatctatatcaggcaatttagtgtcctgtaactccagctctcaggagtccagtgccctcttctggcatccttgattctggcatacatgattgatggtaagatcatcatttagtagatttattttaaatatgtacaacttttacctttatgtatgccgatgcaccacatgtgtacagtgcctatggaggccataaaagtgggtcatatctcctgaaactagaattgtatgctgccatgtgggtgctgggaattgaacataggtccttagggaaagctgctagtgttcttaaccagtaaacgatctctcccaattccagtagaaattaattctcctttcccttccccttcccctcctttcccatcctttccctcttcctcctcccgcctatcccctctttttttatatgtagtttgagctaggctaatacctggagtcaccggagttaggaggatcacagtcagtttgggtccagctggggatatatagtaaattccaggacagcctacgctatagtctgtcataaaaaaatcaataaaaatgtaactttatgtcttaaagaactcaagttttagtccttaataaataactagttttgtatttagtaacatacagagaataactgcactgaaaggaaaatgaagccctatttctgggctgttcctttattcaagaccaaaaaatagtttctttggaaaaaaaccccacaggtctgctcatatgagttgctgcatcaggctaaaaactgcattttattcagtaactttaaataatgacattatatatttgggagtgctttagacagcaaagtattatgaaatgctgaatacaaaagctgagtaaaaaatactctgctttttagtttttcttcctgtttttattaatatttagaaaatagagccaggcatagagtctcacacatatagtcccatcactaggaaggttgaaagcaggaaggtcatgaattgagaaccaacctgaacacaacgagtatcagtccaactttggatacatagagtaaggcactctctcaaaccaaccaaccaacaaaccaacaaacaaaccaacaaaccaattagaaaatggcttgtggggttagggatgtatctcagttggtagagtccacagaatgcttgtctaaactgcaggaagccctgtgttcagttaccaatacttgattaaactggatctaatgattcataccttcatcccagcatttccagcactccagagggcgaggcagaatcggtaatttaaagtaatccttgggtttgaggctagtgtagactacatgagaaaaaaagaaaagaaaaaggagccaggtgttttaatggttttaatcccagcactagggagatcagtgaatctctttgtaagttttgaggccagcgttccagtatagccatatctgtaacagagaaaccctgactgaagaaataaaaaataaataaaataaagaaaaaagaggaacttgcttctggggaaatattcaaactagaagaactctgtagaccaggctggcatcaaactcagagatatctgtctccttctgcctcctgagtgtggatgggttttttaattttttcatggtaaattttcactaaagttaagcttgatgtagattgtttgaaggttatttttactctgaaagttattgtaatcaaaataattcttagctcctttaagataacatttccgtgttttcatatcctctttaccagggtaaggcccatctttttgtttgcttttatacattttaaataaaaaattagttacatcattttctacttcctttcctccagcctttcttctctgttattattgttaaaacacacataaatagctaaatacagcctgttcaattcatttttttgtttgtgtgtaaatggttttagggctggccactttgtgttggataaccactgtgttcattctgagattgtttcacatgaggtctaggttctttaaaatatttttgttattctttaagataggattttactgtatgggccaatcaatcctggaattcttgattcagcctactgactgctgggatcactatgcccagcttcttctaaactttttaagaatcaatacctattagtactttgttgtgggtcagatctgtagaacatagtcatattgtccaagataaatgctatccattggaaacagtatcccatttctcctttctcccagttcctggaaatcaccatctaattcttttccctgattctctgaatttgtgaagttgaaatgtctcatataaatgaagtcatatgttatttgttcttttaaggctaggtccaaactcataagagatccacctgcctttgctttcctagtactgcaataaagatgtgtgccacaatgaccagactccattctgtgagcatgtcatattttctcttccttccctttcattagagaaagtctaagtctgtaacgcacactggctttgaattcaaaataaatctttctgtctccttggtttacaagtgctgggattatacgtttatgccactatatttaaacacattcttttcatgtttatctattagtggacatttgtatttttttaacctcttagcttattgtgaataatgactctgtgactaaaggaactagagatatcagcctcttcctgaccctcattttagttttttggttatatactctgaagcagcatagctgagtcatgatttttcaatacataaacatagaaggacacattcaaactatatcattgactttagaattctcctctgatagccgtttataggttgttctggttcagtgtcattgccacagctgccaaatttaagttgatatagaacaagtctctcctcttataaactcctccctcctgaggtacaaagctgtttttggagctgagcactaaagaggtcttttatgttttccaatgcccctcttatatagcagtgtgttcaaagatttttattagtatctcattcatgaattcttttttttatttcctggttaggtgatactgtctctatttaccttatcatctgagttatatacctctaagcctctttgttctttactctgttaattccaggtactcttacacttttatgggcacagatatggtcaaggtccttaagagttaggcttgtttcctttgggataggatctcatttatatagttcaggctggtcttgaagatgagatgcttctggcttagcctactgagtattgagattctagatgtgcaccaccacacatgactctcttcagcagttcttacttaggtaaatacaatcacatgcaccccataagggattcatctttatgtggccttgctcattgtcttacctgttttctttcaatggtatgtaaactccttgtaaggcagtgagtcattgcatccatcgcctgccttccagtctttacaggttaactcttctactctttatttcttagtctgccttattcctcctcatctttataagagtcacttctggtattgtgtctgtttatagagccttacaaacttctaactggctttgtgttcatctccttgcttgtagctcctctgatgttttatttaccacattagggtttgatgatatgtagatatctgttttctgatgaattgtgaattctttgatgctgcagccatggtgaaatccttatctagtctgtatgttacttacattaatccttatagtaatatcctagtagtacacatctaatttacagataaagcaataggtgaagagagtaattaattagtatttgccaccgtgaggtaccttgtttgtaaggagcaaaaacaaagtttcggtctgagattttgacaccactcatcctatttgggtaagaaagtatactattaaccagatacagtagtgcagatctgtaatctaagcactgtaacctacagcaggaaaattgtgactttgggaccagcctgagctataaagagagtttgaggcctgtctgaacaatatgacaagaccctgtcttgaaaaataagagaaaaagaaaaatacaccattattcatcttagtgttgaaatctgtcgtattactaagttttgctacttttaaattgcttaaaaaattttatgtgtttgagcattttggttttgcctcacatgtgtgcctggtgcccatcgaggccagaaaaaagtctgttgggaatcctttgggactggagttagaggcaattgtgagtcaccatgtgagtgctgagaatctgatacagagcctttggaagagatggaagggctcttcctgctgagccatctctccagcctttgttttaccactattaaataataggcacagtgtttaaaaaacaaacaaacaaaaaaaaaaacttaaagctcttcaaaggcgggagatttttttttccaagacagggtttctctgaatagtcctggctgtcctggaacttactctgtagaccaggctggcctagaactcagaaatccacctgcctctgcctcccgagtgctaggattaaaggcgtgcgccaccatgcccggctaggcaggagatttttgccaccatttttgagaagctaaatccacatataaagtatattcaattcccaaattaatagttgtaaaattgtgttaatgtatgctatatgtatgttaaattttatcacaatgtttttagatgtgttaagaatccttgacttcgtatcttatttctattctaaaaattttggatggctaatatttttttctttaaaagtagattaggtttttttcttatagcttcaatatttttagcaattttgagctttccactaatgaggcttttctagtttctattctattctgagcaatatttctgtcattactctttatctttgaattaagcatcttagtaattatatgccacttgggctgctgtgtgaccctctggaaatctctcttatacagtcttcaggaatgttaaaaacaaatgtgcttttctaagtggtagagttaatagataaaatcattttaaaattaatattcacaggaaacagttctacctagcaactcgtgtatagaatatactattattagggcatgtatgtcatttccatgccctttttgtcttctttggggcaaatctcttcttttcttaaaaacaaatcacaaaacagtatgttttggtggtagaaataaagagtcctattcatataggaaatgctcccaaggctggtaggaatcatgagatcaaaatctaatgttttatttggggcttagctgacatctttaaaataaattttgttattttagaataataaatcatacttcatacatatgaagttatacatgaacacagcattgcacatcactcctaaccctttttccctctctaactcctcccatgatcctctccataaatttattaacttagttatcactgtaacatgtatatattattataacatgtatatatgtacatgcatatttgcatataacctactgagtctatttccctttgcttatatggacatatgtccgaggctgaccactttgcattagtcaatgtatatgggagcttatccctggaggagaatgattctcctcaacagtcattggtcacttgtagctcttcttctaggaaccctgtggaatttacccggtccatattagcatgtcaaatgttgttgtcattatgctgttctcatttaggcaactgaatgagtagttcacaggtaaacttttcatatagaagatactaccacacagaagatagcctgctcttctagcttttccaatcttactctattctcttctacaatttcccctcagccttaagtgtaagtgctgcattggggatgtattagagttagatacttcatagtcactttgaacattttgactactcatggatttctgaaatagtctcctatctgatgcaagaagattcacttagaaataagaactacatttttctgtgggcaagtatttagaatacacttagttcaagaaaaaggtagtagagggttctcctctttggtctgtaacccactagcttcagtgtactaggtatgaattctttcctgttgagggaaattaagaacccaaattgagggaatagaaaatgccttacttaattattaaatagttaatagtactggctgttctctttcataagacttgagttaaagagtcccaactaccatatatctgctcacagcccaggggatccaagagtaccaggcaacccattaggtgcacagacacacaacagacaaaacatccatatgccttaaataaataattttttttaaaaatgagtctaatatatacaaaatggaagaactggaaatgagacatttgaaaaaattctttgtataatgcaatggatacttttcttcaatgattattcttttcttttacctcttaaaatctatgtatacatctattttccttttatttcttccctggtctctaatggtaaattagatttggaataacttattagtagtttacaatcactgggtaaagacaactggaatcagtggtgtagttttattcttgccttatccctcttgagatgtcatggaaatagatactttccctaattatagtcattaaaaaactaatgaactcttctgttttataaaatcttctctatttcccttggctaaccaccttcttttatttatactgcatgtgctactgatagttgctgtttatatcattctcaattcaaacacatggttccttccttcacgaaactagacacatatacattgtagaaaatggtggcttacaaccttcaataactccagttccatgggatccaaagctttcttctaacccctatgaacacaagacatgcaagtaaatacatacatgcaagcaaaatattcgtgtgcataaaataaatctgaaaaatagaacattgtgcttgtaaggaaaggtttcattagggtatttcctttattgtttacatgagggttgactgtctacattctggtaagtagcatattatgactataatatttatcttcttgtaggaatatatttacatctttcttattcagatttggcatagcaaatgaataaatttaatcctgtggagtgttttttaaaacacataataatatttgcctcattaaactattatgtgtgcaactatagaatatagaatattatttgaatttttatggaattcaatgtgacattatcatatagatcactgatcacatttgacctttctttttgttaccctagtgcttcctcagtccttactcatcattctgctttgaagtcagcctctgtaaatcatgtacacattccacatgtaagcgaaaccctatttgtctttgtttaccttatttaccttatcattttgtcctctaatccaatccaacttgatgaaaagacaagatttcattatttatagataacagtctagtgtttgtacgtgtgtattacattttttaaacatgaacctgttgaggattacctaggctgattcaatattttagttattatggataatactgcaataatcttaatagttcactttctaaaatcaaagtttaaaagttttaagtataagcgattaccaaggggtactgcatttcttgggagtgatgaaaacctaaaattgcattgtgcttatagttgtatgatgttttgaatatattaaatattatttcatgataaataagtatgtcctatgagtatattaatgacaggttaataaagctgtttgaagggatactcaaatcattatataactatgctacaatttagttagctctgtatcctctcataaattactttcttccctgtatcctgacttctttaaatgtgtagttaggataatattcagtaaaatattctgttatcagctggttatgagaataaaagtgcttagaaaaaaatctcgggatggatgaattaattttcaatggatagataataaatgcaagcgacttaggattttgttactcaggaagaatatgtggttaggcagaagttacagaggtaagggaaatatcagcatttattattcagggaggaaaagcagaggtatccaggaagggaagatgaagattccttaaagaaaagtggtatcatagaaataaagggaaaacagtctttctgtggattgtggtggtaaggctagagagaagttaaagcctggcagctggagctagtgttttcacagtaatggaatacttacctaccatgcagtagagttctggatttgttttcataattctataaaacagaaaaacaaaatcagaagaaaattttaaactgtaagtttccattggatttggcaagtttgtatcgtgagaatatattaaccaggttacagagaaaggaggttgagagaaagcatgaggaaatccctggatgtgttttgttttgttttgaggaaggttatcatttctttagcagttatgtgttgagttcttactgagtgttaggcattgctgcaagtaattgtggtataccagtgaacaaaacaaaataatttctgtcctaaaggctgttccttcacactagttctagtagaaggaagaggctaggaagagcttttgcaaggatttttttttaagctgaaaagtgcttaaacatatttaaagtaaggaataatgggggacagagtagacttgatgtgacttgatgatgtgtagaggcaaaatgatagctttggtgaacaaaagtgggaatgttgaaatcagaaaaggggatagctaggcttggtgatggcacacttttaattccaacacttggttggcagagacaagtggatctctatgagtttccagaccagcttggtctacttagtgagtttcatgacagccaggacaaaataaaagagaccctgtcttaaaaaaaaaaaaagaaaagaaaagaaaagtgtaggcaaaggctcttgatcagacttaaaacagaagagacttttttttcaagctagaacaaagagctggtgtatacaaggagggaaatgggaggagcttcttgggactaggtgacattgactgtgggttgaaagagcaaggtctcatgtggaatcaagtatggaagacaactggagggggctggaaaactttgaaaagtatacttaggttgaatgtgggactgaagaaaaggagttctgagagattctaggtttttggatcagtgggattggggggggcgtgtctgtgtggataatggactttccaagtactgtggcaagaagtagaatagagaacaagagtgaaagccaagtttcaaagtcttcatttagtgtcaataagtgaccaaagtgtttttgatagagatgatgagatggatgttaaaggtcactagagataaagatgtgcacattaacttgacaatttcatcagatactggaaggagatgaaatggaattgctaaagacccaagtgaatgaagtcaaaaggtctttgggtggatagttagttggccatgtgagaagtaactggtgtttctcttcacatgtatgagccaaaaggtatgaggtgatgaggtatataagcagtgcaagggttataggaaactctgggtggtgaagttggaggcaagtcaagaatatatgggtagttcctgggaagaatttccaatttaatactaaagagaaaatgtttaaaagggctaggctagtggattctgcagggaatagtataatcatgaaaaacgagctggagggagagcgaacagtaaggttatgagtacttgggagactaaaaccagaagatttccatgagtttgaggccagcttcggctacatagtatattccagaactggctaagctatagagtctcaacaaagaacagaaaatgtgttaggcagaaatatagaataatatgaagataagcagcaggggcacagtcaagagtagttgtaacaggcttttaggttttagtgggtttttttctttattcattctcattcattcattcattcattcattcatatttgttccgttttgctccctccctgcctgtctctcatcctctcttgtccccctccctactctttcttcttcaaaatgctatagcatgtgagcagttcagggtttcacgaatactctgttttctttttttttttctctgcagaaaagagtctaagcctatttacggttctaagttatattcttcctaaagcacaagccctggtatttattctacatgctgttttagaaatgtaataagaaaccgtggtggtgatgcccttttttaggttactttaaaaagggaaaaagtgtgttcttaggaataaacaagaccattgatttgtagtattttttagtcactgttggagcttagtttctgcttttagtataacagttgaataactggcatttattcatttgtttatctacttatttataaagaaaatggaaaaaggacattgacaaataatataggtccgagagttacagcgtaaaacagtggattgtatgcctgtcctatgaacagttgctaaacttagtcttatttaaacatctccaaagctgtttttggttagttccttaattcagattatcggactctagtatctgaacccaagtccagaggttattcatactaaaagttataagcaccgacactacagtattgcatgaattgattctttagaaatttattaattgtgggagatgtatttaggaaggaaacctaatgtttaacagctaagaaaatattggacattggtaaaattggaactctttggtaaatatttagttcattttttgatacaacatctgggtaaaaatcaaaggttacttggattcatacaagaggaagtatttcttttctttcttcttttattcttttctctctctactcctgggtgtttttctctctctctattcccagatgttctggaactcactctgtagacttgctagtctgtacaccaccaccaccatccacctggaagtatttcttaaggttaagcaagacatcctattttatcataaatgtaaatataaataagtcatgcaaagtttattttagaggatcacagttaacctaccaaattcataatgtggtttaatatgagagagagacctataagtctgaataatttttaaagtagtctattgtttttcttcttgttatggtagtttcataaacttaattattcctaaagcaaatctattcagataccacagagatagaaatcatatttagtaaacttaggttttgtttgtttgtttgtttgcttgcttgagacagggtttctctgtatatccttaactgtcctggaacttgagctgtagatcaggttggctttgaactcacagagcttcacctgcctctgcctcttgagtgctgggattaaaggcatgagacactataacccagctaagcatgctcggttttttccaataatctattttttattcactttacatcccaatcacagccccggttctcttttcccagtcccacccttaaatatccttccccccattgctctcccccttctgagaaggggagtccctcttgggtaccatcccaccctgggacatctgattgcaaagattctttttaaggtttaggttgtagtaatgattccgatgcatgtatgggacacattgctctttcgttttctttttacttaaatatgtgaactatgctcagattcctcccactgttctgctcctactttgatatattcatacttttctctgaaatatccctgtcttaaccttgatcttaaaaactagattgctttaaacatttactattaatacatacattaatggaaaagttggaacacttataatttctctaaatttttataacaaattctggaggaattttttatttagttttgttgctctgggtattaaaatccaacacaagagccattgctccttatataagaggcactccagcagggctcaatgctgaaataccaggtgaggcttagttttgacctggctgactaaaggcatgtgttcccaaaagagacatttgagcctcacttgggattgagggttatcatcaacagtgaggacacagtagatgaggtaagtgtaagcatcgggaagaaactgaggagaggcaaacaaatgtgtctaccaagacctagcattgttcataacctcaatcttttatcctaaaagcttgacttccctttaagtacataataactgcttatattcatcgaacataaatattcattctccaggattcgaactttttttgtccatctgactaattgatacccttggggaccctcttggttggctcctacattttatggagaggaaaactgagattcaaaagaacgcaacagtgattcaaagttgtttttttttttttttctggtgaaataaccttctaattcagcaagagagtggtgcttacttatcattttgccttacatattccgtgttctttaaacttgggtttcaataggaaggagcatacctttgatttataggttttcacaaatacaaggctatgtgcacatattatttgatttgatttggaaaaaatcataggggaaagtgaaatgtctcaagtcaattatttccagttctaaacctgtgcccctctacagagcaattcactactctgactgccttcttcctgttagttagggtgtttccaaaacaggatgggaggtttcttcctattgcctgcctgtgtagatacttcccccttattctcaacactcagctttcccctaatggcaagcattgcagagctttgttgtattccagagtgtgttcatttgattatacttgctgtttagttctgtttctagtagtctattgcctaccaagggccctccagtttataactgcacacaaccatgaggagaatcatttattataatgtttgaggaaccttctccttttgatagcattttgaatgtttcatggctgtccagtgaaatcaaaatatatcattctgccttcgtttatatgctcatgataagcattggacacatagctcagtaagtaaagtgcttgtctagcaagcgtgaggaagggcctaagttccgtcttcaccaatataaaaagctgagttggatgacatgtgctagtaattccagttttggctcagagacaggtaagaattcctggaacttgccagccagccttgcctaatcagcaaacccatgttcccagtgagagatcctgtttctaaaacccggatggatggtgtcctgggaatgacatctgagattgacctctggtttccacagatatgtacacatatgtacatgctctcctgcacacatacataaatacacagaattaataacttgtcatctgattagtatagaataacaaaatgtttgctcattttgattttacagccttactattttctcttccatttcacaagactctttgtatctcttttcttagaaaaatattcacattgaattcatttgtaccaaatgagtttaaagcatagtaaccctgaagatgtgtttcatttctttgtattaggattacagtttacatggagattaattttttaaatttgtatcatgagcaactggtcattggtaaataatatttttattatgctgtatgacaataatcattttcttagtgtttactatatgaaaagacactgctcattgtaagtcgtcaccatttttatttaaattttatatgtatatttgtctgtatgtacgttagtgtaccgtgtgtatgcaatgcttgtggagatcagaacagggcattgtatatcctgaaactgagattgaaggtggttgtgagctgcaatgtgggtgctgggaaccaaactcaagtcctctgcaagagcagcaagtggtcttcaccactgagccatctctctagactcaccatttccatctagattgtgaggaagctgagatattatggggtcaatgaactagctgcagttcaaatagctagtaagtgagaaactcagtacttggacccagacatttgattcaagaacccatatccttagcctgcatgttcctttattttgtcaatatgtcttctctgaaacatgataattaccacgccctcttaaagaaggtcattatcataaatgtcagagtactgctgatatttgaatattgaatattaaggtatatatccattaaaagacgagacagagctgggaagagatgggtcaattggtaaaatgcttgtcatgcaagcatgagggcttgaagttgcatctacatcacccatgttaagagtctggaacagtgatattcttttaataatcctgatgagtttcagattcagtgagagactatgtctcaaaaaaaaaaaaagatgaaaaagcaactgaaaaagacagccatcatggacttctgggctacacatgcacatacaactctcataacacagccttgatcaaatttttttctcttcaatagacctcaattggtcacagattgactccaaatgatagtgagatttgtttagtcaaacaagtaagccatatttggctataaaacttgcatcaatctgtccttccatcaatatatctagaatttttatctgctcataccatgtatttaggtgctgcagattccagttgtgtgctgagagaatcactggttgtgtttaccttagggaaagctactatatgtattttgcatatttatagttcccatttgttacctgggcttttcattaagttgctggttttagcaatctttcctttcttcctctgtgtttatttagctgtgtgctgcaaatgtatttatgtgattgtttaagtcctatataactttaatttttcaaagtcttatttttaatgatggttcttaaacactttaaccttccatttagcccactacccaaaagaggtagtgggaaagaaaggatatgggggaagtgaacctgtttagaaaggttctttgcagcaactcccatctgtgttgtctggaaattggcagttcaatttataggttagtagcagcagcttgatctacttacagatacttcacagatacagcagccgtccagttccatagagttgggatagtaaacatgaattagcagcagtggcactacctagcagacagagtcaggcctcagcctcagctccagtcagcaggcaagaatagggaggaatgtcagaagttgtaggctgtgcctctctcagtaagtgaagttcagtgaagatcaacaagcgttgcacagctagctctataagcaagcctagctcagcctcggtcactgtccttagagtcctatttataccctccaaacatcacgagtcctccacaggtcttgtctcaacatgtgtcttgtctcagcatatgagtgtgtcttagctgacatcactctgccagtcaacctaaatctgtagaaacagcaagaaagtgcagcacatcaccagaagtttttggatgcatttctctctatggactccttacaaatgtagattaactttgcaacgtaaggcagacccatacatgcttgtctttagcgaagaatccttcatctcatgtcctttcacatgcttgctttagcagaacaccctttcatccatttctgcttcagctaaacgttccttcatgagtctgccttagtttttcacccgtgcctacttcaggaagacagtccttcatgtgtttgccccagcaaaacacagttcaatgcaactgacttcccaaagaacccctaagtttccacttgagtcctacttggatatttggtcaaccccatactgttaaaaccctgtgcatgacaggcactggtatagccccaactatagtaggtcactgagacctagagaatatgtagaaagagtgaagagatcaagccttgcctccctcaggtttgctcttatttgtctgctgatagctttgtggaatggctaacagtgagtaagtgaaagacaaggctaagagttcctagggactctcagcactcatggaggggtcatagaatttaaaaccctctcatggactctgagaaggaccaaagcaagatgagagcctaaagaaagtgggacatgtcgtacgtgagttataacctggcattttcttaattaatgataatgatagccatgtttgtgatttaaatgtaccagtaaggtgtctgagtattttttcatagaagatcttagggatttcaaaacataaagagaaaaattcactaatttgagattatcaatcaaatgtttttcttttttttttcttttttaggtttgatttgtttttattttttctttttccatttttttattaggtattttcttcatttacatttcaaatactatcccgaaagtgccctataccacccccccccccgctcccctacccacccacttcttggccatggtgttccccagttctggggcaagaccaagggacctcttttcccaatgatggccaactaggccatcttctactacatatgaaatgtttttcttatagttaaatatcctttccatgtttaattttaatattttccttatccttcatgcttatttttctctgtgtgtgtgtgtgtgtgtgtgtgtgtgtgtgtgtgtgtatgtctgtgtctgtgtctgtgtctgtctgtctgactgtctgtctgtttctggttatgtatgtgcatatgtgaacaaccctgggtattatcctcatgaatgctatccaccctgtttgatatagggtttcttatcctggagctcaccagttaggcaaggctggctggccagtatacaccaaggatctttttatgactttcagcactgggatatcaaacaaatgctacatttgtggtttctgagtttacagtcaaactcagatcttcatgcttgtggggtaagcactttactgacaaccttctccccagttcaggttggctttcaactcacagtgatttcctgacttagccttctgagggttgggatactgtgaagaatggagtaccacacaggtttgggggttacgtttctaaaagtaattggacgggggggggggggtacacattacaatgtgttgccctttgttcttaatattctttattctttcctttcacatagctacagttttttcatggtaatttaatgtccatctcacagggtcttgtgtgcatagtgtctgtccatgtagaaacccacatcaggccttttctgacaagcctgaacagggtccaaagggtatatcagaagagtagagggtgctggctcagcatttaaaaacacttgggttttcagaggacctgggtttaattcccagcacccacaagggagttttcattgatccataactttcaacaatctataagtccataattacaggggatctgacctcctccagtcactgaatacatacatgatgcatacagaatataggaaaacacatatataataaagtgaacatatctttaaaaacatttttaaaagaatggaaaaatggcaggttttagctataaacaaatatagcagaagaaatctctttgcagtgcttcagtaaaatgatcagttttgcagtcatggtagccactttggtttatttggaatttgatgtgaaaacatagttttctttcctggccccctgtagtagtcatttcagcctattgtctttcttccctattccataccaccttgtgtagtatcataggagcaaataagaactgtgactaaatagaaataatgcttagattttactagggctgacatacatcatggacaaatattttgtgttcataagcattttggatttaggataaaatccattaaaagcaaacatactagtcttgtttttccatttcctgtaagtcaaagtaatataaacctaatctgattgtcttcataaaaacagcattatattaaggattatttctagcctaattcctgactttttaaatagaaacagccttagctaccatttttaatcaactgtttaatcagctggatatgattaatctgaacaactcttgggataaaactgtttaaaatctatgtaaatcaattaacaataacagtcatgtgagaatatgtctaaaaagtcactagacaatgttgctattgtcacaagtactgccttgtttttctgaaattaatccaaaggggtttcttttcatttgaattagtgtacatgtggttatgtgagcatctgtgcaggtgactacagagactagaggtgttgagctccctggaagttggggtcaggtagttgagagcttccagtgctgagccctgaactcaggtccttcaagagcagtatgttctcttaatgttagagctgtctctctagctctttaatcaaaggggttttttttaaacaagtttttaagaaatttgctgagactttgtgctttgctttgtttgttgttaattctctgtaagaaagattttatagaacaaaaagctagatggtgatggtacacatctttaattgcagcactctgaaggcagaggcaggggggatctttgtgagtttgaggtcagcctggtatacagaatgagtttcaggacagccagagctacacagagaagccctgggttaacaacccctgcccccgcccagcacacaaattttatagaacatgttattattcttttgccatgagttgtcctttgagagtaaagctaagtatagtggcacatacctgtaatcccaccactcaaagtggaatcagaagaattagcaggaatccagtgccattctttgcttcctcgtaagtccaacgctagcctgggaaaaataaggaaagtgaaaaaaagaaagtgatgtctgatagttcgaggccagcctggtctacaaagtgagttccaggacaagccagggctacacagagaaaccctgtctcgaaacaaaacaaaacaaaacaaacaaacaaacaaacaaacagatctgaagaatggttacaggtaggtaaagaagtgataggaattttctgtgctaagagaagtagtggaacagaagttctggggcaggaagaagcctaggacttgcctgaaatgggttgtaagaaataaaaaaggtgagatagaggtatagggtaagatatgagattagacaggagagaactagactatgtgtcacaccttgcagaataatttaaatgttttcagattggcatgaaaccattactaaagtaggactaataggactaggtttcattatgtgactattgtctgttattggctgggtcagcttttactgttaacatttacctaactgttcctttttttttttttttttttttggcaagcattcagttaatgttcattctctcccgtaataagctacttgaagacagacactgtaaaatcagtcactgtttccagtattttgtatatagtatgagatcaattaatacgggttaatgaagtgcttcctgacaggagcctgatatagctgtctcttgagaggctctgccagagcctggcaaatatagaggtggatgttctcagccaaccattggactgagcacagggtccctgatgaaggagttggagaagggactgaaggagctgagggggtttgcaatcccttatgaagaacaacgatatgaaccaaccagtacctccagacctcccagggactaaaccaccaatcacagagtacacatggagggacccatggctccagctgcatatgtagcagagggtggccttgtcagacatcaatgggaggagaagcccttggtcctgtgaaggctctatgctgcagtgtaggggaatgtcaggaacaggaatggacttgggtgggttggggagcagggggagtggggaggggataggggattttcagagggaaaacaaggaaaggggatagcatttgaaatgtaaataaaatatctaataaaaaaagaaaaacagtatctgtaaatttatcttgttagctggggatgtgtgtgtttgtgtgtgttggaattcacacaatacaaaattaactatttttgttacatttgtgtgtgtaaacattttgtgtgcatatggaggtcatatgacaattttcgggggtttgttttctcctatcatgtgggttcagattgtcatcagctcaaaattaactctttcaagacaaactttatatttatttagtagtatgaggttaggatatatatcttttgttgctgttttctccatgtttcctgacgtttttcctatctagagaaaattacataaattaaaacttccctcacctttatgtcttgggactagcagtaaattatcttagctatcttgtttgacaatagcttctgagatccgaatttcagaagtgatcctgttatatcaaagaggaaggaatgctgcagagcaaagcaaagcagaatcaaaacctgatgtagggcacaaagagaaaatcaggaggacgtggcaattaaaaggagcccctcaccctagagtcagttgaatgaagtcttgctgtttgtgactgaagaattcagcacactaggtcttagagcttctacaatagagtctcactgaggaaacaaactactcttaaaggtaggctgcattcacagcagtccatggccagcagaaaaatggcctcaaaggcatctttggaggttctttgtctcataatgtcatatcagagctctcttgttatttttaacgttactggcccaatgtatacatagtacagcacacatagtctagtgtgtctctccatccatatgtgcttcttgtgcttttactttggctgttttccttctgttttttttttgttgttgttgttgtttgtttatcctattctgaattttctgttttgtcttaccatatattttattttattataatctcttaagatacctgtttgttgtctaaggagacaggaaggggtctaaatggaagggaagatagagaagaacctggggtggggaagtggtcagggaaggagaaactataattagaatatgttgtaaggaaaaaaatctattttctaagttctggtctataagtatagcagagtatcattaggaatcatttcattgactcttttttttttaaatatattgtattttatttgccagttgtgtttggttctgtcataggtctctgggctgtccagcttctggttcctgaccctccatgcagtgtccagtataggcttcctcttgtgatatggcatagcaagttacaataagactaggtatatatccttatgtcaaggctggacaaggcaacccagttgggggaacaggatcccaaaagcaggcaaaagggtcagacacagtgctcaaactgttagaagtctcacaagaacaccaagcttcataaccataacatatatgtagaggacctagatcagacccttccaggcttcctgattgtcacccctgtctctgagagcccctatgagccctgcttaattgattctgtgggctatgttttcactgtgtcctctacccctctgggtcctgtaatcctccttcttcctcctctttctcttcctcctcctcctcctcctccagcagcagcagcagcagcagcagcagcagcagcagcagcacaggattccctgagctctgcctaatgtttaggtgactctctgtatctgctctgatgatgattgattacactaggctctggtctatgagtatatcagtttatcattaggaatcatttcatcctctaattcaaaacaatcttccaagtaggtttgtctctagatacaatatttttaaatattttataataatcctgtgtataattaaaattcataatttgaaatggcttactattttttaaaattgccctatgtcaattagcatcttttcacttaaaattgcttatacttttgggtgtgagaacatggaagttgttctctaagtggactaaaccattgctctacagtaaggcagatttgagggggcattcttttctatttcacatgtactggttaaactaacattaagtaaaatttgactgtagtgatttacattgatgtctgtaaagcctaaacgaaccaatgaatcttttagtgtacaagatgaatatcttggaggagcttaatgtagtcactttgtgcttacacattttgagaagacattagcatatgagtcttttctggtctgtgccttttaaaatgtttcatatatttctgtcttctttttgcttagaagcctacaaataattttttattccaaaacatttcatgtgcttttgtacttttttttttattttcaaacacttattctctttcttgcccttgaattactcattttattttagaagtcttgactaaattcaggtagccaaattgtacaacagctgaagctgcaatgcaagttttcaatgttagatatgtctgcaaatgttggtcatccccttagagaagatcttctagtcaagctctatgttagtcaagctctgggtgacaaaagccccagtgccagggtgttcccaaagtgtacacagagtgagcagttgctagcagaagggaattaggaccaagatctcctgctgccttgtctctcagaattcaacttcagaagcaaaaacttctacatttttggccaaatattttacttatctacttttggcatgtaaagttagaaatatcacaattttaccatttatctcacttcgtacttttggatgctttgccagaatggcaaattgtgagtggtgtgtgattttcctgccaatagagtccagtatagctataatctaaatgtttggtgtagtaaaaactgaaatggtaccaaatcatatattagcgtgatggcactggagtcttctttagggagaaagtcatatagtcaaataaacatgggaaaggctaatttatgtagttaaaatggttcttttttgaacttttaaaaacttatactatataagtatgcattgtggagccaggaggaatagttatggattgggtttgctacttctataggaacatttttgttaactttttccatgtaatgcacttttgggagaaattgaatagtacattctggtatttttttaatttaattttgtttgtaattcattttttgcactcccctcccaccctccaactgctccatatcccacacctcctcccccacaccccttctccacatggatgtccccaccccccaccccacctgacctctaaactccctggggcctccagtttcttgagggttaggtgcatcatctctgaatgaacacacacccggaagtcctctactgtatgtgtgttgggggcctcatgtcagctggtgtatgctgcctggttggtggtccagcgagagaactcaggggtccagattgagactgctggtcctcctacagggtcaccctcctcctcagcttcttccatcttttccctaattcaacaacaggggtcagctgcttctttccattggtagggtgcaaatatctgcacctgactcttttagctgcttgttggatctttctgagggcagacatgctaggtccctttttgtgagcactccatagcctcagtaatagtgtcaggccttaggacctccccttgagctggatcctgctttgggcctgtcactggaccttcttttcctcaggctcctctccatttccatacctgtaattctttcagacagaaatagtgatgagtcagatgtgtgactgtgggatggtaaccccattccacatttgatgtcctgtcttcctgctggagatggtctctataagttccctctccctacttgggcatttcatcaaagatccctccctgtgagtccttgaagtctctcacctcccaggtctctggtgcactctggggggtcccctcaacctcctatttcctgaagttgcctgtttccatactttctgctggccctcagggtttcagtccttttccctcacccaataccagatcagcttccacccccctccactttccctccctccccatttttgattgctttcttctctctcccaagtgggactgaggcagcatcctcacttgaacacttcagcttattgagctttttgaattctgtggactgtatcttgtgtattctgtatgtttttttaggggggggtgactaatatccatttattagtgagtacatatcatgcatgtcattttgggtctgagttacctcactcaggataatattttctagttccatccatttgcctgcaaaactcaggatgtcctcctttttagtagctgagtagtattccattgtgtaaatgaagcacattttctgtatccattcttctgtcgtgggacatctaggttgttttcaacttctggctatcacaaataaggctgctatgaacatagtggagcaagtgcctctgtggcatgatgggccatcttttgggtatatgcccaagagtgatatagctggctctgattcaggtagatctaattgcagttttctgaggaacctccagattgatttccagagtggttgtaccagcaatggaggagtgttcctctttctccacatcctctccaacatgtgttatcacatgaggttttgatcttagccattctgactggtgtgaggtggaatctcagggttgttttgatttgcatttccctgatgatgaaggatgttgaacatttctttaggtgcttctctgccattcgagattcctcagttgtgaattcttggtttagttctataccccattttttgattgggttgtttcattttttggtgattaactttttgagttttttatatattttggatattagccctctatcggatgtggggttagtgaagatttttttcccaatctgtaggttgcctatttgtcttattgactatggcctttgctttacagaagctttccagttccataaggtttccacttatcaattcttgatcttagagcatgagccattggagttctctttaggaaatttccccctgtgccagtgtgttcttggcagtttatattttctgtgggttcctaattggcagtcttcaaagacattgagatttaacaaagcaagcaggtatttttaaatttacaaattatttatttttttatgtcttaggatactaaaagttctgtcttttacttcaaaatgcttactgattattgtaaaatcttctaaacgtcttttaagaataatttagccttgggttggagagatggctccatagttaagaacacaggcagctcacaatcatctgtaactccagtccaaggggatctgacaaccccttctgccttccacttcagggcacatagatggtacatggatgcatatgtaggcagaataccaatacacatagaagtaatttcttttaatttatggaaaacattagtctcttggacaagaatgatgacccaggcattaagaatatgttccactctagcagaggaccaggtttggttcctagtacctacatgatgctcaaaattatctgtacttcttgttacaggtggttctttgtcctcttctggcctctgtaaccaccaggcacacatgtgtggtacatatgcatacctgcaggcaaatactcaaaacataacataaaaataaatctttgcctttaaagaaacaataattagactagaatgcacgcctttgatcccagcagcacttagaggaccgaggcaagtagagctttgttaaggtatagggcaggtctacatagtgagttcagaccatccaggactgcataataagcctttgtctcacaaagaagcaggagaggtagaagactgttttgtctcagtagtgcagaggaagtttaaaaacaaagctttggagaagggaagggagtgcattaattttggaacaatacacaagtaactgtacactatttaccataaagggaaaaataaatactaattttgtggccaagatctcagacagttctaaaacaatgtatattttggacaacagtctccaatggctctatgattggccctcatttaccatctcacaggaggcattgcaaatttaaacctgtgcagggctagtttttcaagttttatattactgtagtttttttaacatctgcaaaaacacattctttgttcacatgactaatttcgagttataaaaggttatctctggctattgagttaatcctactatagtagactttagttagtgtgacctcttttagagagaatgaaattgagtcaagtaacaaaaaaatgttttcctcaggtttcatcctttaaaaacacatgtaaatgtttcccaagaacatgtttttttttttcttttgtttattccatatcttgtcctgaaatccttacttccaggaaacatcctttttttcaagaacagacttttccttcattaagaaccgagcaatgacgttagcaatataactagctaacgtttgtgagtcagaatccagagccacctcccattaagccatgtgccacaatgaaaagatgaaaatctgttattttcctttccttctaaaaactgtgtttgcagtggtgaggaatgaagccaagccttgtttttacttgctaggcaagtactctgccactgagctacttcctcactcaggatctttagacctaacttttggggactgttcaaactaagttgacaacagcaatggaaactgtaactaaaacagaaatgaaataaaaccatgttcataccatcatgttcctcttgcctctctggctgttgtacgttagccagaacttttctttccttatgctgtaatattttttcttttctgatctaaaaagtagttcttgaatgagattttatctcttctaggtaataatattgattgaaggtgcttcccatacccagtggttctttttgctggacattgctgtttgctgctgacatataaaatttttatacctatgagaatctctaaataatgagaattttctactcctaaataaactttcccacagaaaccattttcttatgtcttacatctgttttgtaccgatctttaaagcttggaaatgtaaaattgtagtagttttcttaaggagaaacccagtgattcataacaaataccttctatctcttaaactattcaaagatcagttaaactgggcaggaggcttaagcaggtatatctctgtgagttttaggccatcctgtttctaggccagctagtgctacatagtgagacccactttgaaaatatcaaatatatgtaattaacatttgtgaattgtcttaagaaatataattgtcatcattttcttttttgtttttatttaagatttatttattgctatatgtaagtacactgtagctgtcttcagacacaccaaaagagggcatcagagctcattacgggtggttgtgaaccaccatgtggttgctgggatttgaactcaggacctctggaagagcagtcagtgctcttaaccattgacccatctctccagccctgtcatcattgattattgtagttagagattggggaaggaagaaagaaattttctaagatgaggaaagaatgcaatactgtgccaacatatttgggagggggggggatgttcaaattcatattgccaaggaaaattaggatttttagagaaaagtaataggcagacatgaagtgccataataacagaggccagtccactagagtgctgcttccaaactaactcatttaggtcctcttatggttcctttgccacctcccacagaagtacataaactcctcaactgaaagttggctttcatcctaaattccaggaaactttgaaaggatcacaacttcttaatgatttgcagtcttctctctgaaacttagctgttagaaaatttcgagtcagtatgcagatggcctcatctttttctaacgcctctgaggtttgtaatctgtattttattttgttttcctgttacccaggtttgctctgtccaggaaccttcttcttgctttccttttgttggtgtatttcattttctgaggttattcatcagtacttagctggattgccatcttctctttctttgattttagagcttaactaccattctatttagagtttcaaggtttgttacatgtttagaataaaaggtggtatacaaatatggatagcaagaacaaaaaactttgtcaccttataaagatgtgttcatctctagttatgtatgtattttgtaaggttatatccaagttatgaaagatattactaataaagttaagttactgtggaccattaggaactttgggagactgaggttatagtctttaaagcaacctctgaatcatttttcaaatttctgttaaaattgtgaattacaaaatgcttacagcattttgatccatcaactatattaagtaatcttttaggaaagctgaattttattcatatttctatagctctgagttacttagggtgagggcatggtgtgggaatgcataggatttgttgtttctggtaaaattaaactgttcagtaaatgagattgatatactaaaaagtccaattgaaagcttccaacacagtgttgttcttatctaggttctcacatctgttctttttaagtattgtgcttgcagattagatatgtttgtgtagagcttaatattatttctgatagcagtttctattcagttaaatatactgctaataggtaattcctttggtgtctacaaaagaatttcatccccgtaactgtattttgatcagatgtttacaaatttcagtaaataggaccgtaattaagatcgaaaggcaaagtcaaacaaaacatcctatatgtttactaactcgggtaaaggaggaagaaacagcttgatcacttaagttgcagtaaaagcaaaatgtgaaacatatattcttaagattcattttctggccgggcagtggcggtatacccctttaatcccagcacttgggaggcagaggcaggcagatttttgcgttcgaggccagcctggtctacaggtgagttccaggacagccagggctatatagagaaaccctgtctccaccccagcccttccccccaaaaacatttatttcacattatagctgtaaattaaaattaggattatttgccttggtttgttacaacagaatgaacttggaattgactattgaacagattatagtaattttaaccaagaagctcaatatactgtagtcattttgtggtactatactattcccctccttgcactgctccccacaaatcctgggatagttatctgattttggggggccttttaaataggcatctgaacttttgatcaaatgtcattttttttagcattgagatactgtttttttccatttttagcctgattgtacagttacaatatactaatgtttcaaggaagaaaatagctttggttgaggtgtgaatagtttaaaaccatttgcatatcttcagtttattttaatttagtttatatgtttattttatgtgtatgtgtgttttggctgcctgtatgtctgttcgttgagcgcatgcctggtgccaggggaagtcaaaagagtatgtcagatttcctggcaggagttatagacgattgtgtgctgcccaatggcttttggaagaatacccggtgctctcttaactgctgagacatctctccagctcctttcaagttttaattggtatttttcttagcttttatttattataagaactcaaagagaggagtccaaccattcagaacaattatgtaattatcaaggataacatctgttaagatcatttgctaataagacagatagctttgcattatatcagtgcctgcaagtttcattattaatgatctgaatggaagacaagagacatacaaaattgaagcatcaaacaaaattttcattttgtgaacagtttgaagtggtttgaaaagacattgtttaataatgacttttttttggattttaccatgtaaaatgaaattattcaaagtattgtaacctgaagaaaaaatgcaggcaggattatgagtactatattgaaaatttataggatgatagttgacaataagcataattttaatacagtaaggtagcagtaattttcaggctcacttatgtattttttccacctataaaacatccggaaaaatattaagcaataggcccatatctcagtgtgaatgtaaaggtgatacatggtcaggattaataatcacagatatatatgtctaggtgatatatttaaatttaccaaacctgaaaaggatggcaaggtatgctttgtttccactccactgttagctcttgtagttacaattttctattgaggctcttacttatccagtcaaaggtctgaatgcaagaaacaaattatacttccagtggctttccttttaaagtgaatatcaaagccataggccaaatagaattataattgagattagctcaatttttgctagtttgcagtttttgctgttttgagtgattatttttgatataaatgtgtgtgtgtgtgtgtgtgtgtgtgtgtgtgtttcaaacactatttaggcataggaaggtgatttttgtttgctgtgacggggttctgcattgcccagccagcctacagtccccatttttcctgcctcccaagtattgacccgggcaggcgatttttatcatgagaaagaaattgaagctttattcttggctatgctatatgttctgagtgtaattttaatgtttttacagttataagaatactttttaagtagtgtttgtgccagtacaatagagtctgtgctagcctatttaaggcttaaaaaaataatgtttataagaacattttgatgggactcaatccaacacaagatggactcataaaaaacttaaatgcattaccagtgacaggaattatatactcctacaccaaaactatattgtcttccatccaaataatattgtttcttaatgtttccttcttggatttccctgttttgtcaaaagcacctatattatttaaaaatcacaggaactaacactactgtttttttctaattttttatttatttatttatttatttatttatttacattccagattttattcctccctccccgacccaccctccaactgctccacatcccacacctcctccccacaccccggtctccacatggatgtctgcacccctccaccccacctgacctctaaactccctggggcctccagtctcttgagggttagatgcatctcctctttttttttaaatttttttattaggtattttcttcatttacttttccagtgctatcccaaaagtcccccataccctcccccccactcacctacccacccactcccacttcttggccctggcattcccctatactgaggcatataaagtttgcatgaccaatgagcctctctttccactgatgaacagctaggccatcttctgatacatatgcagctagagacacgagctccggggggtactggttacttcatattgttgttccacctatagggttgcagatccctttagctccttgggtactttctctagttcctccactgggagccctgtggtccatccaatagctaactgtgagcatccacttctgtgtttgctaggctctggcatagtcacacaagagacagctatatcagggtcctttcagcaaaatcttgctactgtatgcaatggtgtcagcgtttggaggctgattatgggatggatccccggatatggctgtctctagatggtccatcctttcgtctcagctccaaactttgtctctgtaaccccttccatgggtgattgttcccaattctaagaaggggcaaaatgtccatactttggtctttgttcttcttcagtttcatgagtttcacaaattgtatcttgggtattctaagtatctgggctaatatccacttatcagtgagtacatattgtgtgagttcctttgtgaatgtgttacctcactcaggatgatgccctccaggtccatccatttgcctaggaatttcataaattcatcctttttaatagctgagtagtactccattgtgtaaatgtaccacattttctgtatccattcctctgttgagggacatctgggttctttccagcttctggctattataaataaggctgctatgaacatagtggagcatgtgtccttcttactggttggaacatcttctggatatatgcccaggagaggtattgcgggatcctctggtagtactatgtccaattttccgaggaaccaccagactggtttccagagtggttgtacaagcttacaatcccaccaacaatggaggagtgttcctctttctccacatccttgccagcatctgctgtcacctgaatttttgatcttagctattctgactggtgtgaggtggaatctcaaggttgttttgatttgcgtttccctgatgattaaggatgctgaacattttttcaggtgcttctcagccattcggtattactcaggtgagagttctttgttaagctctgcaccccatttttaatggggttatttgattttgaaggagtccaccttcttgagttctttatatatattggatattagtcccctatctgatttaggataggtaaagatcctttcccaatctgttggtggcctttttgtcttattgatggtatcttttgccttacataagctttgcaattttatgaggtcccatttgtcgattctcgatcttacagcacaagccattgctgttttatttttttattaggtatttatttcatttacatttccaatgctatttcaaaagttccccacacgctcccccacccactcccccactcatccactcccacttcttggccctggcattcccctgtactgaggcacataaagtttgcacgaccaatgggcctctctttccactgatggccgactaggccatcttctgatacatatgcagctagagacacgaacgagctccagggggtactggttagttcatatttttgttccacctataggtttgcagatccatttagctccttgggtactttctctagctcctccattgggagccctgtgatccatccagtagctaactgtgagcatccacttctgtgtttgctaggccctggcatagtctcacaagagacagctatatctgggtccttttagcaaaatcttgctagtgtgtgcaatggtgtcagcgtttggaagctgattatggggtggatccccggatatggcagttgcatctcctcttaaatgaacacagacccggcagtcctctactgtatgtgtgtgttgggagcctcatatcagctggtgtatgcttcctggctggtggtccagtgtttgagaaatcttggggttccaggttaattgagactgctggtcctcctacagggtcacccttctcagcttcttccagccttttcctaattcaacaacaggagtcctctgcttctgtccattggttgggtgcaactatctgcctctgactcttttagctgcttgttgggtcttccagagtgtaatcatgataggtccctttgtgtgagcgctccatagcttcagtaatagtgtcaggccttgggacctccctctgagttggatcccactttgggcctgtcgctggaccttcttttccttaggctcctctccatttccatcactgcagttctttcagacaggaacaaatatgggtcagagttgtgactgtgggatggcaaccctgtccctcacttgatgccctggaggtaggctctacaagttccctttccctacttgtcaagcctttcatccaaggcctttgagttctgagagtctctcacttcccaggtctctggtatattttggagggacccccaacttcctacctcccaaggttgcctgtttctactctctctttgccctaggggctccagtccttttccctcacccagtaccagatcaggttcccctctacttcccaacccccagtccacattccttctaatttgtaggttgccaatttgtcttattgactatgtcctctgttttacagaagctttccagtttcatgaggtcccatttatcaattcttgatcttagcgcatgagccattggagttctgtttagaaaacttcctcttctgccaatgagttcaaggctctttcccaccttctgttagattcagtgtatatggttttatgttgaggtacttgatccatttggacttgagctttgtgcaagatgacaaatctgggtctattttaatttttctacatacagacaaccagttagaccagcaccatttactgaagatgctttcttttttccattgtatatttttggcgtctttgtcaaagatcaagtgtccatacgtgtgtggttttatttctgagtcttcaattctattccgttgttcgacatgtctttctatgccaataccatgtagtttttatcactgttgctctgtagtaaagcttgaggtcagggatggtgtttcccctacctgttcttttattgttaagaattgtttttggctattctgggttttttgcctttccagatcaatttgagaattgctctttccgtgtctttgaagaattgtgttgggattttgattggtattgcattgaattatagattgcctttggcaggatggccatttttactttgttttggttgggtccttgtgtggtttaggtaccagagtaattgtggcttcatagaacgaattaggtagtgttccttctgtttctattttatggagtagtttgaggaaaattggtatcaggtctttgatggtcttgtagaattctgcactaaatccatttggccctgggctcttttgggttgagaggtttttaatggcttcttctatttccttatgggatggatgtgggcctgtttagatagttttcttgctcttgatttaactttggtatgtggtatctgcctaacagccatccatttcatctaggttttttttagttttgttgattatagggttttatagtaggacctgatgattttttgaatttcctcagtttctgttgttatgtctcccttttcatttctgatattattaatttggatactgcctcttggccctttagttagtttggctaggggcttatctatcttgttgattctgtcaaagaacaagattttgtttttacatatactagagcattagtttgggcgttctagattcagtgaatatatatatatatatacatatgtatatatatattatatatatatatagtttatatttatatttatttatttattttggttttcccgagacagggtttctctgtgtagccctggctgtcctggaactcactctgtagaccaggctcaaaagaggtacaagaagtattagaaatatatttctaactgactttagggcagtagactgtgcaagagcattgggaaactcttataaaatcaaagaatgatagtttctttgtagaaaagtgtgatcatttcattaataggatttgacttctaaagttataagtaattatttcatgtttagaaataatttgtattgtgtgttctattctctgatatgttagttgacacaatgatcctcagaagttttataataaataaaatatttccagcctattatttttataagttagagttttgagctgcatttggactatggccgaaataatatggctggcaataaaatgcagtgttgtttgtataagatgccctccaaaatttcatcaaatgagttgacagaaggttgattaattttaccacgtgttttaagggaaccaaggaattgcaattagttgctcaactaatcaaacgggatccagatatctataaacccttttgcatttgtgcagttagttttgttttaaggtgttctgttttatttcgggtttttgtttgtttgtttgtatttgagaccaggctggcctcaaactcctgatagtccttttatatacttatatacaagtgtgaactaccactcagcctattataaacttgctttataggtgtttttgtcggggtttctattcctgcacaaacatcatgaccaagaagcaagttggggaggaaagggttttattcagcttacatttccatactgctgttcatcaccaaaggaagtcaggactggaactcaagcaggtcaggaagcaggagctgatgcagaggccatggcgggatgttcttagtggcttgcctcccctggcttgctcagcctgctctcttatagaacccaagactaccagcctagggatggtcccacccacaaggggccctcccgcttgatcactaattgagaaaatgccccacagctggatctcatggagacactctcctttctctgtgataactccatcctgtgtcaagttgacacacaaaaccagccagtacaataggggatgagaagatgaagaatgtgacaatttgaggaataacaaatgagtttaggtggatggatgtgtctaggacttacactgtgcttaataaattattgtttgggagaattgaatgggcctgcataggaagtagacaaaacttgtgtcaaaaatctgttcaagtatagtttattattgaatattctgtcctgaaaatatgagattagttaaagaaaatacacagaaaagaataattgcaattactttcttctttggagtatccagcacagcatcagagtaaacactcttacaacatcttttcacgagcattattattaaattatcagcatatcatagtgctatattttgaggtaaagttctctagatgcctttaattgctttctgtaactatattagaattgtactgttggctttagaccagttcgttcaaacaatagttttgctaggataatttgttaacctggtaagagatttgtggattttcatttctagacagggtttttaccattccctgttcctccgattcaccagaattctaagcttggtaaaaacatggagaaacatggtgaaaagctgaccttttccttctttcttggctagtgtgctggagaagagaaacgagttggtacacgcacagtgtttgttggcaatcatcccatttctggaacagaaccttatattgcgcaaagattttgtgataatagaatagtctcatctaaggtaagtttgttttttttaattaattatttacaacccaatcacttctccccagtttcccctcacataatccctccccagtaacccctcttctcctctgagaggattccttcctcccacaccctatatcacccaaccctggagcatcaattctctgcagggtcaggtgcatcctctcctactcaggccagacaagatagccctgttgggaaacagattccatagacaggctgttgctttagggacagcccctgctccagttgttgggggacccacatggagactgagctgcacatctgcaatgtatgtgccagaggccttgctccagcctatgtgtgtcttttggttggtggcttagtccctgagagctcctaagggtccaggttagttgactctattggtcttcctgtagagtttccatccccttcagggcctgcaatccttcctccaaaagagtccccaagagccatctactgtctaattgtgggtgtatgcacctgtctgaaccagctgttgggtacagcctctcagggacagttatgccaaactcctgtctgaaagaacaccaacatccttgtgtcagggattggtgcttgtccatgagtctcaagctaagctggttgtttgttggccattccctcagactctgctccatccttatcctcgaatttcttttagacaggaaaaattctaggtcgaaacttttgtgggtgggttggtgtccttatccctccactgggggtcctgcctagatacaggagtggcctcttcaggttctattttcccactattaggcttaggtaacccctatagtcttctgggggcttcccccattacaggtgtctggaacttcctaggaatctatagaaagtcttaaaaaaaaactcatgagaagttcatacaaagttggatatattcatttatgcttctaaagatgctgatgcatttatatatgtatacacacatggtcatgtacaaatcagaatgccaactgtgataattaataccctgaacagtaatttactttttaaaaagcctatcacttgcctcccattatgattcacagtgcctgttgatggtgcatattacttcaggccttaaaatgtgctacaagtaataattattgtgctggggagaggtgtttctcagtggtagagcatttgccaacatgaggacttattaattatttacttgtgtagagctttctgagttgcccttgaaaggattagactgtaccggatttacattcttctggagggtgcttagtgacttccatttgcatctctcctctcctccatcttgcttctgacttgtgattctaggtcctacagggtacattttgcctgtatattgcttggcctataaaatttaaccacaataggcatggcactttttgaataatggtcttagtttagtatggtctaagttgagagcagggtcctacaagtttgagtacttgtatttaaatcttgacaaagtatttattagctatatcaccttagttaacttaatgaatgcagcctatgaaatgactaatacttcatagatggaagcacttcttacagctcctagcacccagtagtcatcactctgctagtataatttactgatctttattgctggccaaccaggaaaggtgctagaatagtagatacctggtttactacagtttcttatagcaaggagcatagtttgataatgttcttgacttccaaatgcagtctggcaagagagagctaaaatgttggtgacatttaattcagtgcacatctgcagtgacttaggctctaaaattcttcctttaacaatatagcatattcttatattcaaatattcctttagtttctcctttaggcaatggcataatggagattattttcagttcaaatgttaatatgtaaaatataaacagaagcactcagctctctgggttctaggacagctgggattgtattgagaaagaccttgtatctataaaaagaaagaaataaaagattaagatgtaaaatatgaatgtgaaactgagaagcccaatgaacagatatgtatgtaagcctgtagaacactgtaacaatcagataaaatgctgattttctttttctcttacacattgttgcagaacttttagtcacagtcaggagcttatatacttgtatgtggggtagtgaatagtcttttcagtatagattttgacttactctatgttacccaactaagcaatcagttatagacctttggctcagaatcatagacacaagaactaaaaagtcatttgaggttcatcttgttgacttagagatagagaaacttaacccagagaaagctcccagtttgataagcaagcacttgagataaagccagcaacagaactactgtgtaaggccctataactttgaagaaaaatcccttttcatattatgctgtttgtgtaccatcctcagctttcttttctcctccatcaatatgaaagacttatgacgttcgctagtgtcctatctgtgcgacagtaaagagctgtgctgcgctggtggggactttcactactgagtggtgattctttgttgcactttagtcctcaggctttatggatttagtggatgctttttcaaagtttatataacatccagttttgccagcatctaaagcaatgcaataacatgtttttgtgttttaaagagcatgtgagagagttaaaatgctatttctaaacaaaaccaccatacagatgtgaacattttgtacacagaccaagatacctctaggcaccctcctctgaataccatacatatagtttttctaattaattgttttattttttaatgaaaactgttgagctatacaaagaagaattgacaatacagtaatttcagaaagaaaggctgacctcaattcatttgtgtatgtgtgtgtgtgtgtgtgtgtgtgtgttgctactacctctcaagtgctaatgttatagacatgcatcactatactaggtttagaaagaaatggtaatggtagtgtgtgtttttgttgatgaggacctcatttctgtggttttgggggggttgtttgtttgtttgtatttttgactttgttggctttcttttgtcttactatatagctctagctatccttaaactcagtctgtagaccagactgacgtcaatgtcacagaaatctgcctgcctctgcctcccaagtgccaggtttcaaagcatgtgctaccttacccagtttagaagttctgtgaggaaggtagagtatagtaagtatacttactgcctacagaaaagagagtagataggaacttgaatacagtaatttagccaactgagcagttaccaatataaaacttactgacaattaatcttacttttctattctattgcatccagatgattctactaggtagggatggttgtgttctttgtgcagttcagtttactgataactttataagttactttttaaatagtatttcatttttacctgtgtccctgtccctccttttttgttttttgtttgtttttgacaaggttttgttattttcccctatgttggcttgcctatgtagttcaggctgtccttgaactcctggcaatcctcctatcttaccttcctgagtggaaagattacagatatgtgctgacatacctgcctttgtttaactgttgcttgtattattcaaaatattagcgcttcatcctccccgtcagcagttttattgctaagtgaaaaacttggtggacttaacataaaaacggccatttccactctcttctctggagcttgggataaaacataaaactacagctatgctggataactactcattcactgagctataccacatacttcgggcacaaatcaaataaagcgcaagccttcagttgcttagttcatattcacttcagcttacctacttttatatttctagatttatttgatagaaaatttggttttagttgtgtttagatggtagatgtttgagtcagtaacacaacttttgatataatacaagttttagaagctctgagtgtgtgtgtctacctctaccaattatttaacacactacaaaataagtgaaaatacttatcataaaaaatatatgcagtgctagtattttatgtagaaacattttaaagcatattcttaaatctttggactgatttttaatttcatggctccatattaaaatagtttaaggaaaaacacctcaataattaagagcatttgcttgtcctggcacccacatgaaggcttaggcaacaggtacatgcatagtgcatagacatacattcaggcaagatacctgcatacaggaaatataaatacattattttttaaatagcacaattatcttcttggcaagaacttaggacagaaaattcattttatcactatatttaaaacaactactatatgtgctttcttctgtgattggcattggttttgtttctgtagcagcaaaccaagtctgagagtccagtttttagataaacaagtgaactttaataacttcatgtatatgtctaatgttccattttgtttctgattagaaaactctttggaaatgtttttctttcagtagtatgattttgtttgtttgtttgtttgtttgttatgggtgatctgtcttcacatacatccagaagagagaatcagatcccattatagatggttgtaagctaccatttggttgccaagaattgaactcaggacctggaggagcagccagtagtactcttaactgctgagccatttctccagcccaatgtttcttaatctgtgctaatattggttttagtttatagaacagttgagtgtttcttaatttactttttttcttttacttattcacgttgcatcccactcacttcagtgatttaaatggccagatggccagtacacaaagtttactgtttttttttttttttggattgatttagaggtatcagttgtcttttaacaattgtggttctaggactcggcaggccaaagcaggaggattgccctgagtgtgagattagccttagctgtaattagaccctgctcaaaacaaacatcctcatgtttcttgtcaaataccatgtcggacagttatggtaaaggaagttataacaccctgaggtcttatctcaggtccttatgaagagaagaacactggtttccaatgaagagactaacaaaagttcggaaggaaactgctaatttggtacagtaaaacggtagcagggcgtggagtgtacctacttcagtagtgtaggtagtggtatgtctttgtaaagacctgattgaatccttagtattgtaaaacaacagtagtgataagaggactagatcaaaaaaaggttccctttgatctgttaatactacctgtattaagtaaggacttttgcggggccttaatgcgtatttgtttagtttttaaaaaacaaacatgtagtttgagaacagaaggtcagtgtcccagaagtccagctgttagtttgactttactggaatttatccttcatttatttatttacttgaaattggtgggacagttaaattctggttttagattgtattgggtttccaagtgacaatatcaatgcttttaaatgcttattttctttttttagtcacaagccactttgagaataccattaaaaaaagtgtgaattatttttcccaaatgctcagtccgcacttgggaagtttttggatgctctgttgttgattggttggttggttggttggtttctggcaaaatctcattcaggaagacctgaaactcataaagatcctcctgcctctgtgtctcagtgctgggttttaatgtgtctttggcatttctgtgtttactttaaacaacatgtttattttgttagtgtgccatctcccaccactctggttctctttgaggtacttattttgaaccttagaaataatgttttgttggctattgattgttttcttagttttctttctattactgtgataaaacacagtgaccaaagcaatgtgagaaggaaagaatgaactttaccttacaatttatcctcacaaatggaaatcaaggcagaaactcaaggcaagaacctggaggcaagaactgaacaccttgtatgaatgcagcgtactgacttgttcctcctggcttgctcagtttccttgcttgcttatacaccccaggaccacctgccctgggatggttaaagttagtctggtgagggcgttttctcaattgaggttcctgtgtttcaggtgactctgtcttgtgtcaagttgacaaacaacaacaaagaaaccaaaaacaaaaaaaacaaaacaaaaacaaaaaaaacacactgtccagcacaattatgctctagctgtccatttgacttctttctctttagattctctgaatcttgagaacttctaagccttgtttaaaggaggtgttgtggccaacaagatgtcacagattgtaaaggggcttgctatgtaagtttggcaacccaaatttgatacctgggacccacataagggtttggaaggagaaaaatgatgcctcaaaagtatcaactaagctccacatgcacaccatagtggattcactaccttcctagccacaaaataaatatttaacattgtttaatataaatttaaaaattttttaagttattagcagtaaattcccatataccttgacatgctctaagactttggctttccatctagagactgccatatccagggatccatcccataatcagcctccaaacaatgacaccattgcatacactagcaagagtttgctgaaaggaccctgatatagctgtctctcatgagagtacacaggggcctagcaaacacagaagtggatgctcacagtcagctattggatggatcacagggcccccaatggaggagctagagaaaatactgaaggagctaaagggatctgcaaccctataggtggaacaacattatgaactaaccagtaccccggagctcttgactctagctgcatatgtatcaaaagatggcctagccggccatcactggaaagagagacccattggacttgcaaactttatatacctcagtacaggggaacaccagggccaaaaagcgggagtgggtgggtaagggagtgggggggagggtatgggggacttttgggataccattggaaatgtaaatgaggaaaatgcctaataaaaaattaataaaaaataatttaaaaaaagacgttggctttccagcagctatatccgtggatatatctcgtgacatgcaaatgattggaatagtgactttccaagtataaattcagacttttgccttaaaaggatctttttcattctagttttaagtcttctgtattataatatgtcctacttctgatatttttgaattggcccagtccttgagcttaagctgttattaacaaattacatggtatgcactcaatttgtgtatttgcttcttcatctttgcacatattctcagataggtggtcctgatagagacactgatctgaacttagtgtcttgacaaagttaaacttgacttttgatcagaaagatgagctactaacaaaggtggaagagcaaggacctaggacaagttcacttgctttgtcttctactggagatggcagctgtcttcttcccgttgcttagggtttggcctcacagtctatggtgaatggctcatttttaaaaggggcttacaactctgcaaacaaaagttttaccaaggcaggttgagagatgaaaacatttgcatagggttttacaaagtgggggagataaaatgattggaactctttaatgataagtcttagtgttttcagaaaaaggctaatatgtaatgttttgtccaatattgattgctatcaaaatatatatactatgagagcatatggcacgtgtcttagtcagaatttctattcctgcacaaacatcatgacaagaagcaagttggggaggaaagggtttattcagtttacacttccacactgctgttcatcaccaaggaagtcagtactggaactcaagcaggtcaggaagcaggagctgatacagaagccacggagggatgttctttactggcttgcttcccctggcttgctcagcctactctcttatagaacccaagactaccagcccaaagatggtcccacccacaagggccctttcccctttgataactaattgagaaaatgcctcacagctggatctcatggaggcatttcctcaactgaagctcctttctctgtgataaccccagcctgtgtcaagttgacacaaaactagccagtacagcacggaatttgttttagattgtgttggactattaaaatgtaggactaagatgcctaatagaataatagaagcagaaggtaccctacccaattcattctatgaagccacaattactctgatacagagtagacccacagaaagacccaacaaagatagagaacttcagaccaatttccctgatgaatatcgatgcaaaaatactcaataaaattcctgctaaccgaatccaagaacacatcaaaacaatcatccatcctgaacaagtaggtttcacctcagggatgcagggatggtttaatatatggaaatccatcaatataatccactatataaacaaactcaaagacaaaaaccacatgatcatcttgttagatgcggagaaagcatttgacaaaatccaacacccattcatgtaaaagtcttggaaagatcaggaattcaggcccatatctaaacatgataaaaaacaatctacagcaggccagtagccaacatcaaagtaaatggcgagaagctggaatcaatcccactaaaatcagggactagacaaggctgcccactttttccctacctattcaacattgtacttgaattcctagccagagcaattcgacaacaaaacgagatcaagtgggatacaaattggaaaggaagaagtgaaaatatcactttttgcagatggtatgatagtatatatctaaatgaccctaaaaattccaccagagaactcttaaacctgataaacagcttcagtgaagtacctggatataaaattaactcaaacaagtcattggcctttctctacataaaggataaacaggctgagaaagaaattagggaaacaacacccttctcaatagtcacaaataatataaaataccttggcatgactctaactaaggaagtgaaagatctgtataagaacttcaagtctctgaagaaagaaattaaagaagatctcagaaggtggaaagatctcccatgctcatggattggcagatcaatatagtaaaaatggctatcttgccaaaagcaatctacagattcaatgcaatccccatcaaaattccaactcaattcttcaacaaattagaaagggcaatcggcagattcatctggaataacaaaaaacctaggagagcaaaaactcttctcaaggataaaagaacctctggtggaatcaccatgcctgacctaaaactgtactacagagcaattgtgataaaaactgcatggtactggtatagtgacagacaagtagaccaatgtaatagaattgaagacccagaaatgaacctacacacctatgatcacttgatctttgacaagggagctaaaaccatctagtggaaaaaagacagcaatttcaacaaatgctgttggcacaactggcggttaacatgtagagaaatgcgaattgatccattcctatctccttgtactaaggtcaaatctaagtggatcatggaactccacataaaaccagagacactgaaacctatagaggagaaagtggggaaaagcctcgaagatatgggcacaggggaaaaattcctgaatagaagagcaatggcttgtactgtaagatcgagaattgacaaatgggaccacataaaattgcaaagcttctgcaaagcaaaagacaccatcaataagacaaaaaggccaccaacagattgggaaaggatctttacctatcctaaatcagataggggactaatatccaatatatataaagaactcaagaaggtggactctaaaaaatcaaataaccccattaaaaatggggtgcagagcttaacgaagaattctcacctgaggaatactgaatggcagagaagcacctgaaaaaatgttcagcatccttaatcatcaaggaaatgcaaatcaaaacaactctgagattccacttcacaccagtcagaatggctaagatcaaaaattcaggtgacagaagatgctggcaaggatgtggagaaagaggaacactcctccattgttggtgggattgcaagcttatacaaccactctggaaatcagtttggtggttcctcagaaaattggacatagtattacaggaggatcccgcaatacctctcctgggcatatatccagaagatgttccaactggtaagaaggacacatgctccactatgttcatagtagccatatttataatagccaggagcttgaaagaacccagatgcccctcaacagaggaatggatacagaaaatgtggtacatttacacaatggagtactactcagctattaaaaagaatgaatttatgaaattcctaggcaaatggatggacctggagggcatcatcctgagtgaggtaacccaatcacaaagaactcacctgatatgtactcactgataagtggatattagcccagatacttagaatacccaagatataagatacaatttgtgaaattaaaaaagaacgaagagcaaagtgtggacactttgccccttagaattgggaacaaaacatccatggaagttgttacagagaataagtttggagctgagatgaaaggactgaccatctagagactgccatatccggggatccatcccataatcttcctccaaatgctaacaccatttcatacactagcaagattttgctgaaaaaaccctgatatggctgtctcttgtgagactatgccggggcctagcaaacacagaagtggatgcccacagtcagctattggatagaacacagtgcccccaatggaggagctagataaagtccccaaggagctgaagggatctgcaaccctataggtggaacaacaatatgaactaaccagtacctccggagcttgtgtgtctagctgcatatatatcagaagatggcctcgtcggccatcagtggaaagaaaggcccattggttgtgcaaagtttatatgcctcagtataggggaacaccagggccaagaagtgggagtgggtgggtaggggattgggtaggggagggtatgggggacttttgggatagcactggaaatgtaaatgaagaaaatacctaataaaaaaagaagtataaaaaatatctaagtaaaacactgttttatataatacctatgattcaatataaatataattgataaatctaaaaaaaacttctcaatgaaccgtcatttctgaaaaaaagttctctatctctaaatatatatgcaaataatctatattatataaatataaataatatatgccatgtaatgtgttattgtgttttcaattgttggatatactaaatacactttatatggttctaagatttttttaagtttcttttttaatactgcttttgattcttatctcttttatagtatacactttggaatttcctccctaagaatttgtttgaacagtttagaagaattgcgaatttttatttcctcatcattttccttgtacaggtaagaactccatgaactgctactttaacatggagaaattttgttctttcaaggaatttatcttcttaaattatcctgtgacttaagagatttgcttagtttttaaagtagaaatacaattgcacttcaaaagtgtgtaatgttaaagttttctaaagttgtattttaaaacttgttgagatttttattgctacttcaattttcacagatttaatatctggtcttagagtatacattgtattacagcttagtgatttagcatatatcaaaattgaatgtagtttgagtttaattttgttaaagaggtttagcttattttttttgagtcctgctttctctgtgccccactcacctgcttgcttgtggtttgaaagtctaataagtcaacgtgcttctcagcattccttctactgctttctattttaaattttagtcatttttaaatcatatcctatattttgagctgcataggttttatattttttcattcatttataaaatagtaactgtaatgatactcctcatctttttaaatgaagcagaaaaatgactatgaagttgctcagatgctttggtaactttgagagcttttgtttaagaactctgaggctttgactaaatggtatgataatttaacttatgcctgcctgctccttgaaaccagtctggaacaagtaaatttcagtagaaagatttttttaaaagtttctttataaataatacttttgattcttacctcttttatagtgtacactttggaatttccttccaaagaatttaggagagagtcaatttcagtagtaaatgaggtgtttaggaatgaactcttatatccatggtcagatgtcttagaaacatgaactacaataaaaaaatctttttgaatgagtaattcagtgtatttaattaaattcatttgaacaaatatatgccgactgcctattgtgtattgtgcactagtccccaaaacaaaatatgatcaaaatactgcttttctctacccttaaggaatttataacaacgttgtattttcacttaatttaatgtagtaaaagccattaaagattcagcaaactactaaaactatgccatgaaagttaaaataaattttaactgaagaagaacttaaaagggcttcaaaagtgcatgatagttgaactgaattttgaagaggtttctgtggcagataatgcaaggcaagcatcccaggaatagagaggaggttgcataaaggccttgtaaaagtcttctgtgtattcctctgtgtgtcagggataggtctggctggatgttggagatgctagtgtaataatggaaaggcagattgtagcaaaaatcccatccccaaatctagttctccttccatttttctttctttctttcttttttttagattttttttattaggtattttcttcatttacatttccaatgctatcccaaaagtcccccataccctcccccccactcccctacccacccactcccacttcttggccctggcgttcccctgtactgaaaagtttgcatgaccaatgggcctctctttccactgatggccgactaggccatcttctgatacatatgcagctattttagtaaaaacagcattcactcaagcatgttaaccaagcacttgcaagacatctactatccatagttatagctcattacttaccaatggtaccgtctttctttctgaatatcttcagtatttctttccatatttcttctaccctgatctatctttcacttgtctcagggcaatagcctcccaagtagactcctagcctccatctttattcttttttagtctatccttcatacagcattgagaataaattttcatgttatcattctctgtgtaaaatctttcccattgtggaatgaatagttaacagccaacagctttctctgtatggtttgactcatgcctgcctccccagcctatctcacaccacacttttttagcactatttttctttatttccttgaacacatgtcacttccccttctaaaagagaaactttgtgtacattgctcattgtacctggaaaagttcctttgagctagttaactcctaactgccccacagatcttagcatctgtatgctagttttatgggaaggcacggacttctttctttcttcattagccaagatctctagaggctggatggtaaaagtacagggccttgcagaatgcttctcagatattagctggtaaatcaacgtgaacattgctgaaaatgggatcatctaagctgggtgaaaactagtgctaaattttcttaaactgttatatagattgttttattataattaaaattaatattcatctcactagtagaatatattttatctaaaatatttgcagcatataaattctaaacatgagttaatagctaattttattttcaatttaatttctctacctaggtcacagtagacacaccaaccagcccagttaccagtggacttccactttttttcgttataactgttacagcaatcaagcaggtaaatttctcacataaactatgcctgtcctttaatgaaagctaatttgaattttcttgtaagtattctttttcatatttatatactgtggacaatattttgatggttttagtttatatttgattcctgttgaaaacctattaaagtaagctgataataacatttttaatttatttactcttttcctcgtgtgtgcatgtgtggtgtgtgtgcatgtggtgtgtgtgtgtgtgtgtgtgtgtgtgtgtgtgtgtgtgtgtgtaagatagaagcataatagaaaggacaagtagaaagtccatctcagtagagaaacaggaagtgggatttttactgttcattcttaaaatttcctactccaatgaattttaattgttattgtctatcgtacagaatttaatacaaatacttcaggctagagagatggctcagctgttaagaacactggctgctcttccaagggttcaattttcagcacttacatgatagcttacaactgtttataagtctagttctaggggacctggcattctcacacagacatacatgcaagcaggtgggtggggggatggatggacggatggatgggcggacagacagatagacagaccgactgactgattcaggtaagctggccccgagggcaagagtgcaggagagttggccctctaattttctgtcatgagatagtatgggggcaggggcaaggctctccctacctcccaccgctagtagtgagaactggccctgagaccatgagagttggagggctagtcttgccccctcgaagactgcagcactgggagagtgggccccaaaccctgacttggcagcacattgaagctgactctggagtagtgcatgccagtgagccagctcctgagggcacaagagcaagagaggtgaccctgcctcctgcagatgacagcattgggaggcctagctggagcagtgctagagagcttgccctggtggtgtggataagggagagctggtgcactgactcattgcagtgaacattatttgcagatgaagatgtgtggacagagggataaactgtgggacgcattgtgatgtactgcagtttccacagtgagatgccttctatgctttgggtgtgtgtgtgtgtgtgtgtgtgtgtgtttggggggggggttgggtttttgtttttattttggggagaggttgcaagggcagagggtagatatatgaggcagggtgatgagtggaactggggtaaatgatatgaaactcacaaggattcaataaaaagatttagaaagaacacaaataacttgaacttatcactactactattgagcagggtgatagatagggaagactatctctctcgtcagagttggtaagctctcacagatgatgttgattgtctttgaagtattttgaccattgtgtgtattaatacccttaaaattatccaaataaaattgaaattttcaatagaaaaccttaaatgaggggtgcatttcctatatttagagacagaccgcaggatctgcttatttgcaaacacatttttaggtagtaccttaaggaaacttgtaaattgaaagaaaaaggttacctttcctcctggggttttctgatcctctctcttgcctaccaggaattttataaatatcatgtatttcattgctaaataaagacttggaatgctctttccctttggctaataagattattttccttattataataaatttttagttccaagaatagcatgtatggctttcaaaagggctttcttactgattcattttactcccaatactaggtcatgttctatctttcctttcgtcttaagcaccagagaatgtaccctataaaatgcctagtattttcacgaagagggacagaataggaatgaggaccaaaaaaaaaaaaagggggggggagaaaagttgaccaagagattgttctgttcaagcatatatttgaaaaggcacagatattacaatgaggggcaaaacattggatataaaaaggaggaagtcatgttcaaatgaacatcatgattccttagcccttttagcttaaatctcttccacatgaaaagcccaaaggaaaataaaccattaaatatctctatgattattttttaattctaaaaagtcaccaatttctatttcctttaaataagttagtggagaattttaattgttgtctctataatatgtaaattctctggcaaaacattttcaaaatgttttgaaattttctactttctacatgagaagaattacatttctaagtgattagatttattcaaaaataaaaagtaagaacatttatattttcaaattaaaagagagagctgctggagagatgactcagtggttaatagcactgtgctcttgcaaaggacctagttctagtcctagcacccacatggtggttcacaaccatctggaactccaagtccaggagaccggatactcttttcttgcttccttcccaggcactgcacagatatggtgcacaggtatatatgaaggcaaaacaccaatacataaaataacaatgaatacatttttaacaaagtagaagtaattacaatgttctttaattttttagatacatatagaaaacaaacgcattcattagagcattataagcataaatcgtagattttctcaatgaagaatgttatggctgtaatgcctatgttacctataatatatatctgaagaattaaggaaccttataatacaataaagctatttgcctaaggaatatgtttataaagtgtgccttaaattgtctaagaatatgtgcatcaatgtatctgtagcattctatgttgaaattaacactataaacttaaaatttttcttttcttataggggtatgaagattggcttagacacagagctgataatgaagttaacaaaagtgctgtttatattattgaaaatgcaaagcgagtgaggaaagaaagtgaaaaaatcaaggtactactttactagatcactctcttttaaaactactcttcttcctggtgtgtgtgtgtgtgtgtgtgtgtgtgtgtaatggcatatgtgtagttcagaagacaactttttggagtcagttttctcctgacatgagttctgtggttcagaatcaagatatcctgctggcctcccactcaggataactgcaaaaagtcccacatagtaaaaatgtacacttcaaagtatatgaatagggtggtagtggcttatgcctttaatcccagtatgtgggaggcaagtggatctttgtgagtttggtctacataatgcattctaggatagccaaggctttaccgagaaactctatctcaaccctgtctcttcacaaaagaaagtaagtatacaaattagtatcatttatttacatttacaatgctataaaaccatcactatttacatgagcagaaaaggaaacaccttactcattgtatattatttcttcaacccaagtattgtaaacatgaaccttttcattctcaatgaacttacagttttaatattttacacgaatttgataatacagttcctgaactgtattagaatattttagagctatttgtgttgtagtatatgtcaataattcattgttttgatggctagatgataatatattctatttgtataccactttttttttattcgctagctaatgtttctgtttggggctgctatctatactgctgctctgaacattcaaggacaaggttttgtttgaatatcagttttcagttcttttgggtatatgcctgtgttagtatttttatccttatggtaatttttaatgaaccataaaagtgtttttgcatagagagtgtactctttatattttcagagcaaggtggtatttatattttattcaaattaagcattgtttacttctaccaagtaagagctctacaaaatgacatttatatttgaacatatcaaacatttttggttgctaataggtgtttttaaagcagtaagctttgctgtttacaacagttttatgttcacagcaaaatttaacagaaaaagtctagctgtatagccagtgttctgtcccacaagaatctttttctattatgagcctcagtaaacctcctttggcacataaagtttagtttatattagagttcacttttagtgctgtgaattctatgaggtttgacaaatatatgacattgtaatatcatgcaggataattttactttccctaaaaatttatcttctgtactttctctagctccttcattaggggccctgtatgactgtgagcatccacttctatatttgccaggcactggcatagcctcacaagagataggtatatcagggtcctgtcagcaaaatcttgctggcatatgcaatagtgtctgggtttagtggttgtatatgggatggatccgcaggtggggcagtctctggatggtcttttgttccccattctaagaagaagggaagtatccacactttggtcttccttcttcttgagtttcatgtgttttgcaaactgtatcttaggtattctaagtttctgtactcttttttttttttttttggtttctcgagacagggtttctctggatagccctggctgtcctagaactcattttgtagaccaggctggcctcgaactcagaaatcggcctgcctctgcctcccgagtgctgggattaaaggtgtgcaccaccacgcccggcctctgtaccccatttttaatggggttatttgagttgttggtatctaacttcttaagttctttataaatttggggtattagtcctttgtcagatgtaggattggtaaagatcctttctcagtctgtaggctgctgttttgttctattgacaatgccctttgccttatagaggctttgcagtttcatgaggtcccatttatcaatttttgctattagagcttgagctactgatgttctgttcaggaaactgtatcctgtaccaatgcattcaaggctctttcccactttctcttccctgatatgtagtgtatccggtttttatgttggagtccttgatccacttgaatgtgagttttatgcaggatgataaatctggttctattttcatttttctacatgtagacactcagtgagaccagcaccatttgttgaagatgctttcttttttccattgtattcttttggcttctttaccaaaaatcaagtgttaacagttgtgtgggtttatttctgagtatttgatttgattctcttgatctacctgactgtctctgtaccagtaccatacagtttttatcactattgctctgtacagttagtttgaggtctgggatggtgattacttcagaagttcttttattgttcatgattgttttggttgtcctgggttttttttgtttttccatgtgaagtggagaattcctttaaggtctataaaaaattatgttggcattttttatgggaatcgcattatatctgtagattgcttttggcaagatggccattttcactatgttaatcctacctattaatgagcatgggtaaaattctcctttttctgatatcttcttcagcttatttcttcaagaacttgatgttcttgtgtacagatcttttacttgcttggttagagttaaaacaagatgttttatattatttgtggctattgtaaaggttattgttttccctaatttctttcttggcccatttatcatttttataaaggagggctactgatttctctaagttagttttatatccagtttctttactgaagctgcttctcagctaaaggtcctctctggaattttgtgggttgcttatgtatactgtcatatcatctggaaatagaaatactttgacttctttcttttcaatgtgtatcctcttgatcttcttttattgtcttattgctctagcttgaacttcaagtattatattgaatagataggagagagtgggcagcccagtcttttccctgattttagtgggattgatttgtatttttctccatttaatttaatgttggctattagcttgctatatgttgtttttattatgtttaggtatatgctttgaatccttgatctctccaagagttttaacatgaagggatgttgggttttgtgaaaggctttttcagtatctagtgggatatcatatgatttttttctttcagtttgtttatatcgtggattatattgatggattttcctttattgaaccatcctggcttccctggcatgaagcctacttgatcatgatgaatgatgtttttggtgtttacttggatttagcttgtgagaattttattgagtgtttttgcagtaaggttcataagcaaaattggtctgaagcgctctttatttcttgagtctttgtatggtttaggtatcagggtgtctatggcctcatagaatgaattaggtagtattccttctgtttctgttatgtggaatagtttgagaagtattggtattagctcttctttgagggtctggtagaattctgtactaaaaccatctggccccggggcttttggggggggggggtgtgctgagagtgcttatatttccttgggaattgtaggactgtttaattaatttacctgatcttgatttaactttgtcaagtggtgtctgtatagaaattcatctattatgttaatattttccagttttgtggagtgtagggttttgtagtaagatctgatgtttttgaatttcctcgatttttgttgtgtttccctgttcattttttattttgttaatctggatactatctctgtgccttttagttagtttggctaagagtttttcaatcttgttggttttctgaaagaaatagctcttggtttcattgattctttgtaattttttttctgtgattgatttcagccctgattttgattatctcctgcattctattcctcttgggtatgcttgttttgttttttcttctagagctttttggtgtgtgtttaaattgctggtatgagaactttctaactttatggaggcactgttgaggcttactttgtacctgattatatggttaatttttggagaaggaaccataagatgctaggaagaaggtgtattctttttgttttgggataaaaggttctgtagataactgctggatccatttgattcataaggtctgttggttttattgtttctgtttgtcttctgtttcaatgacctgttccttggtgagaatggggtgttgaagtctccactattatgtgatttgagcttatgaatgtgggtagatgcccttgcatttggggcatagatattcagaattgacactacctcttgttggagttttcctttgatgagtatgaagtgtccttccctatgtcttttgataacttttaattgagagtctattttattggttattagaatggctactccaacttgtttcttgcatctgtttgcttggaaaatctttttttagcactctattctgatgtagtgcctatctttgttgccaagctgtcttcctcatatgcatcagaatgatggattccggttttgcatccattctgttagcctgtgtctttttattggtgaattgagtcaattgatgttgagagatattatgattattagctcctattatttttattgttggatgtgatactgtgtgtgtgctcttttgttttttctgtgagattattaatttcttgtgtttccctgggtacagttacctccttgtgttggaggtttccttgtagtatcctctgctaaactggattaatagaaagatattgtttaaatgtcatttagtcatggaatattttggcttctccatctatggtgattgagagttttactgggtataggagcctgggatggcatcttagggtcttcaagacacctgctcagggtattctggcttttagagtctctatttagaaatccagtgtaattctgataggtcttcctttatgttacttggtctttttctcttgtggcttttcatattatttcttctgaacatttagtgtttcaattattatatggtgggatgcatttttttctggtctattctttttagtgttctgtaggcttcttgactgttttagggaccttttcagtttagggaagttttcttctatgattttattgaagattattttctggcactttgaacttggaatctttactctcctctattcctatcattcttacgtttggtctttttatagtgtcccaaattttcttgatgttttgagttaggaacttcttacatttgatattttctttgaccattatatccacttacttgtatggtatcttctacacctgagattctgtctcctatctcttgtagtttgttggtgatgcttatatctgtagttcctgttctctttcctaggttttccatttccaggattgcctgcacttgtgtttttttattgcttctatttccatctttatgtcttggactattttcttcatttacttcacctgtttgtttgcattttcctctatgtctttaagggatttgtttcctctttaagggtttctacctggttgattgtgttttcctgtttcttgaagatatttatttatatcttctttaagggcctctatcttcttcatgagatgagattgaaggtcagtcttgctcttcaggtgtggtacaatatccattggtttctgtagtaggagggctgcattcttatggtaccatattgtactaactttttgctatttggttgtttctgatattggctggcctggtatcccttgagagtagtaagcctctgggactggctgtcccagatagccgaggacctctggagaggcaagagagctgtggctggagatgggtgtgctgatcctctattgcaggtggaggtgtgggccagaaggaagatggagctctgatatggccaggcagagctcaaagcttcccagcttgtgttcttttttttttttttaaattattatcacgtattttcctcaattacatttccaatgctatcccaaaagttccccacaccccccccactcccctacccacccattcccattttttggccctggcgttcccctgtactggggcatataaagtttgcaagtccaatgggcctctctttccagtgatggccgactaggccatcttttgatacatatccagcttgtgttcttgatggggactggtggctgtttaggtgtggctctctcacctgtgtatcttgggttagagcaggcctcactggaggcatacagagctctaggatgaagaacagagtgctaattcaatattataggtagaggtgtgggaccagaggaagatggagctccaataaggcagggcaggcacattacttaatgttttctttgtatcatttcaaacatgcatcttctgcagtcattgtaatcatctaagacttttacctaaggtcatatcatttagtcacaaatctgagacatgaactagggctttgttctctgcatcattgaatggttcaaggtttcatctctcaaggttttcctcttgttggggttagcatacttgctgataagtgattattattgctctataaagtgattcttctagcttatatgagattttattgttatataaagtgagtcttcttaatagatgaattattggaaagctaaattaacatatggaaaagtccaccactcccatattatattacctgaggttttcaaacactagaaggaaccgaataatcacaactacagacaaaataatgctgacatatatgtggttcaaaatgaagatgtggagggttctgtcttgaagtacctaatttgaaacctataggttttcttgttttattcttgaaatggcaatgataattgtcttattatatgtcaatgccagaaatagcagagaacagaacatggatgtcaggatatttattacacaacagtgctaagatactctgaaagcatactaaggcctatgaccttaaacaaaattctgagtgcccaataatagattcatctctttgcatgtggtatatgatgcttagatactctccaagcctcagatctataatgtctattaacattttagcttaaatgttaggtatactaaatgctttgtttaggatttaaaatatttattctgctgttttaggttggtgatgtagtagaagtacaggcaaatgaaacctttccctgtgatcttatacttctgtcatcctgcacaactgatggaacctgttatgtcactacagccagtcttgatggtgaatctaattgcaaggtaatggagattaaacctgttgagtgttttattttcagaatggttaataagacagtactgtctcctaacactttttagtcccttaactcattttatgaaaggtttgtatttgtagacagctattatgtaattaccttagcttctaagtaaatgcccaattgggagaataggattgtgttgtttgggcccctacaaaagagccattacaatttttgtagtaccacttaaatttaatattgatatagttcaattaacattttatttaggctttttgttagtgtttttgttattgtacttaggactgagatctaggctcacacatgcacagtagaactaccactgaggtacatctagatgtttatagttgagaatacttgtgagctaaaactacataaataccagaatggcttcaagtactataactttttaattgatctacttttatttttaaagaattgtgtaattttgtttaaaagattaattctgagtctggtggaatagctccatagttacgggcactgactgttcgtctagaggcccaggttcaattcctagaacctacatagtagctcacaaaccatctgtaattcaagttctaggagatacaattctctgaccttctccgacaatggggacacaagtggtggacagacatgcttatatcccaaatgcccatatacataaaattagatagatagatagatagatagataggtaggtaggtaggtagatagatagatagatagatagatagatagatagatagatagatagatagatagatgtgttacctgttactatttactgattctgcgtttcaaacacagggcactaaattattggtgtctcaactgttcaaaaactgaattacattttaggaattatcagaataaaatacagaaatctacctaaagattctctaacatggaaaatattgtgtagagaaagaaattttcagttttcttttattcattaagtggtaataaatcagagagcttaaagtcagtcagtagttttaaatttagagcaagaagttctctaatatctctaaagactgtcaccagctttcccttgtacataatacttgaatttgcactaacgtttgctcacagtttataaataggttcattggaccttgtctttcatttggataaattaagagtgttttacacacacacacacacacacacacacacacacacacacacacacacacacacacaaagtgtcttaatcattgaacataagacattcttttcctgcttctatataaaatatacccatgttgaacagtttcaaaatcattacttaaattgtttgtataagaaaaatctgtttgtgtaatggaaccattaatgatttcttcaaatcttcatggggatttcagttaactatatgcatgctacaaatgcaatactctcaactgtcagtttcaaggaaagttttaagttgtttttcttttccctttgaaatccttttgaggcagagataattatctagttgttggtagtttaaaatagtatcctatatttggtgggtaatatccatcaacatttgtaatattcgctgatccctattactgttaaacattgctgtttctggaaccagttttatatagttataaaaaaagaaataatttatatttgattatcttctgctgtcatatagacacattatgcagtacgagataccattgcactgtgtacagccgaatccattgataatctccgagcaacaattgaatgtgagcagcctcaacctgatctctacaggtaagaagaccttgcttcaccttacttatgtctgttgtctctgcttctttttcctaccagtgtagcaaagaaatacccactgcttatttaccagcttgctctttgtatgtttttataagctgttcttattccaaggaagggagatgaatcaaattagccttgctcattaccagcttaagataaatcattatggacccaagcgtcctatgtttttcttttcttttagttacttggatcagttttttagatggttaacctaagcttcatctattagactaatagagtatctagagttaattaaaacaaaaataaacctttcgcatcttagccaacgtgatcaaaaaaggagaagatgggacagtccaattaataggcatgtcatcctttcttgttagtgagtatgatgaactgaagattacaaataggctatctgtggtccaccttaagccattaagttcaaggaccaataaaatgttatatttttcttctggttcttggatgtatgtttctgataaatattcattgtggttgtcaaaaaaatttgacattagaatctaagactcattagtttgattagggtatggtactgccgaagatatagtaatagtttttaactaatttcattctataccactgttgcacataacatctgctatgtaagcaatccatcatggtttgttttgttttgttttggtctttcaagacagggtttctctttatagccctggctatcctggaactcactttgtagaccaggctggcctcgaactcagaaatcctcctgtctatgcctcctgagtgctgggattaaaggcgtgcgccaccatgcctggctgcaatccatcatgttaattcatgctggaagactaaatgtctggaatttgttttctctgatatggagcagtagagaaaattatcctattatgagaatgttgccttccctttcattctttgtttcctctttctctttgttatgttcaccttgacactaagaactagagccacagctgggcagtggtggtgcatgccttagttccagtacttgagaggcagaggcaggtgaatctctgcgagtctgaggccagatgatctacagaatgagttccaggatagccagaactgttacacagagaaactctgtctcaaactaaaaccaaaccaaaccaaacgtttctccacctttaaggagaaaaaccattcttctccacatgaatctaaaataaaagccacattatttgtagaaaggtgtcataggaggtattgtgtatattgataaccaagtagaattttagttgatttaaaatctttgtatatactcctaaaacttgtaatattattttaaaggttaggtttaagttttatataatttataattttgacttttttcagaagcttagtaaaattttcaatgaattttcaatttattcagaattttattcttttattctttttaatctgatgaatttccaattgctgctatttggattttatacttgctagtatgttgtcttgttttgttttgttttaacaggtttgttgggcgaatcagtatctatagtaatagtattgaggctgttgccaggttagtttgatattccttttatctatccttttgaaaggagggatatttctcttttaaacccactaaattagtcagatgcctttctttaaatatattgaaaagaagatagctaagtaaccttttgactagtagggttgtggtggtagggtttctctgtatttgggtagattattattgaaataaatacatagggtttccaaaaacaaaaacccaaacagagctccatgggaccagccaaatgtttcaaccaataaagatacttgccccaaatctctagaacccacttttttttctctctcttttttttattaggtattttccttgtttacatttccaatgctatcccaaaagtcccccataccaacccccccaatcccctacccacccactcccccttaatccccagaacccactttaaagttgaaaggagagaactgactccaaaaaaccttatcctctgactgctactcatacacactctgtggcaaggtacatccatacaaacctaatcattatagacatgagttttcattcaaaaatataaaagagcagagctttgtacctgctttcccaaacctgttctagacattgcatatattttccctgcttgtataatggctgagaaggatgaaaataacgttgaagaaaagtggtttatgggagagcaagtacggctctagacagtgaggaaagtgctagaagaattgcttggacctaagtaaaatataaggttcatcatttctgaggcaatgcatacgaacagggtgctttctttcctcctttatcatggaattaagtgcctcagtttttcactttgccttaatcccccagaaatcaattttattcactacaaagacatcattgtggttttgcagcttgtcatttgccttctcagtcttttatctgtgatcctctatttctcacttcttgtagctcttgttttgccatctatgaatcataagcttttgatccttctgtaccttttttttttaacctttgcttgttgctggctactcctggactgcttccatctgtgctgtaccctcaagtcacatcagatggaaggagggatccgtctgctcatcctggggagtaagcatatggtggaaatagatacattttgaagccctcggagataggtgtatgttagggcaaaaatctgtccccagtgttgatgacattatatacattgtttaaataaagtgtgcttcttttttatttaggtctttgggacctgaaaatcttttgctgaaaggagccacacttaaaaataccaagaagatatatggtgaacaactttaaacatatgctgttaaaatgtttattaaaatctatggagaaaaaaataatgcatgctaaaagtgaacatggcagatacctgccttttattctcaatgtatatttatgtgctgaaaatttaattaacatgactgacattgtatcctacttaaattttaatataattaataatatcaacaatgagtagaaagaaaactttgaattctcaccatcatagactgaaaaatgcacagaaccaaataggcagggtgttggctaacaaatttaccaataactaggtttttgttacattctgttattctttaggagttgctgtttacactgggatggaaaccaaaatggctttgaactaccaagggaaatctcagaaatgttctgctgttgaaaagttagtatgaaccactattttattttagtcaatgttgattgaaatagttacttcttcagtaactccaaatagcaatagcagaaatcagaacccacaataacagtaactaccattttgagcacatatttctgcttctgaagtggtcctcattaatttatttctgatttgatttgattcaatcctctaaataatcctatgaagttatttatattagaaatgaagaaagggtctccaagatggtacatgacttcaataagcctacatagtttttaaatgataccatttatgtaaagtgtaaattcttttccttctgttgctggatttggggtcatttagttgatatgtgtatgttagttctacattattgttgagatagacattggagtggtagagcaagtaaggtgacactaacagaggtttctcttttttaattttaattaatttttaaaatttaattcaattttaactaaatttttgtttgtgtatctgtgtatacaacacacgtgtgtgtgcgtgcctctctctctctgtgtaagacagacaaagagacagagagagacagacagacagagagggagagaggtgggggaagagagtctcttgcagcacagactgattttaaactagctacttaagctgaggatggtcttgatattgtaatcctcctgcctgccaatataaatccagctacgggggtttatagacaccaccatgccagacatactcttctctttgcaggaatggatatgattcattgtgtcttattcagaattatgctgttaaaaatgggattcacatttgctattctacctttaatttgaaatatttagtcttttggcggggagaggcaatacacttttcatagaggttaagtagttactaaaacatatggatatgtctatttccagttattttacaggaaccttggtaaaggtgtatttgactagccagatattgtgccttggggaacattagtgatcaataaacagtccagggctagattttccattttgccacttaaacagtgattcttcagctgtgatcattaaagttcttacataaaaacattgggctgtgattatatagcatacacaggagacgctttcgcttagttaagactaaagtagactcaaattgaacatttacatttctgttttgtttatatcttaagtaactaggcatacaatcttgtttttcagatctattaatgccttcttgattgtttatttatttatcttactgaccaaagctgcagtatgcacaactcttaagtatgtttggcaaagttccccatacaatgatgaaccatggtataaccaaaagactcaaaaggaacgggaaacttttcaggtaattgctttgctgtgagaagaattactctttgtgattagactagccttcactgaaacactactcagaaaaatgagaccttttgatttagatttgtttttattttatatatctctatgtttttttgattctttcattaagagatttgaaaagtaatgagctttctggcattttaattcaatatgaacttgtattcctatctatatatgaattttgaatgtttccatctatggataggaggaatttaggacttaatgaggtgaaaaagtattaaagtagaaagctgaaaaatatagataaaattcatagtgttctaaaatgttgttaatactaatacttttgaatataatgatatagtgtcattaggaagtttctttatattaatagtgtgttaagcattaaaacaaaagaaagccattttatattttattcatctaaggctgtgaatctaattaacatgaaccatctcttattttaggttttgaaaatgttcactgactttttatcattcatggttcttttcaacttcattatacctgtctccatgtatgtcacagtagaaatgcagaaatttttagggtcattctttatttcatgggataaagacttttttgatgaagaaattaatgaaggagccttggttaatacatcagaccttaatgaagaacttggtcaggtgagaacacagtttttgctttaattaaactactatagtaaaaacattttctggtctggaataccaatataagtaaccatttcttttattgacatataattcaaaggaatatctttagtgtagacaaataattaaaggtttgcaatattttcacaactgccacttcagttattgtttactagtatttttacaaaggataaaatgtatgcatttaatataaatattacagaaatctatataaaagttcaccaaacgatactgtcagataaaaacatgaaatgtggttttccttacttcctataatcaattctgaatagaatgaagtataataaaatattgctattttacacatgcatgtttgttaaccatagttatcctatattgatattttctggggtgcatttcttatgacattgaacatagacctagcaagctatgtgtattccggtataaaaatataaatgaaagaaaaacataaaggcatgtccttcctcctcaataccatttcccagtatatttgcttcatataacagggtaaccaagacactgcccttgtttctaacataggtgcctttattttctgatacagtgtaacatgtgatttaagcaatgacttcttaagtgcttttctcattagtggtttgtttttattggtcttgggattgaacctgagatatgaagaaaggtaggcacatgctctaccactgggttagaatatattctttctacttttaattgtgagacagggacttgcttaattgcacaggaactcatgtggtagcctagacaatttttccctttgtgatcttcctgcctcagcttcccaagtcaatcaatatagacttgagacttgacctggctttcttattagtattgagaaagatttcccctttgtctaaatttgctatgtattatctaatgtttatagttgaatggaatttttttctttcagttaattctcatgatagtttataagagtggtacaaatatcatttctgtgagtagaaaatgcaaattcaggcaatgaaatggtggctagaacaaagcctcacatttgtttgaaatggtgctattttgcatctgtacctcaaaactctctttaaatttagctcttcttctccttggactctctatatctacacattttaatttttaacctttatttttattttagtttatgagtattctggcttcatatatgttttttggaccatgtgtgtacaatgtgtttggaagccgtaataggacatcagattctcttaagatttagagttacaagtggttataagtgtgggtgctaggaattgaacataggttccctggaagataagtcactgctcttaaccactgagccaatctctccagcccctatttgcgctcttggcacaatcttggcctaaaccaaagtaccatttcacagttgacatggaaaagaacaaaaggactttgcacatgctattctgtttagaagtgacttcagatattggtagctcagaccctggaatctacattcctcattgattctggaagtgctgaaacagtacaagaaataagtgaaccagtgtcatttcccgtggatttcctaaagattcttttattgattaattgagctgccacagttaatgccaactttattttttttatttttttaaatatttttattacgtattttcctcaattacatttccagtgctatcccaaaagtcccccatatcctccctaccactcccctccccacccattcccactttttggccctggcgttcccctgtactgaggcatataaagttttcatgtccaatgggcctctctttccagtgatggccgactaggccatcttttgatacatatgcagctagagtcaagagctccagggtactggttagttcataatgttgtttaatgccaactttattaagccgtgtatttgcacataggcgcaaggttgaatagagttactttaatcccaatgagaagcttaagtctacaggtttttggcataagaaaacatataaatgcagaagctaccagctcatactgtccactaagtaaatatgtgtcatgtttgttgcaagcttatagggatttacttatccagaggcagaagtgaaggctagcttcaactttcaatgcaaatatgataactatcattccatagtttaaacttaatgcattctagaggcagacaggatgcctagggcagattcctcttgataggactcttgcctcattttttcatatttcctcttcacaagtatacatattacctatatgaatactctggctcttctagattgtattaagagtataggcaataaagtagagggttgggtaatgatctggtaaatttgctcagtggaaagaaactaccacgtttgtttccatttccattaaatttcccagccaaactgcatttctggatatggttatcatttcttcaaatcacaaagttaatggcatattactactttaattaatacaatgcctaaaccacttggaatcattattagcttgtatgtgtagaaagtacaagaataaaaatacaaagaagtcttgaaatagtttcttgggctatttagcactcaatggactgttacacacaaaattaagtgtaaccaatttcctatctttgagtaacaattcaagctgtagagctttttatgtttctaaatgtagtatcagtttattgccatcaaggccacagtaaatatttgctttagtgacacattagtatgaaaaaagtagaggaacatgtttattgggacagtttttggtgtaataaataaaagaacagattcttaattcaattataaaattataagatatgttttgataaagtaacaatctttcataaaactgaatagttttagtagatcttgaaaaagttgtggggaatatcctttcttatatcccttcaaccttgtggctatatctaattatatggcatcattcttaagctataatttgattcaactcatccaatacagttgttttgaggtcctaacatgtacctgagatgtgttctgcatattgaagttactgttatgaagttcaaagaaagaaaaaacctccaattacccactacctgcttggacaaacataatagattttactttattagtatggttataattaataagaaaatcggaaggtaatggggcaatagaaaaaatcttattaatatcagtcaaatgaatcagagtattctgtagagagaatatcttatgtatgaatgcatcacctgtcaagcaaatgacctgtggcttaggcaggaaatacaaggtgtggcacccaggaggcagaaagaattctgatatagagccaggtatggaagatttgccaggaagatacaacaagatgatactttaacacagataaccaaccatatgatagaatgtaggctagaatagatgggatattttaaattatatctagtcagagaagagcctagccaaatggccaaggtatttgtaaatatattttgagtctgtgtcttatttctgggaacatgggaatgggaggtagaactggacctaacatcaacagtattcatcaacatatatgtagtaggtgggacatatttattgttaagctttacctatagtcattatagtcttatacatcaagtattttactttatagaaaaattaagacatttttatcaaggtttataactgataagccagagctctagtctaagggttcctttaggttaaagcatttgatatttgttttgtttaacttacaaaataggtgacttcatgtgtttagtctagttcaagagttctttttaaaaaatatttatttattttatgtatatgagtacattttagctgtctttagacatagcaaagaggacatccgatctcattacaggtggttgtgagccagtatgtggttgctgggatttgaactcaggatctctggaagaacagtcagtgctcctaacccctgagccatctctccagccccctcaagaatattttaatccctatataaccaccaacttcaccaaaagagcagaaaaatttaattttttcctccactactcagagtaattcaacacaacactgtcacaatatgacaccaaggcaaattcttcagtgagttccaattctaatactgtctacttcaggatacaaattgaagcctaagtcctacagtactgtcatcattcaaacaccaatcacaagtgcatgtgattttggtcatacagttataaatcaagattattacagacccttgattgaatttcagtaatttgacagcatgatctagaaaactcacagaaacataataatattgcttatcattatatttaaatagttattaaaatggatatagaggaataaccaaatgaaagatgtgcatagcacaaggtacatgggaaggagtgcaaaccattgtggcaaccttcaggaaatctccatatgatcagatactttaaaagttgccttgttttggtttggtttgagggttcaatagaagtaacaaaacgtaacataatgatgaaatcatcgaccattggtgatcaccttaacctttagctcttttaccctccccatcaggggttatgagatagagatgaaaattccagccatttaattaatgtcttgctttcttcagtgactttcccctattcaaaagggtatctaggtatatagggccaccagtcatctcattagtatatgaaatatatggatctctttctaggattaccaggggttttaggttgtgtttgggagattaatagtaaatagatttttcataatatataatagtcttgtcatttttgacacccatccttttacataaagaggatatacaacctcaaatgatagtaaggcattactcaaattgtactcaatcattaataatttttctagtacattatccacaatatctcccagagtgagaatactgagaaatacaggctttatctaaaacttgtacagttctaaaattaggagtaagaggcttctatttgattgaactaggggactgtcatctctttctctgagtcccttttaaggtattaagtagtattggattgccctcactgcataatccatttattcatttgtgacccaaaactttgattcctcctttgctagatattcagactttctcacattgggaagggtgattaggcttgtctgttgtgcacatctagactgtaggcaagtagtccagaggaacccttccccttctttcctgttcagataggctgaagttgtgtggagatgtgatcagctatctgtacagttagttccaagcgcagtaaaggtgcaacccatttacatcataagctcctttgaagttttaaaggtttttaaaacataggatgtgagggtgtactttagtatgtagtatttgctttgcatttatggaaccttgagtcctattctctacagaaggaaatgaaaaacctcaagtttcttgcttaggaattttctgtatatccagcacttgtagggtttgtttggtttgttgttattgttcttgttattgtgtgtgtttgtgtatgcttttatatatggttggcttttcagtgctggaaattgaaccaaggatattacacatgttaaacaagtctcttagtactaagctttatctctagcatgtttcttttttgagataggatcttactaaaatattcatgctggccttgaactcactctgtagctcagacaggctttagtaataccccaaccttagcctccttagtagctgagatcataggcctgtaccaccaggcttatcactcagtagtttcaccatgattctataaccattgcatcggattaaaaaaaaaaagtagaagaagaaaaaagaaaaaagttgtgatggtctgagaaatgaaaagggggtatagaaacatctgtgttagcagatacatagtcctctattatcatctaccagaaaaacaaaggactatctagtggggacattccttctgtcacaccatgttgattataagcaacacattcagccatttatcatctcaaaatgatgttcttactgctctggtgtgttagaagctatttcagaaaacagaagcagatcaaatgtgtattttctaatattcaactaatgtaggcttcccatccataaactgatgagcttgtatttgctgatagagagaagcctttcatccagctcaaaattgtcattgtagaagaatctctttaggcagagcccaagagcaagctgtccttttatacctgtttgttaaatatgaaagtgcttaatataaatcacagctagccccctgtccacttttcctgaacacatagcatatgagaatggttctaaaagtactgtgattctagggccaacagaatcaatattcaggaaattagaactgaaaaagatgcttgttttattttatattttgttgccttagtgtttacttttactatctaaactattctatggacacaaaaaattgtacattttatgttgcagtttccacctttaacactaatgaagtggtgggggggcgggcggggctagaaatacagctcagtcagaaaagcggttcccataaaagcacaggagtattagttctatcactgggagctgtttacaaagggcccagcatgatggcatgcactttaacccaaatactgaggacatggagataggcagatccccgagcctccctaactgtgactgcctcacctagcttcctagagagtactaggtcagtaagagatcctagagaaggatagttcttagacaacaacatcctaagttctcttctggcctgcacatatatgaacatgcaaaagattctgaatggactaatcctaattgaaatgcatgatgtgaatcaacccaccattcttggaaaaataaaagtgaatatttttgatcaggaatagaaagccccccaaaatttcagtttatttagagaaatctaactgacacacaagtaataccactaggatcaatttaaaaagaatccaaactgggcagatgaatagggaaaaagaagactagaatgctttatttgtatcagtgttggtaccatgcaaagctttgaagaagaattcgaaagctactactgctggagtttattgcttttcctacataataaaaaccagactcttgtgcttaggcttattcctgtcagcccataatattaactatttaagcataaattagcaaaaaggaaaataaaattgtgggtttctaaaagccagatgttataaatagagtagataaaaactgagataaaatggaagtacttaaaatgatttattgcaatggaaaatttatttcattggcttattttccattatttttaaaaatatacctacatattctattttaacctttttttaaaatttggaaacagttttgagtagtatctgagaaagaggcatggaaaaatatttttttgcagtctcttaccaccttttacctgttgtatctcctaattaaatagctgttaacatttctctttcttctgtcttatatgttctatagttgtaatacttttatttcagtgaagtatttttattaaaaaatgtcctgacaagagaattccccaggtaaaggtgcttgtgaggcatcctgttgacctaagatggatctttggatcttacatgatagaaggagacacctgtcttctacaagttgtcctccaacctctctatctgtgtattggcatgcatgttatatattatggcacaaatacacccaatacatttataaaatgaaatataattttaattgtgcttttcaaggaggaagatattgtcatcagttttctttgattgtatgccaactgtatttttattgcatttcccccattggcttatatactggccagttgtaggcagtgctcactctattgttgtcctccttggaaaattaactttcttaaccttataaaaacattaaatgattaaagttgcttagcttcacaaaatccatagttttctgtcctgttagttttctacatgtaagtaagtttcagtgtctttgaaaatgctcacaattttctcatttatttgataacagtgcatctctaattctgacatttgacaagtcttagaagtgatttttgtggctatggaagtaggactgccttctagctgagtaaaacttaactatactaaagaatatatatatgtgcttatgcccctgtttctaggtggactatgtatttacagataagactgggacactcactgaaaatagcatggaattcattgaatgctgcatagatgggcacaaatataaaggcacaactcaggaagttgatggattatctcagactgatgggcccttagcctattttgataaagcagataaggtgacattttctctgttgttttacctgagaaatcaatctttgtaagcatgttttatccctatatagtagaaataccgaattttccaatgggtgcatgataacgagttttgaataattatttgctttttttttaactacacctttcttttattaatacttttagcatttgtagacaactagaacttagaagtagaattatgggaaatggcatttgaacaaaaatattaacttagctgtatgtgcattcacttaaaaaaatcagcttttctaagaatgttgtctcttcaaatcattaaagacctaatatttacatgttaggtaaatcaaagtcttcctacacatgaacaattgctagattgtgatacctaactacatcttaagccataaagaagtcactaccttaggtataggtgatactacatgtgaatttgaatgagttaataatatatatgagtacactgttagctgtcttcagatacagcttggttacagatggttgtgagccaccaggtagtttctgagaattgaactcaggacccctggaagagcagtcagtgctcttaacctctgagctctctctccagcttccaggaaccagtaattgtattcgttgctatgtagtcgtttgagtatttggaatttataaatttcagagagattatgacattctgtcaccttaatatttttaatttgttcactgtctgggttacctagtgatcaaaataaaaagaatagtaatttgatgcttctgttccacagaaccgagaggcactctttctccgtgccctatgcttatgtcacactgtagaaatgaaaacaaatgatgatgttgatggacctgtagaaggagccggattcacatatatctcctcctcaccagatgaaatagctttggtgaaaggagctaaaaggtaagtacttcttgaatttctgagaaagggaaagcagaagaggacaggcgtttgtttgatgtttttcatttgcttcagtaactcagtcatgtgcctctcctgttttgtaagttcaaacagaaaatggtgaggcattcgtttagtttgctttatgtattcatcccagtcattagtccaaattgtcatattatattttgtaaatcatctaacagcagcagcatttttacaactcatgttatttctaagtactgccagcaattttgatgcaatttgataagtgacaatctagtttacccatgaaattcaagatgactaagtacctaaaaggtcacatactgtttttgctacaaaattagaattacaaattgacttcctcttgaatgtagtagtaagcagttgttgtattcctctttgttatcaacttatcttgaaaggggaaataaaattggcgattgagatcgtttaaaagaggaaaagaatttagacagtatcagggcaagagaaaataaattgttccttgaagatatacaagacttttttcttgttttcataggtttgggttcacatttttgggaaatcagaatggatatatcagagtagagaaccaaagaaaagaaatagaagagtaagtagcactgtgttttgatgtttgtctttcttaacccaattgtaaacaataaatggaatcagaaaggaaaggaaacttatgtacctatcaggattgaactgtattttcccatttcagagtctgtatagatatagctggggtaggaaaggccatttgtcatagaatgtcctaagtatgaatttggaatagaagttccagtgtgctttacatgttgtcgagactgagtcttggtgaactatttataaaatgtagatgaaaatatttatttacatgtcctttccttttttaactcttctgtatgatttacatacatagacagatccaagtcatctcataatgtcattattatactttttaaccccttctctagccttactgttttaagataaaatgccacgtttctaaaacagcaccaaagttcccagttctcagcacctgcttattttctgtctttcatctcttgctattctcctatcattgagctttccaaactttggaaatttaaactctcttatgaaccatgtgctgccatgtgtgcttttatacatgttctttcctgtgctctaaaatcatacctccctccctttaacatgtcactcttttagaatccagcatacacccttttccaagaaacattctttcagttggctttttaaagatctgtgctctggtgtcacttttgagtgttttgattgaaggaagtatttaatgaacttggaatacagttattttctttaccttttgtgtcctttataatgtggttaagttcttagaaaagtcatcagcagattcatctcaattcctcaacacatgcatggcacagtgtctgaccccgtaataggcactcaaatcataatcccactggacaccccctccagatctggcttgatgggctagttctttgttttccatgcctatgtagtcattctttttgaagttatacagtgaaaaataaaaacaacttttactgctatcatcagaatgttcagcatacagagacatttcgaagaaaagtggaaagtaccactttttttttgtagtatacaaaactaactgtctacatccaaacaagaaagccttgtgtccattaagatggttcagtcacatgccttttctcatctcagtgtaactaagttatttcactttttcatctttcctaaggtatgaacttctccacaccttaaattttgattctgtccgccgacgtatgagtgtaattgtaaggacccaaaaaggtaggcatctttaaaatttgacttatttatctttttctatttgtaagggttgtttataagctttttgaggaaaaatattttatagagtataggattaattagtattacaaattttagcaatatttgaaataccaattatagcagcctagagttcagaaagttggtggttgtctatatttttctgacctctgttattctacaagtgcttgatactcttcggaagcaagtaaagtagagatgtatcgttaacctagatttctgggaaagaatattcttgtttcattccagagctaagggtcctgaaagaataaaacttaccttttcagagaaatgagtactgtcatctctaggttgctcaatgtctttggtactatggtagtttgcctcctgttcagattctcagatgtatgtatatgtgtgcgctgtgtttctttgaccgcacccccctcccagaggcttatttccaaaatagacttgatttattttagtattaaatctactgcaaattgtttagtgagaaagtgcaggcaaagccatggtgaagtatagttcactttacttgtatggtctgggataacagcaaactcaggagactggttttagtttttgatcatggaatttgtttataacttttaagcagacttcactgtgtaattggaaatgaaatatttagcatttaaatattttcatgtgtgctcatctatagctatattctgcaaatggcaaaatgtctgaaaaataacatgcaaagtattggtcccaaaactacactttaatttgttaagcacagctatttgctttataaggataaaatgtcttaatgctcaacaatatatgatccaaaacttcacttataatatcagcattatacaaaggaattttaaatacctttttaaaaaccttaaaagcccagtgtagctcaccaagcaagtgttcttagtttattcagagtggacttgggctttgggagtttttggtgtttggctctaggctgtgcctggctacattttgagagatactcacctggagttccttgacacagcctagtactctgtgatctactagaaggaattgtagcaagagtgcatggggtaggatttggcttatttattatgtctatagtattctaaagatggtgattgttctcacaaactaaagctctagatattttatttcatttggttgaacattacagaaaaaaatcaaaatatatagaagttgcatgagaaaggctaccttagagttaccgcttctttaaaatcctgctaccagtcttcacattctaagttgattactctggttctttattttaggagatattctacttttctgtaaaggagcagattcatcaatttttcccagggtacatagccatcaaattgagttaaccaaagaccatgtggaacgtaatgcaatggtgagcctgcaccccttgcttcaacaaataaatgggcacatggtggagatagctatgtttgtggtttctaaagagatattgatgttaattatggtttatttcatacttggaaatttggtcatattcccatattctttattttaacataaattactatcctagaccagtattgtgattagaactagtacttgaagatgtttcaaggattttttttccttgacgaaatattaacttttaagtcgcatgctattcatttaaagttaaacatcagcatttctctttcatacagatgggtaaagaaaatacctttcaagaatgtgcctgggctaggaagatgtctcagcagttaaaagcagaagaccccagtttggttcccagttcccatgttggatagttcatagctacctgtaactctagcactagatctcatgcctctggcctccatagtcatcagcactcatgtgaacataaccatacagagacatcttctgataaacacacaacacaattaaaaataaaccttcaaaaggtataacattcctttagctattacagagataactatagaacttctgctttgtttctaggatgggtatcggactctttgtgtagccttcaaagaaattcctccagatgattttgaaagaatcaatgcacaactagtagaggcaaaaatggccctacaagatagagaagaaaaactggaaaaggtttttgatgagattgagactaacatgaatttaattggagccactgctgtggaagacaagtaactagatattcttgttaacgtttttcccttccctttcctccctctaaaacctcccatgtccaactccactttgttctcttttacattcatgatttccttttcctttaagtgtatatttgtattcctaaatatataaatgcctgcctcagtctctataatgttatttgttttcagggctgactttttagtattggctaaggaattggtgtgcacttccctgggggtgggaaggacactatttctcttccctcagccagcattccttaactacctgtagttctttatctcttttttgggtcctattagcatgtcttttggtattgtatttcttcaggtgtactcttgttattttaatgacctgacatttagatatgtaccagattagtaatttatttacatattttgaaatctcttttagcattgtcgtctaaataaacttagattggtttattttaccaaatatggaaaatatagcagattttgaattctagaaatagttttaaagtaaatacatgtatcttagaaaaaaatgaatccattatcaatatggtcttttggatatttactaaatcatctaattgtttatggaacttttatgaaacaaccacagtatataagataggattgtagaatcattatttgaactggtgcctagaataatgggtaggattttggtaaatgaccaggaaggaaattcacagtaaatagctcaagaatttaatctaacctgcttctacaagccagaatatgtttttgaacactttaaaataaaatgttaaaaccttaaatatgtaggcttagctttttgagacattattatagaacttggttaaatatttgattaagataatgttttaaaccaccaaagccagacactatggcagataccaacaagattttgctgaaaggagcctgatatagctgtctcctgagggcctctgccagtgcctggcaaatacagaagtggatgctcacagtcatccattggactgagcacagggtccccaataaaggagctagagaaagtacccaaggagctgaaggggtctgaagccccataagagtaacgtcaataagaactaactagtacccacagagctctctgggactaatctacaaatcaaagaaaacactgggtggaacttttggctcttgctacatatgtagcagaggatggcctagttggtcatcagtgggaggagaggcccaaggtcctgtgaaggttaggtgggttggggagcaaggggaagggggaggagatataggggattttcggaggggaaactaggaaagggaataacatttgaaatgtaaataaagaaaatatgtattaaaaaaagataatgttttaattttttaaataaaacaagtttttcaaagatagcttcataatttagtgtactggttgctcttccagagaacctgggatcaattcccagcatccacatggtatccacaatcatctataactcgagtctggaattatccaattcctttttctgccattcttgagcaacagacatgcacatagaatacaattccatgtgcacagggaaaaatacccatacatatacaataaatttttaattactcaaaaagtaatagacatgtatttaaccaaagtattaaatttttccttgtttttattttgtgttaatatttattagttttttacacacacacacaatgtaatttagtcgcttcattccctctctcatctctctcatcgtagtcctcatcgtagtcctgctctcattgaacctcttctacccaacaagatcccctcctattttctttctgtttccttgtctgatttctgtttggtttttgtttggctttgttttgtttggtttggtttttgcagcccactgagttcagttaaggctgcttgcatgggcatgaatagtataagcattttcccaagcatgaccaatttagtggtggctatgccactaaagaaaattactatcctacccctgcaaccattaattgctaatagttcctcagagagtaactatgagccccttgtccacccatgatagaattggtaggtcctattttctgtaggtagatacacatgctggggattcaggagtgcagtgactatgacaaatccaaaagctcaaaagtccagaagttcaaagcattcctccccttcttccaccccctctttcattatgtttcctaaaacttggagggattacatacatttcccatttaagtttgagttgtcatctgtcacttttgaccagttatcactttgacttcattaactgtcacccacagcaaagtgaatcttctctaatcaagattgagaacagcactaatctataggtataaacataaatatttagaagtcagtttggcactatagtcacttagtttttaaaaaaaaaaaaaaaaaaaccagcagattacatcctagggcctagtacctcgagtgctatagacttttggctagtttgcagtaccaagcaagagttccctctcatggaaagggcttcaaatacagtttttaggtttttttgtgggatttttgtttgtttgggtggttggttcgttttgttttgttttccccacggggtttctctgtgtagctctggctgtcctagaactcactctctagaccaagctggcctcaaactcagaaatccgcctgcctctgcctcacaagtgctggaattaaaggcatgtgccaccactttctggccctcaaatacaattttttttggtcatcttttttcccccacattttttattagatattttcttcatttacatctcaaatgctatcccaaaagttctgtatatactccccctgccctgttctcctacccactcactctgacttcttggccctggcattcccttgtactggggcatataaactttgctagaccaaggggccactcttaccaatgatggctgagtaggccatcttctgctacatatgcagctagagacaggagctctgggggtactgattagttcatattgttgttccacctataggattgcagatcccttcagctccttgggtgctttctgtagctcctctattgggggccctgtgttcacttctatagatgactgtgaacatccacttctgtatttgccaggcactggcaaagcctcacagaagacagctatatcagggttccttcagcaagatcttcctagcatatgcaatagtgtctgtgtttggtggctgattatgggatggatccccgggtgggtcagtctctggatcgtccatcctttcgtcttagctccaaactttgtctctgcaactccttccttggatattttattttgtattctagggaggaatgaagtatccacacattggtcttccttcttgattttcttgtgtcttggaagttgtatctttttgttttgttttgttttgtttctatttttgtttttcgaaacagggtttctatgtatagtcctggctgtcctggaattcactttgtagaccaggctggcctcgaactcagaaatccacctgcctctgcctcccgagtgctgggattaaaggcgtgcaccaccaccttgggtattctatgtttctgggctaatatccacttatcactgagtgcatatcatgtgtgttctttttgtgattgagttatctcactcaggatgatatcctccagatacatccatttgcccaagaattttataaattatttttaatagctgagtagtactccattgtgtaaatgtaccacatttcctgtgtccattcctctgttgaaggagatctgggttctttccagcttcaggctattataaatagggctgctatgaacatagtggagcatgtgtccttattgccagttggaacaacttctggatatatgcccaggacaggtattgctggatcctccggtagtactatgtccaattttctgaggaactgtcagactgatttccagagtggttgtaccagcttgcaatctcactagcaatggagaagtgttcctcttcctccacatcctcgccagcatctgctgtcacctgaatttttgatcctagccattctgactggtgtgaggtggaatctcagggttgttttgatttgcatttccctgatgattaaggatgttgaacattttttcaagtgcttctcagccctttggtattcctcaggtgagaattctttgtttggctctgagccccattttttaatggggttatttgaatttctggagttcagcttcttgagctctttgtatatattgggtatagatgtaccatattttcttgatccactctacagttgaggagcagctaggttgtttctagtttctgactattacaaataaaacagctataaacatagttgaggaaatgtctctgtgggatgttagagcattatttgggcctatgcccaggactggtaatggctgcgtcttaaggtaaaactaatcccagttttctgagaaaccaacaaattgatttccacagtggttgtccaagtttgcactcccaccagcaatgaaggagtgtcccccttgctccactcctcaccagcatgtgctgtcacttgagtttttgatcttagccattctaatgtgtgtaacgtagaatctcaaattctttaagtgcttctcagccatttgagattcctctgttgagaattctctgtttagttctgtaccctatttttcatttgggttatttgggttgttggtttttaacctcttgagttctttataaattttggatattagccctctgtcagttgtagggttgatgaagatcctttctcagtctgtaggctgctgttttgtcctattgatcctttgccttatagaagctttgcaatttcatgaggtcccatttattcaattgttgatattagagcctgaactattggtgttcttctgttcaggaacttgtctcctgcaccaatgcgttcaagggtatttcccactttctcttctatgagatttagtgtatctggtttatgttgaggttcttgatccacttggacttgagttttgttcagggtcaaagatacggatctgtttgcattcttctacatatagacatgcagttagaccagcgccatttgttgaagattctttcttttttccattgtatggttttggctttatcaaaaatcaagtgttcataggtttgtgggtttatttctggtcttctatttgattacattggtcaacctgtctgtttctgtatcaataccgtgcagttttcaatcactattgctctataagtacattttggggtcagggatggagattcctcccaaagttctttcattgctcaggattgttttggctatcctagcttttttatttttccatatgaagttgagaattgttctgtacaggactgtaaagaattgcattggaattttgatagggattgcattgaacctacagattgcttttggcaagatggtcattttcactatgttaatcctaccaatccatgagcattgaagatctttccatcttctgagatcttcttcaatttctttcttcaacaacttgaagttctggattgttttggtacctggatttcttactgtagtaggtattgtgagcataggagatattgggaccagggtgaatctctatgatcgtggtgtagcatgcctctgatgagtgtctttgggttgtatggttccagatctgcaggtctgcatggttcaagagctggagatgagatgaaggtgggtggataatggaggttcttctgggctagcagagtgctcaaggcagcttggcttgttccagaggactcagccatagggaagatgggtggggaaaggaaggttacatgtattgttcaggatcagcaggtctgatgaaggtggggggagaatagatgtcccctaggatagcaggctcctcagggcagcttggcttgttccagaggactccaagcatgagagatgggttggggaagagaagcttatacctgtagggttccggctcaacagatctaataaattgctcagagaggtggcgagagaatggaggtctgcctgggctagcctgtacctgcatatattttaatcatattccttgattttattatttcttacctcctgtggctcccctttccccttctcctcttaaaagaatttcttttgtcaaattttattgatattctggtatctgaaaggaagccaaagaaagtgtcattattctatcctttattcttaaattctcaaggaaaactactgtatttcctttatttatttacttttctttttatgagacaggatcttagctgtgtaggcctggcttgcctggaacaccctatagagaccatgttagcttcagattctcaatgatttgcctgcagctgcctcccatgtgctgggattaaagatgagctacagcactcagcagctttcctaacattagaagttcctcaatgctaagagtttactaatatcccccatatctaattagaatgtttcagctctttccattttgccagaggcaacctgactataataaggattctagaattggattgctagtgagctgtaagaatgcttacttcaacagtccttcttctctcatgaattttagagattaacgaggtttctttgtgtttttaggctgcaagatcaggctgcagagaccattgaagctctccatgcagctggcttaaaagtctgggtgcttactggggacaagatggaaacagccaaatctacttgctatgcctgccgccttttccaaaccaatactgagctcttggaactgaccacaaaaaccattgaagagagtgaaaggaaagaagatcgattacatgaactgctaatagaatatcgtaagaagttgctgcatgaatttcctaaaagcactagaagccttaaaaagtaagaaagtacatctacttattaatttatacattgatccaaatgtaaataagagattatttttgtagaaagctctgtttgctgtgatttactattctgtgttgatttttttcttctaagttaaaaccttccctgaggacttgtctaattctccacttgagattatttgttgctgtatctctctcttaatgtaaaagtcaaagagatttcgcaagatttagtgtcaaaactcaaacattatttggcagtgctgtaaatcgaacctagggcctcacacatctttgacaagcactctaccactgagttatccccagctcagttcctttttttaaatgaatttataatttacatgtaaacaaaagcatataattgtacatattaataagttaatgtgatattttaatacatgtgtacactgtataacatttaaattatagttaaacacatttttcccaaaacacaataaaaagttctgtagaccaggctggcctcaaactcagaaatccacctgcctctgcctcccaagtgctgggattaaaggtgtgcgccaccactgcctggctactatttgtctctttatgtctggacttttttattttttagttcattattacacataatataatgagcttcattcattttgtccatgtagttgcaaatgacagaatttcatttttgtagctctgtagtattctaaattatgtatgtatcatatttttttctcttattagttgatagatacttaggtggtttccatctgggctcttgtgaatagtgttaaaatgaacactagagcacatatattttgacatgcattttgctcttgtatatatactcagtagtgaaatttctgggttatagcagtaacttttcatttttctttaaaaaaaacttttacagtagctgaatttgtaaacatttagaatctagacatataatcccatcagactctggaactgttgacacagtttttgaggttctagactattttccacgtgaatttgtgtgcttcagtactccaacaggaaccaaataaaccgagattctgtcttcaactagcaaaggaaaaaagatttatggagcctaagaatttccaggaaaatttctgattgacaataccttagtgcctagagataaggcatctctcattcttctcattgtctacattgcccagtgttttcagatttcattagtctacaaatagagctagtcatagacagttctttgaatataggtaggctagggttaagaacccctaggtgatataaaatggtatttatttaaatgatacatatatttatttatttatataatgttgtttaatgagcaatatatcttcttgatgttttgccctatttgaaaatcatgtttgcctggcagtgatgacgcacacctttaatcccagcacttgggaggcagaggcaggtggatttctgagttggaggccagcctggtctacagagtgagttccaggacagccagggctacaaccttgtctggaaaaataaaaaatgaatgaatgaaagaaagaaagaaagaaagaaagaaagaaagaaagaaagaaagaaagaaagaaagaaagagaaagaaagaaagaaagaaagaaagaaagaaagaaagggaaagaaaaagaaaaaaaaagacaatccctgttctctggatttcctttgttattcaggcaaagatgctatatttgtttgctcttaagtcattttgttttctctgtttccccagaagttttaactgatgagttattgaattttgcatcatttcataatagtctaactaattaagctgtagttcaaaagactaattttaaagttttacagtgcacaaccaccttcgtttttataattttcaaaacttagaatcaaccatgtgggcaatccttgctccccattgcactatttgccccctgatgcctgttatttgggttcttgttactttacaggtttttttaataggcaaacttgatgcaatcgattttgttcgttttgttttcttcctcatttctctactgaagttgacattatcaattacatcctccctgaaactctccttcttaggccagtgcactagttcatcatctaaaagcagttgctgcacaagccgtttgacttgagtttcatctctagaaccaattccagaatagccctctgatctccacacatgtgccatgcttgtgcatatgagcacacacacaataaaaatgtaaaaacaccaactctcttttaaaaaaagatttatttatttattatttatgagtacactgcagctgtcttcagatacacaccagaagagggcatcagatcccattacagatggttgtgagccaccatgtggttgctgggaattgaactcaggacctctggaagagtagtcagtgctcttaaccactgagccatctctctagcccccaactctctttcttggtgtctatcgcagtgttaacatttcctcccactttggcagtctgatatcttaattttctccctaaatatctttttctaaccagaactcactgttgttcttttattagagacaatttattctttgggacgattgaggaaggaaactagaactggtgacttgtcttatctggaatcctccccctcagtgattgagaaactcaaaatcatgcagggtatggaggtgtgtgcccgtagtcccagaacttgaggaatggaggcaggaggatcaggcagttaaaggacatcctcagctatagagacaattgaaggccagctggagctatgtgagatctgtctcaaaagaaaataaaaatcagggtcttaattatacatttttaaaaatctttttcagagcatggacagaacatcaggaatatggattaatcattgatggctccacattgtcactcatactaaattctagtcaagattgtagttcaaacaactataaaagtatttttctacaaatctgtatgaaatgcactgcagtgctctgctgccggatggcaccattacaaaaagcccaggtaattgaatattagttaattttttcatactggatcctctgtgcacatctcatttctctccctgaatttttgtgagcaaacagtgtatctatactgtaccttgtaccttcaagcttgctgacagttctttaccacttagacttctgtaataagtacttagtttctactgcctctgcctagtgttccttcctcttcgtggcattcttagttctatgtatcctgtcatctcttcttatcttactatcctactgtcttggttacagagaaacctggcccagttcactattcttttccttgttcctctactacagttagtgctatcacttacagtttcctcaaaatcgtccttgatttttgtgcttgtccaaaatgctatttcccttcgctttcccattgtatcttttcatttggtttcatcctgcatttttaatgttttattttattttgatgtgtgggagtattttacctgcatgtatagatctgcaccacttggcttcctagtgtttacagaggccagaaggaggttatcagaacccctggaactggggttagagacatttgttagctgccatatgggtactgagaatagaacccgaagcctccttctggctcattatcctagattttctatctgcttaatagatttttcccctatttgctttcacgttatagtcttagtctctccaccgccccctcaattcttccactgataaagctctagacctgactttttcttaagattaattctcctatttctaggtgtctgctagacattgccattttgattctctactatcacacattaaattatagtttcataagacagatcttacaattttcttgaacagtttgtttcttccctggtcttattttattcctgttactagagccatttttcttttgttccctaaatctcataagtctatttatcctacctatttttttgtcatagctctcattttcatgaaaccttttggtgttgcacatatttttcctccttcctagaacatatggtatcttgtgattcagaactcgaagtattttatctttgtcactgcagttagttttctagactagtaccttctcatctcttatatccatatagtttaagtcattaccttctgtctaaatttttgggattctacgtcattagtttcttacaaacccatcttcttgggattgttttttgttgttccaactctgccttctcacagcttaattatcattttttcttggcatttcttattgtttctataaccaagcttactagagttttaacttttaaacccaaatcctttattgacttcttatgcttttctagtacattttactagtcttttctacctgtttctttcttcagagctcattagacttcatctgtaagtagcctcctaacatctctgtttcctcatttttgttttctaccagtgccttctatactctgctgcttgtacagtatccttccatgttggcctgagtctgttatctatatgtgaacatttgttaatatgatcacaccagacatactttatcagtgtttgttatcttcacttccctgtgtgccttttttatgtcattcctttttctctgggaataccctattatttccctgcacacacaaattttactagaatttcatgatttaaattatgctagtgtaaactaatgcctaattgacaaatattttcctcttacttgatatcataagctttcttatatggaatttttttacattgatttatttattgtgtggtacatgtactttgttgcacatgtggcgataagaaaacagcttgaagaagtctgttccttcctttctccatgtgggtttcaaggatcaaagtcaggtcttaatacttttttttttttccattttttattaggtatttagctcatttacatttccattgctataccaaaagtcccccttacccacccaccccaactcccctacccacccactccccccctttggccctggcgttcccctgtaccggggcacacaaagtctgcgtgtccaatgggcctctctttccagtgatggctgactaggccatcttttgatacatatgcagctagagtcaagagctcagggtactggttagttcataatgttgcacctacagggttgcagatctctttagctccttgtatactttctctagctcctccattgggggccctgtgatccatccaatagttgactgtgagcatccacttctgtgtttgctaggccccggcatagtctcacaagagacagctacatctgggtcctttcaataaaatcttgctagtgtatgcaatggtgtcagcgtttggaagctgattatggggtggatccctggatatggcagtctctacatggtccatcctttcatctcagctccaaactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctaggtcttaatacttggtatcaggtgtcctcacccacttagccatctcaccagcttttatatggataattggataatgtcatgtactcctgtacatatagcatattttgttatctttattgttatctattgtttatacttctatttgtaactaatctatatttcatttacatgcttttcaatggctacagctcttcattttttatattagtatattattatgaatggtatgttgcacacatttatacttgatgaataaagctattagttaagtcacttgtttttcttgagagcgtcccacagttttgagaaaaactgttagtataggtaacttgaagaggtcaggggaaaactccatgttgaccgaatcctctgggactttattgccagtgaccacatatccttttgttttttcccacaaggacaaattaatctttcaacctaacctatacttttcttgcaaacgttgtcacccttgatgattttcttgccttccagactgcagtgtttaatccttgaggtatagagatcattgttgcacatggtatatggagtgcacattagttagccattattatagctcattaaaactgaatggggtttggatgttttagccttgtcatttattaagcattttataggaaccaaattaagaagagcgatcaagcaaaagctaacatttcacttcatttttatgttgaatgacactggacatgtaggagttttataatgcttttaacacaagtaaaaatcttagtcttatttaaagaaactactatggtgtgcattccttgcatagattatttataatctcttcatctgtattgaaaatgaattttatttatgctaaccagttagagaaatcattatttagcagctgagacatttatgtcttgttaaggctattagatcccaaggaatcttaagaatagatagctagcagtgactatctgaaagagaggaggaagacaactttaaccaaaacatttccacacgtaactttctgaggaggtttgggagaaccctaaagaagaacttgtttaacaacaccagaagtgaacatatttttgtaaagtatttgccctgaaaacaacagtaagccatactgcaatcactttcacatctagataagatactatttagaaagtaactgaatttgtacacccatcttgaatatttttcttcaactctcgcctcctttaatatatcccctttgaaatgtagctatctgaaagagagaacaaaccatattgagtagtgagaaaaattagtaaagtttatttggaagtcatagaggtacaaaattaacatttgttccataacaactattgaggtattttttccattaatatatttatttattcactttatattccaatcacagccacccctaccatccccccccccgacacacacacacagctcttctcccatcccttcttcccttctcctctgagaaggggaaggcatgccctggcacaacaaatcactgcaggaccagacttaccctttccacggaggccagaaaagacagcccagttagggaaacgggatacacagacatgcaaaataatcagttgttgggggacccacatgaagaccaagctgcacatttactacatatgttcaaggagcctaggtccagcccatgtatgctctttggttggtacttaagtctctgagactcctcaagtgtccaggttagttggctcttgttggtcttcttgtggaatccctatctcaatggggtattctaagggaaatgtcttcagaagagggaataggaggtaaccaaaactgttctgatttttccattcttcttctagtggctttgtacatgttacctcaaatccaatttatgaccgccacgcgtatacattcacaatataatccaaaaagatcacatgaaaaaatggcaaaagaagaaagcatggcaggaaatgttttgagcatttatgcatgtacagacctagaagcaaatgtggcgctggtggtgtgttttaaatgacttgttactttatacctgagaattcttttatatatatttctgtttacttataaatgacagtaaaccctagtgagttgttacacattctgcttttgacttttctgtctcttgtatttaatgtttagattgtcagaatggtgaagaacttgaaaggcagccccataacactgtcaataggtgatggtgccaatgatgtcagtatgattttggaatcccatgtgggaataggtgagaaatatttaatgtgatggcctctataaagtcttattagtagtattgctttgtaggttgaatcatgtttactctagattgttttcgttactaatctggattttgagtttggaaataattgttaatctaataaaagatttcatctaataaaaagcattccaagatcctactaatagtgtagttagagggtatttttatatttgccagacaaagtgagtttttcctttttctttattcttttgttttgttttttgttttgattttttatgtttttttgagacagaatttctctgtgtagctgtggtggttgtggaactctctgtgtaggccagtctggcctcaaactcagagatatacctgcctctgcctcccaagagctgagattaaaggcatgtgcctgaccaccacccaattacaaagtggctttttcaaacgtactagagccacaattaattgtgtagatcttattttgacagcgtgaatgatattttattaaatttttacacttctagccaagctgtctactctcttacagctctctttcttttgagagtattaactgttagaggttaaaagctgatcactaattggctccttttccacacagtggtatttatgaataccttaggctctggtgttgaagtcttatgttgatatacaccaacagtttttctcccaccttcatcaggttttcaccttcccaattgctattaagcattcaacctaacaccccaacaccattaggcaatggattgggagcacatagagaattaatgtcttggaaattgttagagtgacttttagcttcccagattacttctcccattcagaagtagaatgaatgagcatggaattccaagtttactcattgattacccaatatggaagtgacctgactcataaaacccatgtgtagctattcagcttcattcagggacagagagattcactgtcttctcattggtttcccagactgcaaacccagacttctgagttgccttaatatcacaatcggtttagtgttgtgcacaattaagcacatactgaaggccttaaataatattcaggtggctttttcccttccagataattttttttggtttgtacttgaaataatgactcttcttaattgttttatattattatattagcaaatagcttatcagttaaacagacttttatttgatgtgtcaatagccctgttaaagcacatttttatttttaaaaaaactaaaggtgcacacttgatttgtaacatttaagcaacttaaaaatataaaaacaaatcaggcatttggtcactgtaaaaaattgacactatatggagatattctctctttaggtattaaaggaaaagaaggccgtcaagcagccaggaatagtgattattctgttccaaagtttaagcatttaaagaaactgctattggttcatggacatctatactatgtgagaatagcacatcttgtacaatatttcttctacaaggtatgtggtcaaatatttataatttagctgttttgcaggggattatttttgaaacaggattttgctatgtaacccagatttgaatcaaacttcttttgtaactggggctggcacatgctcctctgccacagcctcccaggtgctagaattacagatgtgtaccacagtgctgaactgtgcagtttaatttctatgaatcaaaaccaaggtatttctgtggatataaaagacttgaagttattttgaagtcagcttttttaaagtataaatttaatattgtttaatcatgtataataatgttttatccattaagagtatatagatccaggccaaagagatattttgttcacctaagggtttatggaccttttttatccttttgaagaatcaaatgcttgtttcattgattctgatttttgtatatgtatttatcttttcatttcagatttttcttctattatttttcagatcgtaatatgattatatcatttctccctttcctttcctttctccaaactttgacacacacacacacacacacacacacacactttcattcctgactataacctgctcaatctggattatgttagttacataggtgttttcaaggctgaccattggtattagataaccaattagtgtgctcttccctaggaaagacaatttctcccactctcagcattttttcatcgcctagagttccttgtgtaggtttgaggctttgtggccttttgtccttgttcaactcatctttaggttgtcatattggtgagacgctataggtgtagcttctgataacactaaggggcacagtctctcaggggattcactgatcatctcactcttacaatctttctgctgcctcttcctcagtgctccctgggccttaggtgtggaagttgtattgtagctgtatctgttgggactggtcatccacaactctgcatttgattggctgtggatttctataatgtttgttatctttccatttctttatttatttctttatttttttttttttttttttttttttttttttagtttttcgagaaagggtttctctgtgtagccctggctgtcctggatctcactttgtagaccaggctggcctcaaactcagaaatccacctgcctctgcctcccaagtgcttcgattaaaggcatgcgccactagcgcccggcttatcttttcatttctaaaaatgtttccttgatgttaagcaagtgtttagaatgtagttagaatgctgatttagtaaattgatgcttgtctgttctcttccaagacctatgacttcgcgatctctcagtagttactacatttccagtaccaagcacaatgtccctcttgctaaacgggtcttaaagccagttagctgctagctactaacaaactctgtgccggtactgcacccttagtgttattatgcaattctggttctcaatatggtttatagacatcatagttgaatatcactgtaggttgtctccttcgattggaagcttgcatagtactttctgaatgctgtttctaagggtagaggcattcaggtcagttacagctcaggagcccccaggtcctttgtctaagtacaaggtatcttcagcaataggaatttaaaccttccacctcctgggggcaaccaaggacaatagcaatagactgtacgtttttggattctcttggacattgctgaccaacaactcaaaagggaccttctcatgcctattattggtggtttttattaggtggcctttggctcttggagctttgtcagcccagataagaaaatttcatttcaactatatatatttcatttatacacagacttacaattttttataggcttggttttaggtatgattagatagttaacagtatgattctttatgacattttccaaatattcttactataacttcacctgtctccttttttctcctgtatatatcttcccctttatccaaattagagccccacatttttctcatttccccaatcagatgacttgtacttgtattcccctttctgtggctctctaaaccccctacaccagcagtggtccctcattacttttgtggtttctacagttaatccaagatagatactcactttggtaatttggagctaagaacctcctataagagggaaaaaatagtgacaattgtctttatgggtctgggttacctcacctcaatatgatgtttttctagttccatttacctgcaaaattaatgatttgatttgattttttacagccaaatagtattccacagtagaagtgtacccacattttcattatccattcggtggttgcgggacatttaggttaggttcctagctattgtgaataaagcagcaataaaaatagctgagcaaatatctgtgaagtaggacataagccaaggaatgggacagctgggtcatttggtcgatttagtgttaggattttactccacactgacttcacaatggctttaccggtgctgagggttaccaaaaatatggagcactttacaaatttggatgtcatccttgtgtagagtccatgctaattttctctgtagacttccaattttaatatatgtgttgcaaaaatgaccactgtttatttcttgagaaaatttctcactctgtaggaatttactatgcagaccaagctagccttgggctcacagagattactggttttgattcacaagtaatagaattaagtgttagctaccacacctgtccatttcaataacttgtaactttaattctttttgtgtatgtctttggaatttagattgtacttacttttccaaggccctaaggtacattcttagttatttagagagctcagatttttccctcttttggcaacatctcgtgtatctcagacttgccttgaacttaatatgtacctgaggatgaccttcaacttaggattttttggtctctaattctcgggtactaagatttctggtgtctgcttttatgcacacaccagaatgtacagaatgtatttatgtggtgttggtgaatgaacacagggctttacatgcgctgaacatgcaccccagcccagtctgatgtttttaatgcagattcttacaggtttaaatttcactctcaggactacttagaccttgggttttggtatgttgtattttcattttcattcagttctggttttgtttttaactccctccttgatttcagtgtcccattcatcatcctttagaagcttttgtttggtttggttttatgttttggtttgttcttttagtttgtttttgtttttttatatttttttgttgctgctgttgctggtgctactactactactactactaataataataataataataataataataataatactgttgttggaacagggtctcaccatgtaattctggctgacatacatttgtgatattttctgctatcgttttgttgaaattgctttctgtttctttaacacagagttcttgacccatatctcatagttttggtctttccgtgtgtctttcagttttactcctgtgaatagacaccatgaccaaggcgagtcttataagaaacatttatttgtggctaccttacaggttcagaagttcaatccattatcatcaaggtgggagggagcatgacagcatccaggcaggcatggctcagaaggaactgagagttctacatcttcttctgaaggctgctagcagaatattagcttccaggcaactaggctaaggaccttaaagcccacatccactgtgacacacctactcccaacaggaccacacctgatagtgccaatattagtgacatgtgcaaaccaccacaccatggatctcaaatgttctgattgtaacttattagtttttaccttcatcaaaattacatttagagaatgtgtgtgtggcagcatgtgtccttactcactgagccatctctctgtctttatattagcttacctttgtcattcattgtcttatgttcctctgccttgtctttaagccctttgatccattctttttttaaaaaaaaatttatttatttattatatgtaagcacactgtagctgtcttcagacactccagaagagggcatcagatcctgttacagatggttgtgagccaccatgtggttgctgggatttgaacttaggacctttgaaagagcagtcggcgctcctaaccgctgagccatctcaccagccccccaccccccctttgatccattctattggtaaagctttttaaggagcttatcatttgacttactgaaaatttgtttccagtatttctatttattttctattttagtatttccaactctgctgaattctgttttcatatcccctgtttgcttatttcatttagctgtttgtcttaccttaggtattccgctttggaaacttgtctgtgtttacactgtctctgaccaggttttcacctagctgagcactaagaggttttgctgcaatgtttcttcaccatagtgtagaggtattctgctggccaggttctgcctgtagttcactttgagtttccagagaatacagaccaacattggagcccctggagccatcaactcagcaggggtcttttgaaatggtattctagaactgttccagttcagttcagccaaggaaaaggtgtttctcagaaaatcttttctctgcagctgccatgcataacttttacctcctttcttccttttccctttgtcttttactgggagtattatgctgattttggagggtctctcttttaagtattgtctcagtgatcactcacacagagaggagggagttccccagattatgctggtccttcaggtcagatttagtattttttctgttctgctgttcaagctttcctattttactttggattagactagagattttgtggctctcgcccttctaattgctgttatctagccttccttaggttattccctacatagtctatcagaccaagcctatatgatgtccaccatcttatctagcatctcctatttcatttcttcattcattctctcatctatgacccatcaaatgagtgatcatcagtgatcattcttgctacacagcaccagatgcccaggctcctatatatgcaattgttaaataaaaataaattaaagtgagccagttagagtagtacatacctttaatctcagcacttaggaagtaaaatcaagaggatcaattgcttatgagtttgaggccaacctgacttgcatgagtttgaaaacagcccgtgtgtgtgtgtgtgtgtgtgtgtgtgtgtgtgtgtgtgtgtatcctaagtttccagatttgcctgccaccctgtattaactgatttgggggctaaacattgagcaaggaagattacaatttagatgatgataatgaacccagtgtgtgtaaaacagattgttgtttaacagaagcattttattaattaattaatcctgacaagtctcttatgagttgtagtatctgtttttaaatatataaaaaatagacctcactctacccttagtctgtcccttctctccccgcttccctcccccctctctccacattcctgacttccctctactctcgcctgcccctctctgcctttctctattctctcctcaactcctttccccataccctaaataaactctattctatactttaaaaacacagacctcaggaaaatgctataactggtcttggttctacagctaggaagtatgagaaccttatgtccacagtaggttcaatctaggaatctcctccagagttaggttctgttgggcttggcatcactgattatttcttttgacctttccctaataggagggccccatgaagatttgtcatgtaaatttgtttggtaacctgacttttcccaaaaagcttgatttgcctccagatgcactttggcctgtaattcaagcgtgtaccacctgatggaatgaatgctctgttaaaagaacaaagcaagctttaacttaccaagtgttaaccaatggttagaaactgttatgacctcattcacaacacaggacattagagattatttctgtagatgacatcttctgtgtctgttatcatctatattactgactcagccctatttcttttatacagctgtcttttgtccagaaagaaattctaatcttgtaacgctctttggcttagcattaaaaatatatccccccttcttttttaagatatatagtcagtaatatatgtgtgtgggtatgtgcatgtgattggaggtgctcaaaggcaccatatgaccctggagctggagttaaaggcattgtaaattgcccatctggatgatgggaaggaaactcccaaaccattttcaaaacgtttccccattactggagtactttaattacaagtctgtgtttgtttctgctttcaatcttactcatataatccaaccagggtaccttagaatattctactttccaacttatctcttagaaattttactctctgttgtctgatcattattctgtcttttaaggtaatccctcactctgacactgtcttaccatacatggattttatgttgttttgttcgtgtgctggttttgctgttttaaatgtatacttgtgtttgaaacaggggttccctgtgtagaccagaatggcttcgaacttgccattgttctgcctctgcctcctgagcactaaagttatagctatgcagtattttgcctggctttaccatatatgtttaaaatgaatgctactttgtcttgattctgctatcccatccatccttaagaccatgatcatcccagaatgcaggatggttcaacatacaaaaacctgtcagtgtaatccaccatataatcaaactgaaagaaaaaaactacatgatcatcttattagatgctgaaaaagcctttgacaaaatccaacaccgttcatgataaaaaagtcctcaagaatttagggatacaaggaacattcctttacagcaagcctataaccaacatcagatttaatggagagaaactcaaagcaattccactaaaattgggaacaggaaaaggttgtccattctttccatatctattcaatatagtatttgaagctttagcagaagcaatatacaattgatagagatcaacaggatgcaaattggaaaggaaaaaggcaaaggatggtcattcacagatatatacatatatgtgtgtgtgtgtgtgtatgtatgtatataaatgacccccaaaattctaccaggcaactcctacaacttagaaacaccttcagtaaagtatctgaaaagattaactcaagaaaatcagtagccctcctgtatacaaatgacaaataggctgaggaagaaatcagggaaacagtaccttagcctcagataacaatttttggagtaactctaatggagcaagattagacttataacttcagcctggcggtggaggtacacctttaatcccagtactcaggaggcaaaggcaggtggatctctctacatttccagccaacctggtctacagagctagttctaggatagccagggatatacagagaaaccaagtcttgaccctcaaaaacaaacatccttcaagttattgaagaaagaaattgaagaagatagaagatggagaaatctcccatgcaaaaggttagggaacggttaacatagtaaaaagagctaacctaccagaagcaatctacagattccatgcagttgtcatcaaaatcttcatagatcttggaatgataatctttagcatcatacggaatcaaaaaaaaaaaaaacaccccaactccctaaaataatcctgaataataaaagacctgctggatatatcactatccccggctttaaattgtgctacaaagctatttttttaagtcagcaaaataattcataatagttaaatatctcttaaagatacatggaatcttctgaagctaaaagtaatatgcactcaaccagttttttaattttatttggaatattaaacatgatagaaatagaaatagaaaatctcttatgaagtcctctatgagaggaaattgtgactagttcctgattagacagaaactgtcccatcttcaagggagaatacacagcataactgtggcttcatagaatgagttgggtagtgttccttctgtttctattttgtggaatagtttaaagagtgttggtattaggtcttctatgcagatgtgatagaattctgcactaaacccatctggtcctgggcttttttttgaggggggggggcaagacttttaatgactgcttctatttttttagtggctttgggactgtttatatggtttatctgatcctgatttaactttggtactgggtatctgtctagaaaactgtccatttcatacaaattttccagttttgttgagtataggcttttgtagtaggatatgatgattttttgaatttccttggtttctgttgttatgactcccttttgatttctgattttgttaatttgaatattgtctctgtgacctctgatgagtctcgataagggtctatctatcttgttgattttctcaaagaaccagcttctggtttggttgattctttgtatagttctttttgtttccagttggttgatttcatccctgagtttgattatttcctgccatctactcctcttgggtgtatttgcttctttttgtcctagagctttcaggtgtactgttaagctgctagtgaatgctctctccagtttctttttggaggcatccagagctgtgagttttcctcttagcactgctttcattgtgtccctaagtttgggtgtgttttgccttcattaaattctaaagtctttaatttctttatttcttccttgaccaagttatcattgagtagggagttgtttagcttccatgtgtatgtgggctttctgttgtttttgctgttactgttgccttaggtcatggtgatctgataggatgcatgggattatttcaatcttctggtatctgttgagagttgttttgtgacaattgtatggtcagatttggagaaggtaccaagaagtgctgagaagaaggtgtattcttttgttttagggtgcaatgttctgtagatatctgttaaacccaattggtccataacctttattattttcaatgtgtctgtttagtttgtatttccatgacctatccattgataagagtggggtgttaaagtctcccactactgttgtgtgcagtgcaatatgtgctttgagctttagtaaagtttcttttttgaatgtggttacccttacatttggagcatagatattcagaattgagagtttgtggtagatttttcctttgatgagtatcaagtgtccttccttatccttttccacaacttttggttgaaaggtgatttttattcaatattacaatggctactccagcttgtttcttgggaccatttgtttggaaaattgttttccatccctttactctaaggtaatgtctgtctttaacactgtggtgcgtttcctgtatgtagcaaaatgctcgctcctgtttacatattcagtctgtcagtctatgtctttttattgggaaattgagtccattgatactatgagatattaaggaaaagtgattgttgcttcctgttatttttgatgttacttttatgattgtgtggctatcttcttttgggtttgttggaagattatgttcttactttttctagggtgtagtttccctccatgtgttggagttttccatctattatcctttgtagggctggatttgtgaagagatattgtgtgaaaatttggttttgtcgtggaatatcttggtttttctattctatggtaactgagttttactgggtataatagcctgggctggcatttgtgttcttttagggtctgtataacatctgtccaggatcttctagctttcatagtctctggtgagaagtctggtgtaattctaataggcctgcctttatattttacttgacctttttcccttactgcttttaatattctatctttgttttgtgcatttggtgttttgacaattatgtaacaggaagaatttcttttctggtccagtctattaggagttctgtaggctttttttatgtttatgggcatctctttctttaggttagggaagttttcttctataattttgttgaagatatttactggccctttaagttggaaatctttactcccttctattacctaatatccttaggtttggtcttctcattgtgtcctggatttcctggatgttttgggttaggagcttcttgcattttgcattttctttgactgttatgtcaatgttttctatagtatcttctgcacctgaggttctctcttctatctcttcttttctgttgatgatgcttgcgtctatgactctggatctctttcctaggttttctgtctccagggttgcctccctttgtgatttctttattgtttttatttccattttagatccgggatggtcctgttcaattccttcacctctttggttatgttttcctgtaattctttaagggatttttgtttttcatcttgaagatctacctgtttacctgtgttctcctgtatttctttatggaagttatttatgtccttcttaaagtcctttatcatcatcatgagatgtgattttaaatcagagtcttgcttttctggtgtgttggggtatccagggcttgctgaggtgggggaactcggttctgatgatgccaagtagccttggtttctgttgcttatgttcttgacctttcctctcgccatctggttatctgtggtgttaactggtcttgctgtctctgactgtggcttgtccctcctacaagcttgtgtgtcagtactcctgggagaccatttctctcctggaggaatttggttatggagagctatggcacagggtcagctcagaggtgcagacagaaactggaaggatccttcctgtctttagctattccttgattcctgtttcctgatagctctgggtgggtccctcttgggccaggattttgaacagaattggttgtcttacagatgtgtcagcactccttgtacaccagctctctccagaaggtatttcggtgtggagcactatagtatgtataggatcagctccacacgcagatggaaactggaaggatcctgtcccagggtgctcctcagctcctgtgccctgagggctccaggcggatccctctgagcagaagttgtggtcttacttgtgctcacaggcttgtcagcactcctgggagatctgctctctccgggcagtatttggatatggagcactgtggcacaggatcagctcgggatgcagatggaaaccggaagtgctacagagctattgtaataacagcatggtattagcaccagaggaaaaaaaatacatgttgttcaaattgaattgaaggcccagacataaatctgtctatatatggacaccttattttttttaaaagaaggtagaaatacatactggaaaaaaatacagtatctttaacaaattttgtggttcaactgaacatctgcatgtagaagaatccaaatagatccatatttatcaccatgcacaaaattcaactccaactcaaagacctcaacataaaactgaatacactgaacctgatagacagaaagtgggaaatcgccttgatcccattggcataggaaaatactttctgaacagaacagtcactaagatcaaaatacacactttgggtattatataagtctattgtgattgtataaatccaattgatatttaagggataatacagtaggtgttgtatcatgccaaatgaacttatttctttcctgtaacaagaatatagcaagccagccctggtgtcttgtgattgcaattccagcacttggaaggctgaaacacaaatttgagaccagataagagtatatagcaaattccagactacgttggattatagtgtgaggacttgtctccaaaagaaaggaaaaaaatcaataatagcaagaggttctcatatgtgagatcctcttttacttaggtaagggcaaaagttactcttcttagtgtgaattactcatttgaaactcatttctttacatctttgcaatagagagttattgcattcgaacattagaaggatttaagaatgactgtgtacacacccgtttaagttaattaagtaaaaatactaacttttgtcttattattttccagaacctttgtttcattttgccacaatttttgtaccagttcttctgtggattctcacaacaggtatgtgccattcttagcagaaatgtagagatacaagaagtataatgatggctggctcagaaatttggttagttcataagcactttaatgatgttgccaagctggtgtgactggagcatctatgaatgcattttcaaatttagagtcaagctttatcttgattctaaatgctagaaagtaatgtttttcttaggatattacaatattccaaacaaatgtcttatcactttaaaacttgcagtatagtgatgaagacgaggcagacacttaaacacgtgatgtggaatgctatattagtgctctgaaggaaaaaatataaagtttgtaaaaatataatctaataataaaatgatatactgtaacaaggtgagaggctactagtttaaaggagctatctagaacaatctcttaataagacaacattcagacagagaccggcgtaccctagggaagaaactaaacaaacatctttaaaatgttccaggtaaggagatggtcactgagtgggtgatataaactgtgttagtgctggcagcaacatgctgtattgtatgtttggagtacatatgtgtagtctttttcaattcatagcctcattagttactttctggaattcaaagtagactaggaaaatgtagaaattgaatctatttaaaacaaacaaaaaaagccctcgttttctttagtaaagctaggatattacttctttgttttttccatgaaaagaatatatttgtaatacctttaacaagatgactgtattatcaaataaaccttgtttgtagaccattctgtctcctcaaattatgcatttgaaaattgcaattaactctcacgtaaccttaaacttccatcctgaatcaaaagtagattgatgcttcttttgtttgaagcaaatataagactatattacacaccagccagtctgaggagttgctgttttaatttactcattagggaaaatagatagtttcaaaagcaaatttagtagtgtatatcatgaactagtactttcatttgaaaattagaaatatagcatattttatgctttttaatttactgcaatattttttgctgatcttaaatctttatatgtgaaagttgtctccatattctatgcagagccatccttttaatttcattgactatgctgaatatactatttctctcaccctttttgttgttggtggtggtggtgatgtttttgaaaccaaatagtgtcatgatcccttcctcttggtctactagctcgctttataaccccaactctacttactctttgtcttgaatttgaacaccttggtgaataaagggtaaatcatattagtcctcagtgcgtggcacttactatgctttctattaatggtttgatgtcaactagggaatgaactaaaaagttctgttcaagttgtttccaacgttttcacatgaactttcatgatacatggatgtgtacttcactggttaaaaatatgaagttgtattgattagtgtcacctttaaatgaattttattaatcagagaacacttacataaataaatgtaaaagtgtgtatgaagtatgcctttaattcagacaatacaaaatagttctatgatgatacgtagcagtgtatatctaatactaaactcaataaatacttgtacctgaatgaagttcataaaatatttaaaatttttttcaatagaagttttataggcatggtggttaaaagcacatattgctttagcagagaactgaatttggttactagcttccatgttggatagctcacaaccatctgttgtaactccagctccatgggttcttgcaccctcttctggcctccttggacacatatgttcacataaatttacccatacacagacctaaacatatacataacttttaatcctatagaatttttttgaaaagttttgtgtttcctgtatgacctttacaaataaggcatgacttctgagttcacttgtctagtatttactgaaagctttcaagattccctcctctgttttgggagctcaatactgtcaaaacactcaagacaaagatcaataaggcccatatttatagttgaccgagttaggtttattagtcattaggaagtgagtacacaaacaagaggaactgtcagaaaaggatgctacaatggctttctcttagtatttgagctttattacactatttgggattggaaaatactaactcaatatctataaagtaatatccagaaaaaatctgcaatatagattggctactccctatgatttagtttctctaaagagtcctggattgtacatatatggtcttttctaaaataactaaatatctacatttttagcaactgaaaaatcagttagtaggaaatattaagatcctgatcctattaaacggtcaggtatgttaattatgacaaagaatttttcagtattttttatctttggcaggtaaggtcacctaatttacaaagttttctttgttgccccaaaaagtatttaaaaaaaaaactatttagctagaagttttacaaatacataattatcttatagatgaatgacctcagtccattgttttcctgtttgtttgtctgtcttttcagccactctatgatgctgcttatcttacaatgtacaatatctgtttcacatccctgcccatcctggcttatagtctactggaacagcacatcaacattgatactctgaccgcagaccctcgattgtatatgtaagttggaaatatcatttatacaatttcccactctatagtccaagtttgtttggaacttgtggtgtggctcagactagcctaaaatttgtgaaatcctcttgtgttggtcttggtattaatggtgtctaactcactatgctgggcttttaagtagtgtgttttatttcatctacagataggaaggatacagaactgctcacgtagttcattaagtggttcagctaaaacagatcactcaacaagaaagtggtacatttcccgagataccagtcctggacttaatgcatatatttgtgatgtatggataggtcacaagttatttcatagtcttacacagagatgtaaaatataggctataacataactatgacccagcctaaagtgtaacttaccatcctaacattgtaagcagtgggtactcactttgatcaaacttgattttagcttgttcctagacaacagaatgttattagcttgacaactgtataaacatgggtctctaaagtgtcctattgaattttagccatgaacgttatatatttcacctttaggacttagtgactcagacattttgaaagatattgatgtgaaacatttggctatttttatatccttaatagacatttgaaaactgaaataattcttttgtgcagagagcaggtagctaacttcttgacctttaaagaacatcctggtaacatctcctgcatatcatatggagttactcaagctgtgttgccaatcagcctttatccagatagtcattcttggtttttttccttatgctttctttcatgctaggtcgcatacctattttgatttctaacagcttcttcatctaagtgtggctaagaaatctagctggtaactcagtataccatgatacccttgccaatttttcccatagatttttgcaaggacaggaatcactttctactcttaacctccttgccctagtctaagtcagtgactagaaaagtcacattggcactaactccaggggtctttagagagatatttttcctgtttctgagaaacagccacatctttcttctcccacttttctttttatagacaacatcctttgaatttcagatttatacctataagataaaaggttgtatgatttgacagtattacccggtgacatttctatagtattatcagtaggtgtgctatttaagtgattagatactctttgacacatggtaagaggaattagaaatagaagcaaaaaaagatccatacacaaacctatctttgttcagatctgcttcattagaagtaacagccttatttcactttctaatgttgactgagaagaatgtgctagttttgaagtgttcattttactctgcctacctgccatttatcaggacatcactgtacagcttcgaacatgtgatttgacttggtggaaaactaagacctacttaaaaaatgttacacttccagtaagaaatttaaagaaatatatgagcagatacaattagaaaacttgctagcattgttaaaaatatgtatacatttgttgttgtgtttgttgtttgtctgtctgtttgttttgagacatgggcttactgtatagctctggctgtccaggaaatcactatggaccaggctgatcttgaagagcaacctgcttctgctgggattaaaggcatgtgccagtacacccagctaagagaacatatgtttgaagttaatttaatgcaggcctttatattagttttgtgtcttactgagtgaattcctatacttagaatcacttgaggaactttaaaatactctgatgtccaggttatatatcatagtaataaaatcagaatgtatatgtaaatcagggatcagtatttattaacttataatacttgttgtttgtgtactatggtattttagttcaatacatgcataatgataaagtcggggcagttaatattttcatcttctcacataccatcatttttctgtgctgatgaccttcaaagtcttctgcttatcttgaagtgtccagctattgtaaactgtggttaccttactgtagtataccacattagaactacatctgactctctaataagtagtaactctataaagatataactttggtccatctatccttttactaaaaaaaaaatctaattattagggtaggcccttcattataaaaaagtcaaataaatgcccacttttcttgtttccttacatatttaagacaatagcttacagagatttattaatttttccctccatttcttaataggaaaattaccggtaatgctatgttacagttggggcccttcttacattggacatttctggctgcatttgaagggacagtattcttctttgggacttatttcctttttcagacttcatccttagaagacaatggaaaggtaaaatgaacatgcatttttccatgggcatggcatttatcacatgcatattcttgtggtattaatttttcagtattcattttggaaacttttttaacagttctttaacataaagaagttaatgacataagaaattccttttgtatgtgtatgtaagaagagaacttaagcaaaacctttgaaatcttaatttctctgtagtttttaggaagtgaagagagttcttgatactttagattttatccctgtgtgttgtgacatttaaaaaaaaaaagtcttttttccatgttactgcatagtctgaccatctgcatttctaattcatagttagtagatttctgtgtttggagttgaagcaggcagctaccgtgtctgtgtagtgttagaccagtatgtaaagagagaaatcttttctctcctccctgcttttcaaagtgggagtacagtgatgtttgtttgtttgtttgtttgtttgtttgtttgtttgtttgaagagttctgttggtgctgctcctaccttctgagaaaatggcaatagcagtgagaagctgcattgggacaattttgtcctactcatacaataggagaaaattactgcagcaagggaggaggcctgaaccttctgacttgcatgttgtttttattatgttctcctttgccatgtttggtactcttcttttatggtcattcttactaatcataaatatgaagcaaaactatgtttcaaaagtaatttattacatataatctgtctgaacctacataactaacatctcttacaaaaatgtatgcttaatgtatttgaatgatactttgaaattagctgttacaatcaggcccctctaagttagtttagtatgaatcccaattattagtcatagtataatgattaggaaaatattaattacccttagaatacatataccaagcacttgccacagatggtcctgcaaaatcccgggtatcgttggaaaactcacattagctttccaagtcagcttttgtggtctagtaattagaaattcagttttgtgatttctcagatccttcacctatgagtaattctgtgactttggctttttatttttgacacaaaaaatgtatagagctggctactgctgaaaactcctttgcttcagatttattttatgttcacattcattgacttagctaacgtaccaggttgaatcagtggcccagccttttctgtttccttttgtattttgactttatgaagtccaaattaagattttattgtatatgtcaccatcctttttaaatgttttctaaaattacataagtgtaagaattatcagcagctaaacccatgtatgatttggtcaaatccttttttcttctattaaccttattttgtttttattttgtaaaaacgttttacatctcattttctgtttcaatgttctgcattcagatcttgacagcgtttggtaagcatatgtgccattcattgccatcctttggatttataagtggtactgcttctctggtgtgcacatgctaacagagtgtttatagtcataaattagactccctttagaagtgtgagtcctttcgtgcttatgtgagaactctccttatattctaggacaaaaacatcaaactcattagtggcatgagttattattttgatgaatggtgcttctaggggaatagtattctttttcttccacctttatcaaaccagtgagctcactgtttgatgctgtatggtaataaatatagtcaccagtgtgtatctattcatgaaagtctagtgttgcatcttaatcttagtgaccagctattttcccaagtaattcataaaaagattgctgtcaatttccttcaggattaaacttgactttttatttcttcagcagacttgtgtattcatgatacatataattgttaaatgtttttcagatttatggaaattggacatttggaaccattgtttttacagtcttagtattcaccgtaactctgaaggttagatttttattcattcaaatatattttgtttaactttatcgcttaatctttgtattactatttgtcatccaccccttgtctgaatgcttactaaaaagtgtgtaatgataagggttttagcatttgtatactatttgtcactttgtctagtacatattctatgctattttgttttattattaagaaattcagacaccacacttacattggaaatctattccttcttaatcactgccattgttttgttttattattgaaaagaaatttagtatattctgatcatgctttcaccttcccaaatttctcccagatcctccttatcccctaagtccatgttttctccctccctccccttctctctctgtccctccctccttctctccttcttacactatgtccttccctctctccctgcctctcttcctttctgtcttcctctgtctttctcactctgtcccccccccaaaaaaaaaagaaagaaagaaaaggaaagaaacaaataaacaaacaaaacaaaaccataacgcaaagtacttggaaaccagaagcaggaatgggcatggattcccaactgctaacctaaaggccatctgtaattgacacctgcctgcaaatgtcgtttttaaggcattacactaaattatataaacagggtgagagctcacgaatatatatttataatagttccatgttaagtacttatatctggggactgaagagatggctcagcatagcacttgcagatgattgggattctgttcctagcccgcatattgcaaggttcacaactggctgtaatatcagctgcagggaggccagcagcctctttgggtatctgcatacatttgcacatacatataaaaattaataaatttatatctgaatttcttttatgtttaaaacaatagacagtcactgcttttgtcctttttgttgcagcttttacttcccaatgagaaaggtcctaaagcaagtgatataaatgtttatttgtgtgtgtgtgaatgctttgcttgcatgtgtatctgaacaccatatgcataaaatgcccactgaggccagaagaaaatgatggatctcctggtactagagttagagacatctctgagctgctatgtgggagataggatataaacctgggtcctttagaagaccagccggtgctcttaaacctctgtgccatctttctagccactttatcactttttatttttttaaaaaaattggatctttaagaggcccattggtcatgcaaactttatatgccccagtacaggggaacgccagggccaagaagtgggagtggggggggggggggtaggggggtggggggagggtatgggggacttttgggataacattggaaatgtaaatgaagaaaatacctaataaaaaatattttaaaagaaaaaattggatctttaaaaaaaatggaatctctataaggatcagtgggtgactttccaggacttttagtgatgaagaccttgaaataaatgtctgtatacaagacatggatgcaaaagaacttggtggtaatgtaattctgtaaattctattaattactaaaatatagcaatatgttagttaaggaagtatgtaatgatatatgacagcgatagacatgattatctttgtaatccctgtatttagaattcaagaccagtgtgtcttacatatatgatgtataaagatagttgcctctacttgtagtgactctcagctgttggtgcttttataacttgtatgtactcctcttgctactcttaccctctcctgctttttggcatacttgcctcaaggagacactttatcttctcctttattagtatatccctggccactactccctgaagacttgggactttggcctcctagttattactattgcttcacacgtcacctgtcattcaacactgagaaatctgtagccctccacctacaaatgggttgacttcactacacttccatgccttgctatagaatttagaaacctcagggcagcactcaacattcttactttagtactttaaaaagactagtttctgctcttttagttacacccccttctaaagtaatggctaaatatgaatcctcccataggtattgtatctgtataaattgtcagatatcataatatattacctggcatatttttgtgatatatagatatatgtttgcattgtatcttttcagctcgccttggatacccggttctggacatggataaatcattttgtgatttggggttctctagccttttatgtttttttctcattcttctggggaggaattatttggtaagcagctgtacctgtgtgagcaatattaactttatatgtaacttttaaagttttgattatatgtgatatataatattactaatctataaatgttaatggattagaggttacttatgccttataatattgctagctctaggtaaaacttcaaatatgaatttcttagtccatttattcaaaagacctggctttgcatagatagcctctgcccaaatatttacatttgtaggcatataggcagctctttcaaacacaacaataaatacccagaccttccatgtgatttccaatagaaaggctcaccttgtaaagtttctaccttataactttgaccaaacatatatcagtgtccatttatacctgtggttcacagcctggggatcatggcccctttgaaggtcatatatcagacatttacattatgattcataataaaataaaataataaaatagcaaataaaataatcttatgattgggtgtaatcataacatgacgaactatattaaagggctgcagcattaggaaggttgagaactactggcagaccctaatgccacataaatggtatcattttccttcagtaggaaaggcaggatcatcataatttcaaggtcatcttaagctacatagtgagcttgatgccagccatacagagacccagtatcatccttcatacctcctaaaaggggaaagagtttttcttttgaaaaactatttaagggggctggagagatggctcagtggttaagagcactgactcctctttcagaggtcctgagttcaaatcccagaaaccacatggtggcttacaaccatctgtgatgagatttgacgccctcttctggtgtgtctgaagacagctacagtgtacttacatataacaataaataaatcttttttaaaaagaaaaaaagctatttaagataaagtccttaagaaaatctactttaagaatataacacctaatcttttagagatgctattatacaactaaaccaaaatgtattaactaaatacaatataaagttgtttgtttacccagaattctgtgactctgtaatcaacatatgaaagttagacaaattttctcaataataaaatatttctagaccctaaacggttttgaacccttcctacagacttttcctcattgattaagtcatttaaaggaaaagttgttttgtttttttgaatctaagtgctccgtctgaacgtacacctgcatgcaagaagagggcatcagatccctttataggctgtgagccaccatgtggttgctgggaattaaacttatgaactctggaagagcagccagttctcttaaccactgagccatctctccagcccctaaataaatgaaaggatttttgtcatacctatttgcatttagtagtaatacctactgtaaatgaagtacaatagccttatttatggtttgatttgagggtttcaatttttctcaatgaaccatagactaataaatacatgaaaaactagaaataaggaatgcataaattttaaattgcagttttctttagtgtgataaaattgcatgccacccatctctgtcctgttagagacatgaaacatccctttgacccgtgtttacttctatttgggatattctggagaaaattattttaacatgtgtgaggaagattccttttaaatgcaaaagacagtttgagttaaatttctgttttacctgccaggaactgatttgattttacattctgtgttttctttccattccaggccttttctgaaacaacagagaatgtattttgtgtttgctcaaatgctctgttctgtatccacatggttggctataatccttttaatatttatcagccttttccctgagattctcctaatagttgtaaagaatgttcgaagaagaagtgccagggtaaggactaaatttatgttgtagcctaatatttggaagaggcttcactgtctaccgtgaactgaaaatcttatatagagaattacattagttacagcatgttaaacccctccttgcaggttcatcacttaatttcctcttctgcataaaaagtatagtaaaaacttcgttatccaatgcaggtggtaagtagattccttaatagtgttctgtgtcatctttagcaatccatatggagtatctcatatgctccatatggaatttttaaaggaaaaaaaagactttattttgtatttatctcagatttttcacactaggaatttccacaccaacatttcaactttgaccttagaaatttccctgtggactgtttgcagatgttttgtcagttgatatcctgatttgcctcttccaaagctgtccccttcctgtgattatagtgctgcttaatctctgtgctgcttctagccctgtctcatagcaggatagttgaaccaaagagaactgcttggatgtacctttaacatccttactcttcgggacacacttgtaaacattgatgatagcttataagtgtgtttttatttttaactactaaattactgtgaagagaagttatctccctctgtcacatctgataccttttgaacatttcttttaaagcttttaaagtgaaagggttagaattgcctgaaaaatgaaaccactggcaaatttttaccagcagatgaattaagtaaatcatattgctgccaacagtcattcctcttgttaaaataaagtcctacttctgtcatactgatagccactaaatcttataacacctctaaggcagtattttagagaaatagtcaagtaagtcctgactgtctgatgtgtttaattaaatttatcaacccattgaaccacaaaagtagtatatcatggagatctttctgaatattgaattacagaacccagttgggtgacattatatagaaacaaagatatgaaattattatactagaagtcttcaaccaagttttaaagaactaaaaatacagctttagtggtagcactttaaaaacattcatgatacctttaatccttagtaatg

SEQ ID NO: 716 - DNA, 2071 bp, mus musculus
caagctgcgaatgcgaccagctcgagagaacgcatcaggtgagagaagcccgcgagttcccgccgactttgcgcggagcccttcggctagcctgcccttcccgcctgagctgccggcccgccggcccctgagcaccactccgacggagtcccccggccttttcacggtggccgctccagcccccggagcgccgtctcctcccgccacgctggcgcacctccttcccgccccggcgatgtacagcctgctggagactgaactcaagaaccccgtggggccgcccaccccagccgcgggcaccggcgtccccgcagctcccggcgctgcaggcaagagtggcgcgaacccagccggcggagcgaacgcaggcaacgggggcagcgggggcgcgaacggcggcggtggtggtggtggcggcgggggcagcgaccaggaccgcgtcaagcgacccatgaacgcgttcatggtgtggtcccgcgggcagcggcgcaagatggccctggagaaccccaagatgcacaactccgagatcagcaagcgcttgggcgccgactggaaactgctgaccgatgcggagaagcggccgttcatcgacgaggccaagcgactgcgtgcggtgcacatgaaggagtacccggactacaagtaccggccccgccgcaagaccaagacgctgctcaagaaggacaagtactcgctgcccggcggcctcctgcccccgggcgccgccgcagccgccgccgctgccgccgcagccgccgccgccagcagcccggtgggcgtgggccagcgcctggacacgtacacgcacgtgaacggctgggccaacggcgcctactcgctcgtgcaggagcagctgggctacgcgcagcccccgagcatgagcagcccgccgccgccacccgcgctgcctcagatgcaccgctacgacatggccggcctgcagtacagccccatgatgccacccggcgcccagagctacatgaacgccgccgccgccgctgccgccgcctcgggctacgggggcatggcgccctccgccgcggccgccgccgccgccgcctacgggcagcagcccgccaccgctgccgccgcggccgccgccgccgccgccatgagcctgggccccatgggctccgtggtgaagtcggagcccagctctccgccgcccgccatcgcttcgcactcgcagcgcgcgtgcctcggcgacctgcgcgacatgatcagcatgtacctgccacctggcggggacgcggccgacgccgcttctccgctcccaggcggccggctgcacggcgtgcaccagcactaccagggcgccgggactgcggtcaatggaacggtgccgctgacccacatctgagctccggcccgcgctcccagctcttcgcccccaccccgccccacaccccccacgttgggacgccttgctgtttagctttgctcgcctgggaccgttgccttgtaccgaagatgaggaggaccgaaagtttggccgtaactgtcggggttttgtacaaaagcgagaagtcccgagcagcggaaatgggacttgctagagccgctggcttctgaccactgcccctccctccccctctggctgggaatcgctgtggtgtttgcggagaaaccgcggccccttcctcttcccggattcctaggttcttctgttgcagttgaaaatgtcttgttagtttgctattaatcgagaactgagtgaggttgcccgcccccaagaactgcaatgcctccacccccagtcgtattgcttctgttttcctctggcttttttttggggggggggtgctggccgcgccaattggcgcgacagctaaagccaatgttaatttatagccaggtgtgcgtgtgtttcccgccttgccgcccctggccgcgggacagctctgtccagtgcgcgtttaggctgttgagtttgtgatttctgcagtgatctatttgctatttcgtgtacgcatttcgttcgggtggtggggaaggggttattttgttccaggttttttcaaagttttgttcttaattgctaagtgagagatcaataaattttataacc

SEQ ID NO: 717 - DNA, 2071 bp, mus musculus; identical to SEQ ID NO: 716

SEQ ID NO: 718 - DNA, 21761 bp, mus musculus
gtcccgatggttggcttcgctcctgccgcgcgggttggtgggcggagagacctaagaaactggtgagcttttagcagtgtggcggcggcctgtaagcttggggggcgtgaaccagttgtagttcagagcgcgaaacatggcggaggagggtgccggtgccgggtctgatgacagctactacaaagatgtgggtgatgactgcgtggtcaaggcagctgtagaggtgttcgagaagctgaaggtactgtgagccaggggaaccgctccttgataggggaccaggtggggccccgtcccagtgccatttggagcttcctgtggacattgaccgcaccacaggggtccacagtggcaggccctggcaaagctttgggggggggggcgacttgcggaccatctgtcttaggtctttggagtcctcggacctctgctcgtgctgttccaacagaccattgcaagattgaggctggggacttggagcccatgaaaaatggagaacgcgggccccaatctcaaagagctggaagtgggtggagttgggtttgaggggacagatgggctgaacaccttgccgttttgttgggtcagagacagtgacctccaggtgggtttaaggtacatgcagcagtgaggagcatgaccgtgtaaagttagggagctatcccaggcccattgaaccccttgctaacctccctcccatctccccttgctactgactcagtgatcactttcagtctccctccactgcccctcagatttaatcgtagtcttcttaacccattctcaggcatgttcctagttttatggccgtgaaacccagagggaacacacttaaaagtggtggggcagcaagtcacaggagcaaatgtagggtgaagatgagggacttgaacttttgacaaggccaggaaggggcacaaactgatagaaatgcttagccaccccacagtaaccggcttcctctgacttgccttttccttgtttagggtgtaaactgccccttcctcgacggcctgtatattacagaaccaaagacaattatggagctgctgtgtaggccctcaaagtaccggttggacatactggaatggatgtgtatacggtaatgctctttgttctttcctttccatgaagtgtcttctgggggagatgggaatgtgtcattttagagggtcccataaccaagccagctccaggaaagctaactgagccatgaccaagatggtggggaggtggccctggcagtacaagatggactttaatgaaagccctttctgcaccaggcctcctgggcttttgattgtgttgaggctatatgatgtggttcttgtcactgagctctgattactgtcagcttggacagcacctgatgatcagagagggacgttgcccagaaacccagtgacagaaacgggccttctagattgtttcccttcttttctaccccaacttgcaaagaacagaggtttttcttagtccatcctgagggcagtgcttctaggacagcctaggccttttcagtggaatggaagttgttggagtttttccttgcagttttctgtggaaccagttctgtccagctaggagctctcaaggccagatgcttactcgagagcctcattgttgagcttatctgtgtgcttaaccctgaaggccagggctgcacagccaagtcatcagagcttcttttactataggggccttctagtgtcttaaaatagagctcagcaaggcattttatatgaagggacagctactgttccaactcagtcttgccagggtagcacaacagcagcataggcaggcagcatgtacaggaatgaatgggtggtgtagcaataaaccttctttaaaaataagactgggagcctatatatgggttcatctctctgtaaaagtaactattatttacctgatgtaattgtcatctcatgggcttacttcctccgtctgctaacctaggcctagtactggaagcttctagcctccatacaatctttttttcttattattccacccattgagttttattagtatgaagatcagaccataacaatgggggtcttgagatttacctccctcagattcctttaagggaagagtgggtctaagactcaaggctttcagagaccagcattagaaaacacaggaccctctgtatgcttaggattcaaggcttctgtgttaaggtcatccctacagaaagttcacagcctccgtgcaatcttatctaggcctagcctggtttcagcctctgagactgactgctgaatgagctcaccctttcttgttcttactgagctgtagctggctggatccactcagctgttctggatcaaactcctctctaatctgaccgattcagcctggcttcttcctcacagcctctcctgaattgttctgcttggcctcaaactaacaatctgttggcaatctgttctaattgtctggctcctttttattctctggctcattctgtcttcacctgtgcctagcttgctctctgcaacctgtctctgtacaactgtccaggaaaactgcctcctctctctgaacatgctgtcttgtctcgtctcgtcttttcttcttcttcttctactactactactactactactactactactactactactactactactactactacttcttcttcttcttcttcttcttcttcttcttcttcttcttcttccgcttcctcctcctcctcctcctcctcctcttcctcctcctcctcctcctcctcctcctcctcctcctcctcctcctcctcctcctcttcttcttcttcttcttcttcttcttctttttcttctttttcttttttggtttttcaagacagggtttctcaatccgcctgcctctgcctcccaagtgctgggattaaaggcgtgcaccaccactgcctgtcaaggagccctttcttaagtagcttccctttcctttccttgtgagagtcgggcagatcctattctgtcagtctttctgattcatcactttgtctgccactcaattagccctcactttcaaacatggctgcttccttctacaaactaattttgtcttcattgtttgggattaaaggtgtgtgctaagtgcatgtctgtattctagtcagagggattaaaagtgtgtgctaagtctgagctacaccacaactagaaacagttttttttccaataaataacataatcttaggattcaaagtgtgatcaaatgtcctgcaacatctttcctttaaactgtgtattgaattgtactttttgaaaagtgtataattaaaagtgtccacggctcacacctttaatccaagcatgaaagaggcagaggcaggtggatttctgtgatttccagtctagcttggtctacatagggagttccaggacagccagggctacatagtgagaccctatccaaagccaaacaaagaaaaaagtgtaaaatgaccttttctgaaaagagtgtagcaatggtagaggcaaccattgctccttcattatatacttactgacctctgtttttgtgtgttgatcactgcctagaaatgtgctaggctcaggaagtacccaagggaaagccagtttctggccccagccagttttcattccaggaggatagagtcttctaaaaggttagggaaccttggccaaagaggctgcagagttccttggaaatccttataatcagggctgtccaggctgaggagtgagttgaagtgatgatttaggtatgccagggctaactgggaagccagcgttccagcaggtgcatactcaggccaattagttaggtgtcaaactcccctgcaaatgcccagacttttcctttcttgtgcacttgtgtgtgtgtgtgtgtgtgtgtgtgtgtgtgtgtgtgtgtgtgtgtgagagagagagagagagagagagagagagagagagagagaacttggagtatttccatttctgagggaaattttttcttaagtattttctcatagtaattgatggtaagagtcacatgatatcaaataaattattttaaagtggcctttcactggcatttagcaattgtacaagtaattctctgtttagagagtaggtatggagggtggtaaggaattaggcacatgactgactttgctattttcccacagggtctgcccctccttgcaagacaagttcatctcactgaaagggaatgcattggatttgaagatacagggtaggtctctttataggaatgtggcatttgctggtaaattctgggcagttctgagcttggtcacagtgtctcagtgagttgtgacatttccattaactaatgttttcttttgtatggtgtatactctgtggctattattagagtcttctagaatcacagccttctgggatatagtcccaaatagtacatttgggaccaaatagtgcattgttctaccataacactgagaggtagaaagcattgtttttttgtggtgtcatcagagatctctcagtgtacatattaggtttatatggcattcctaggagccccatgattgctctttaatgtggcttaccttgtcactatgttattttgatgcttagttttttttgttttgttttggtagaaccttaacctggtgtgaatgttacataaagatgagcaaaaaatgatatctgtataagtggcttccttatagtatggccaaacattgataaaatttaaaaatgctaagtttctcaaaatcctgtgtatattctgaccactgcagtgtgagtgagctagacttaggccctgaactgtcctcgttcatccacagtttggagacttcactggacccagcctcacttttctctttgaagatgaaggcctttcccttgttcacctcctcagaatgtgttgagtatttatttgagtggaagtaggagacacgaggacaggaaatcattagtttcattgacatgtgaggcagtgtttgatgtgctagggtacagcagtgaaccgtgccaccctcatggaacttatatgttagatgatgggaagcagagatgatgaagaaggaaggctgcaagctaccagttaagggaaaggtgatacagagggttggaataaaggtgattttattgacagaagatggcaagaagggtagaactgagctctgcaagggaacagccaatgtacaaggactcaagtgggctatgcttggcagctttgaggaagagtaaggaacaaagatggctgggtagagaggataatgaggtatcggaaatcagtgggggggatagggataggtccttataggtcatagagggttattggcttttcttccaaagaaggctttgccctccattaggttcatcaggctccctggggatggatactgtagtgaaaatatgaacacccaggcagcagctcttacagtaactgaggcaagatattggggaatgaataggttaaaaggtgtgctctacttgatttgttgagaggagatcagaaggatcagagggtttaagtgctgtgattgaagcaggctggcttggaggcgtattggcatctgaagagtattcccagggccccagaattgttacacagatggtctgacactacttccagtgggtcttttccagcatgtcctatataggtttgtactgctctgctcctgctgaggcatagcctggcctgagatggggtgaaggtactgctctaacactgatgctggtccaaagctctctaacctttgtttatatactagatggccatgtaaaaatgtgctagatactgcagaagatatggcgaggtattccctattcctcgagggggcttcagactccatatctgtaaaatatagcctagactcactcaccttcaagatggcatgacaggagaatgggcatgagagacatttggctcatctggtcttttgtgcccccacccctgctatggggaaaaaagcctcagtatcctatatgttctaagtgctgggatgtcttgtatcctcctctgtttgggtgggtctacagtgataaggtttttgtgttctaacagagatgttgaagctaggccatgagctgatgttttgtgcaccagatgaccaggatcttctaatggtaagaaaggaacctcttctgtctctgcagaggatgcacatgttgggttttttgtttttgtttttgttttttctgtcctggactggtgagagaatgggagctccagagcccatgtggctggcaagactgcttctctaggcatccccaggttaagcattgcaagaaatctttcagggagacaaacaattgggacagctaatgaatgaaccatttttggtggggttgtatttcattatgctgtttagtctctctctagatagggtttgcttttaagcagagctggttcacagagcttgtcagcagcaagaacaaagaattcccatctccttcctgccactggccccatgtcagcctccctcactgtaggaatgtttgttaccttagtaagccaacatagattaggataactttatctcccaagtgtgtatccaatgggctatgcttctcttgttttctggttggaagttgttacatggttctttgctgatactttgtgctttctgtttcttgttcagaattgctctttcaagcgcttttctaatgattacttgaagctgtcagttcatttgcctttctataatccctgtattggcatctaatgagcatcttttcttgtgcaagttgaggtctttgtggtttttcatatgttggatgattgtggttttgtcctgctcatgttgactgttacttggattttgttaaatttcatggaaagttaagatccatatattccagcaagctctaggtttgctttagtttatgcagccaggaccacccctcctctctctcctgagcttccactgtcagctcatcttcttcccatctatcctgcatgcgccacccagtggttgagcctggcttcacacctggcttagtaatcagtcatatgcacgcacagtcagggctggtccagacttccaaaactgatttttggagttattttcttcatctctttcctctctgccattctccctctcctctcctctcctctcctctcctctcctctcctctcctctcctctcctctcctctcctctcctctcctctcctctcctctcctcctctctctctctttttctctctctctctctctttctctcctcccccctcctctggtttggtttttcgagacagggtttctctgtgtagccctggctgtcctggaactcactttgtagaccaggctggcctcaaactcagaaatctgcctgcctctgcctcccaagtgctgggatcaaaggcgtgcgccaccactgcccagcctctctgccattctctaagcttttcactttcccagagctgtccttttctatcctccagctacagcccacttgcacgacggattaagtaactataaggcagaaaggaaaaactatcaagaggttcctggaaagacactttttatcactgatcaaaagaccaatgaaaatttaaactgcataggcgtgttccactcatgccatgatatctagagttagaaggaaaaatagcacaggatgacaaggatggggagacgtaggaaccctcatatattccagtagggacacaaataatacggctactgtggaagacagttaatacagatgtacagaattcattgtgaatgttcatagatacccattaactgatgaggtaattttcaagaaagaagacgttgctgccacatgtgacaacatagatgatgtttgaggatgttatgctaagtgaaaagcagatattaaaatgtagtataaggtcataataaattgtcacatattgtaagattccttgtgtgtggactgttctgaagaggtgagtccataaagaaagataggagtatagtgattgctaggggctcaggcagaggtaaataagaaatgactgtatgactgtcagtgggtttagagtttgttttgggggtgttagagatgtttctaaaatgtggctaggagacttgaaagatgattcagtggttaagagaacttgctactcttccagaggagtgggtcagattcctagcacctatatggtggctcacaaccacttataactccagttccaagggatagagtggcttttttttggcctccttgggtacttcactcatgtggtacactgatatccatataggaaaacagacacataacataaataaatttttaaaaattgactatgataatgacctcctggctccctgactattctaacaatcactgcactatacatttaaaatttttaacatttaatttaagttaacagaatttaacacagtgaattaaagttaaacaaacaaaaaacactatagccaagtgaaaaaaaaaaccaacaacaaagaacatctaggagaacagcaagtacaagagaccttgtactgtgcttgatgcgttcagaaacctgtcagcagactggttagggcagagtagactggaaacaaggaaaatgaatagagcagagtgggtagatgtgattgatggcctttgtaggctagaggaggctttagcacatacaggggggtatattgggagcttggagctgagggacatggatttctatttagtctgacagtgatggctgtggctaatgtgtggagtggactgtgagagacctgttggcaggttacagcagtgtcgaggcatgtaaggagatatctcgaatggcagtggtagtggggaaattggagtagtggctagattcagccggacccactggatttgttgatgtagtaaggtataggcagggacgacactcaacagtcactctctagaaatatctggagaatgagttcacaaagacttataccttatcatatctctagacctttccagagtgtgattattagtcttgccctttgctggagagtagagaggagacagatagggtatggtatagtgatgggcttcagtaaggtggccacagagcagcctgctggaggccagcatgtacacttgtacatgtacatggtcttgtacagcctggatcctggtaatccagaagggtcataagtgactttgtggaaccattcttgtgttttgatctgggctggttccagtttaaacagtgtattgaccttctaccacagactgctctgcaggtgtgtttcttaggcaaatggggaaattgagtcaacaagaaagagcaaaagcatcccagaagtcagagtcaggttaaggacatgaggtgagggctttggagtgggtcttgctaactcagtcatgtaagtagcatttgggtctctttggaactgtctactcctcaccaggggcaacttggccctttttcttcagcatctgcatccagcaccagctttcagcgcttgtttttcttgaaggtgctgggagtggtgattgagtgactctttgatttctcttcctcagaagagtgtgtgccaggcctgggtggtaagggctaggtcttgcttggtgccttattcacacaggaatttgtggtgcggttatggcctctaagatagtatctgctcctggggatcaactttctagaagaaggcaagccttggactcttcactgggcaactccctgcatcacctgggcagatgggcaggcaggagacagggtcagccctgcatgagttgctgcacagaatcctgtggccttcgtggtggaaagcctaggcccctgctggagaacaggccaccgcaggcctcatgctgtgcctgttggcctctgcattcttggccaggagggattgactgaggataccggatctttacttgggggtgtccctgaggattaggccaccatcagattactgtgagttctattctgctttagtaggccctgctgcatgccacccacccactgaataagccttcccctcgggctctgtgacaaaatcacactgtaatatgtttcgacaacagtttgcattttgcattggcagtggtcttccaggtatcattgcagcctggaatgtggcagaagtctgaggatgctattgctgagttcaagaggctaccagcaggggtcagggacagggaagaggaactgtctggccagcccccttgccactggccacagcaagggcagcataggatcgggcacctggaacaggctaggccttgctgggtctagtggcaaatgtgtgtggcttttcctgccagggccgtgagtgtccccagaagcaactacagttcatggacaagatactggatatgatgcagagcctggccactggatgctccagtagttctaggtaaaggtgtcagtgtcacaggcaggtaccctaacagctggtcttagtcttagctatggagatggtagggtggtgagggaatgtgtccccctctggtgacagtagccatgtgtggatccaggcattacaggactgataaattgagacagctcaccctagtcaccatcttgggggttaggctagctgctcagaggccaggaagcggctcagcaaagggtagttatatttctaggatgctgggtcatggcctgagattcctgcactataggctttgggggcctaggtgcctataacctaggcagataggaggggaattaggatgtctgcaagcaagggggcatcaagccaaagcaagcagcgactgggagggatgtaggcagtagagttcctcgtccttgggactgctgggccagtgctcctgttggtaacactgtgttcagggcctgttctgattttgcagcctgaaggaacaccttgaagacaccacagagaagaatgaggcgttgcttggggaactcttctccagccccaacctgagggcaattttgaaacctgagagtgacccatggcctctggacatgcagtcctctctaaacaagcaatctgatgacctgccaaagtaggtgtctgggggactctagtcctagtcccaccccatcttgcttctcttctgtaagatggagctcatagtggcctactgcctatagcagcagtagcagagagctgacagtgtccctccctgttcctcctgcagggctgacccctctgcccagtcagagggagaaaaggtggcagatctggccaggcagctgcaggagagtgctactaagcttcagacactccgagaccaggtgaagggtaccaactctggggcttgtgggacttggggaataggctctgctgagttctagggaaggtggtgttccctcagcttggcatgctgtgaggcttcagtgagatgaaatgggagtgtggaggtaggtgttaagggtctgagcataaaaggaaagaatatacttcagatggcagccatgcactaggcctgaaatcttctcaaattcagccctactggcatctgttggcagggctagatatttagctatggtgactgtggtctgtgcaaacattagcctcatggctgaggccccattcacaccctccccatctctctctctctctctctctctctctgtctttctttcttccttcctttcttcctttctttcagtttttcaagacagggtttctctgtatagccctggctgtcctggaactcactttgtagaccaggctggcctcaaactcagaaatccgcctgcctctgcctcctgagtgctggaggcccggcttcccatctctctttttttttttttaagatttatttatttattatatgtatatagataccccagaaaagggtatcagatctcatcacggatggttgtgaactaccatgtggttgctgggatttgaactcaggacctttggaagagcagacagtgctcttaaccgctgagccatctctccaggccccccccccatctctttctttatggagactttcttcctgttaatttgtgcagtgttatgtcaacttgtgctatgttatgtgggttggtgacatcctaggctggctgggcagcctcaagtgactgtcacccttcattttgcagtgctttgcacagcataaagcagggactgacaccagcaccatagaccagaaacttcgtctggtcatctctgacttctaccagctcatcttggccttcctgcaagtctatgatgatgagctacgcgagtgctgtcagcgcccagtacccagcctgcacccaagtggccccatcatccaagctgtctatcagactctggcttcctgtggccaagtaagacactcctcccccaactctgtgctgcctagcacctcaagagcacgtgtccaccaggcctgggctcagtaccttagcaacccctgatatcaaatgtacaggctggagaagagcttgagagggcttagcctgggttcctcaaccagtcacatggtagaactctggctataggacctttgtcagatgaggacaaacatttctggtgccttgggaggtgatgaaagctgatatgaacattttctccaagagattcccccccgccccgccccaggcagtttccgttcttacttctcttattcctagggaaccttatatattgcttgcattggattctgcttgacttagtatggtgtcctggtcctagcatctatgctgtgttagttcactgttttcatatgcccaaacatgccaagctatattttatctgactgagcactaggccagatagacaaataagatggtagacagttgggtttgtggctaagccattgagtaaatgtagctcacttggctcttctgtatttcaggttcttagaggccaggcttagcagctgaactaattctcatcactgtagctacaatgtgtgtaactctggctttggttcatagtgccatgatgttgatcttaggttataacaagaaaacccaagccttcccagtctctcatgagactcagccagtagagggaagctcttatcacaaaggcactttttggtaggatatctcttttcccacttgtcatctgctttgctcaggtggcacaatgcatgtcatgctagcaggtcactaagaactgagggctgccagaataacatgatagtgtagagtccccactgaatgagggaaaaggagacataggattaaagggcaactctctagatgagagttctgcctctttctgttggctgtctgtcattaggggcttcgatgtaagcaacagatgccatctatatgtcagactagcctcactaaggcctgtgtgccctctcggtcttgacagttgttgagagcagtcatggagattgcagacacctctgccgaagctatgaaagcagcaaggaagcaggaaggagagccaaactgttggagcagcaacaactctgggataagcctaggtaagtgcctgtggctgaggggcaggtatcctttcctacttaatgcaggcctattccatcacagagcctcttcttttttgtgctgggccagctctcaggaaacatgctacttagttttttcttttaatgtttgttttctttcccttgggaaaaaaatgcttccagcattcttggcaaaaaagtggtataactcagaaatgtgtagatgtaaaactaaaagaaatgaactacactctggcaaccataggtcctgggtgtgagaattttcatcagtttcttgctactcttttccctattatcatttcctttctttttatattattgttactagatagaagcaaaattgtatcaatttgattttcattctaccttcccctctctaagtttgtttttgtactgtttgttttttaggtgaggtctctctctatatagcccaggtttgcctggaattcatggttattctcttgtttcagccttctgagtactgggatgaaaggcctgcaatacctccattaatgggtgtggctatgtttcagtaaaatttcaactatgaaaataggcagttgaccctggtttgttgatcctgatgtatagtgctacatcttagtttcaattcctgtgataaaacaccatgagttagggtggaaagggtttatttttttcttatagtttcataccacagttcatctctgaggaaagtcagggcagtaactcaagacagtaagatggaagcaggaactgatgcagaggccatggaggtgtgatacttactgatttagtcagtgtgctttcttaacagcatctaggattaccagcccaggagtggcaccacccacagtgagctggatcctcccatatcaattatcaatcagtctggtgggatgttttctcagtttaggttccaactttttcctcagtgactagtttgtgtcaagttgacataaaactagccagcacaccctgtgtcacactatgctattaatgctataaatattcttcataccactcattctggaatttagggattgtttgttacaattgagggttcttttgtttgtttgattttgagataaggcctgataagacactgtagtttacacttacctagaacccactgtctagcctagactagccacagactcatagaaattctcctgtctcaacttcctcagtgttgagatgacagtgtcagcttccacactcagtcaatttgagagtcttatagataccactgctctgagcatattagaacatatctccctgtgtagacttgtgccagtttctccaggatgtcttcctgggaggaaaactactccatcctgacacactgcctggcaccagtgtgatgtatcatagctgcatgtcctcatcagctctagccatgacctggcatgttgcagcatgtttattctgtatctcagtgagtacttacagagttgcatatttgcatacatttattgatcatttaagcgttcctttctatgaagtacctgtcaaaatcttgcttgtaaaggcttgttttctcattgatttttagcttgttttataatacagtacacagaagccctgggatgctaattgtagcatgtgcatcttttcccaaaatgtgcattatcttttcatagcttgtgtgtgtggtcgttggttgtataatttacgtgtagtcaagtgtaaccataatttctttatggatagaatcttttgtatttgttatagcattcctactctgacacgttatctcccaaggctttctagcatttccttctgtggttaggttagtaatctttccagagttgatttttgtgtagtaggagatgggagttcagtttcattctattctatatggatacacatctgtcccagtagcacttaatggaaacccattctttcccccattggtctgtaaacccatcacctctgttagtcatcaggtctctgagttctctattctagtctgtttctctctctctctctctctctctctctctctctctctctctccctccctccctccctctctctttttatgtcttagaggtcagaaaaaaatggcaaaataaacacataagataaaagttgtttttcctcctctatcccttcactggagattaaatctgggcttcatatatgctgtacaagtgagatacacctaagccctattttaataacagctttactgagatacaattcacataacatagaacttaccctttctaacagtgaacaatccagtttttttggaagggttttcatataattgccagtcatcatagctaagtccagaatatttttaaatatgtatttatttttattttatatatacgagtgttgtttttgttttttgttttttttttttgcctgcatgtatgtctatgcacaatttggatccagtacccactgaggccattggatcctctggaactggagttacagacagctgtgagctgccatgtgggtgctgggactcaatctcaggtcctctggaagagcaacaagtgctcttaacctctgagccatctctccagatcctagaacattttattattcccccaaagaagttctataccagaaggcaggtgtggtggtacatgcctttaattccagcatgtgggagacagaagcaggtggatctctgggagtgagttccaggacagccagtgatacatagtgagaccttgtctcagaaagaaaaagaaagaaagaaaggaaaaaagaaagaaaggaggatgaaaaagaaaaaaaaaggtctgtaccattagcaatctctttttcattttccctacaccccagctcttgacaaacactggtctactgtctttctcctatagctttgcctattctagatatttttcttgtaatggaattgaatagtatatgaccttttgcttatcctttttcatggagcacatagtttcgaggttcatccatcttttgtatggctgatatgactgatgaataaatatttttgttttattcatctattaggagacatacaggctattccttcattttagctgatatgaataatgctgctggaatttttgtgtgaacatgttttttgaatctctctgttctaaagtagaattgctgggtcataaactttttcttaaaaatttattttcttaccacttgcctttagaattatagctaacaacctaaagtactttggtgctaagtttatttcaatagtacacagaagttgtactttcatagaacttctttgccttttcactttggtattttttaaaacttacattgcaatttcatgtattatatgatcatcaacataaatttataataactgcttcatgcagttgcactcaaaattagatagaagaaaattacaaacactatgtcaaatgggttggccacaaatgttgagcgatctgcctgcctctgcctcccaaatgctagaattagagatgtgaatcagcagatctggctttcaagttctttattgatgtaggctgataatcactagcgttcattcatgctttgtagggaaggtctaccagtgacaaatttcctcagtttttgttgatcttaaaataccttccttactttttccttcattaaaaaattcaatgtaagattttaattaattctttgagaatatgatacatgtattttgatcatattcagtcttcactcttccccctaatgtcttccaaattcatctcctaacttgatgttctcaaaaaacaaaacgaaacaaaaacaaatcctaaaaccaaaacctctcaccaaagctgatttgtgctgtccttatatgtgcttttggagtgtggggccattcattggagggaacataattgacttatcagggggcacattcttgtttttctttttttaattcttctttcatacaatatattctgattataggcttccctgtcccactccttctagtcctccctatctcctctttccctcggatccactccacctccatttaccttcagaaaagagcgggcctcccaggaatatcaacatggcataacaagatgcaaaaagactgggcacaaaccctcatgaagggggcacgttcttaaagaaaactgactctccttaccccagcatccatcagctgtcaagagctccactagggtgtgggcttgtgagctgagccagcttcatgctagaatgttgggaaacttgatcttgtataagcaatcacagccactgtgagtcatgagtgcagcatctctgtcatgtccagaagacactgttttgcttaagtcctctctaacctctggctcttacagtctttctacctcttccttcttgatgtttcccgagcctagggggttggaggtgtgatacacatttcccatttgtgaattagcactccacaacactttgcctagttgtatttctattttaaccaccacccactgcccagaaatcttttcagggccatctgttattctccttccatactttgaatatatcatcctactgtcatttgaccttcagagcttctggtatgaaacaaatttgtgttcttattgaaggctcttatatgtaacaggtctcttcacttcccttttttctgatagcttctgacttttgctagatcagttatgtgtctttctctgaactcctataagtttaacacctgtaagttttcccattttggaggtctctggactttgtagatttttgttgttcatcaactgctaagcagttggcagcttttcttctacttcttgttggctcagagtgtcaggtttagccaggaggaggacttagagccttcttttgggaatttacaaagtgctgcaaccttactcctcagcctttattccccagtctttccttctaagttttttgaatcagtgtactattttccttgactgtttcagtaaacaccaagtaaagcacttgactataattgttttcactgggttttcctctgagtagtgatcttagatcacagcctttatgctgtctcctttggggacttttccccctgtgtattttgctattgaacatattcccaaccctctttctcccctttcccttccttcctttctcttcctcttttcttttttcttttcttttcttttgtcttctttccctttctctctttctctctttctctctctctctctctctctctctctctctctctctctctctctttctctctctctctctctctctctctctctctctctttctttcttctctctctctttctccctttttctctctttctttatttcctccctctctctttctttcttttgtttaatttctattttgagacagggtctcactaagttgcccaggctggccttgaacttgcgatagtcctccctcatcttctccagtagctaagattacatacctgggactataggcctgtacaaccaggtcttgattgggattctctctggctgatggctttctttctgtgttctgccctggtatatacctgccacatatataccagatacttgggaatctctttttgcttaatgagccacaagaggatccttcatcttaaaatttatagcatttaccttaatcaccactgtcactggctctcgttgccgtccatataattatattaataaattattcataatctatgctataatttctacaataataatcattaatagccctaacagtgtgctcactctctggtgactagggcatattagcactggtagtaagcttggcagtatgagctgggcactcctatcccaccctttggttcccaatatcctcagtgttgttgaaatggtgagtagagcagggctgggctcctgacccagctcttgtcagtgtggatttctgatttgctttgagacaaattcttgaacactagacatgcccagagaaaaggaccagtgtccaaatccactccaaagctacttgagcctttcactgcccattttttatctgacccattatgggctttggcctctatgagaaacaaacttccccttatctgggggaagtctgtttctatatcattttctgtcttactgatccagatgctgtgactgagctctgttggtgatatgtcccagagtatcaagtaagaggctcttgtaaaggtcgtgtgtctcctggcttatggcattgtgcgaatggatactactgtaacaacacctatatatttaggagacaaagtggccctgccagagctgagaatagagggcacaaatgacaagggagagattaataggtgtggaagggagatagcaaacaggaagaaattctcagacctacagaatagctaagtgacagaatacccccagaaagaattgggggcagatgctctgatagtagatcaaaccaactaataaccactgtggtctcaaggcctagcagctgccccagaaaagaacagaattcatcaatggcctgtggagaaaacaatggcaatgaataaacaaacaagtttgtgatgtaaagccttgaggggccatatgataagggctgacctttcagcttctttctgaagccaaatcaacctgtcaatcattactgctttccatgtacctcttctttaagaccccttcacaggaaagggtgcaaacctctgaacagcatggggggagtatcttttgcccaggctccacaccccaattccagggtagggcagggtacagagaaccagtatggtgaagagaagacctggatacacaggaaattgtttttggaaaacttccaagcaacatgacaggcaaatgtgcttgggtaactgtgaaagcccagctgagaggaaagatcagaagacagtgacataggaggtagtgagcctctaggagcagatgtgagatgagagagtaagcacaaagtacagaacacagaagctggatccacagaaacagaaatgcaacaggggagctccttatttcaagtccagagcaggtgcaacctaaaggaattagtctacaactcaccctgctgtagcaggaccagggtacgagaccaaacttcaagataaaaagccagtatgtggtctcaggaacagccctggggactgagaactactaaagtccacatgttagggcaaagcaggccttcttccaggtgggaaagtgtgaaccattgggctgatagctcaggatagggtgaggcccagggtctagattctagcaacactcagggattgataaaggcagatgccacagaagaaggacagagcagagcccagcaaactgtcatcttcagagggacacagtttgccacagttgaagcctttaactaggataccactggaaacattaacagcaaggggggaaggatccttagggtgctattcaggatgggatttcattattctgcaggcaggatttatttgagcagttaagaacactggctgctcttccagaacacctgggtttgattctcagcgtccttttctggtctcctcaggcactgagcatgcacataatgtacatacatgtatgtggtcaaaatgttcatatacataaaataaaaataaataaatccttaaaacagagatacatgttaaaagcaaacaaaggaagaacttaaattgggtagaaatttagttaactgggtacctcgtaattgtctggtcagagccccggaggtgggtgcgtgtacaggttatgacccccaaagcagtgattctcaaactctgggttgtgacccctttgggggtcatatttacattacaaatcatagcagtagcaaaattacagttgtgaagtagcgatgaaaataatgttatggttggtgatcaccacaacatgaggaactgtagtaaagggtttcagtgttaggaaggttgagaaccactgctctaaaagccatagaatagttctgggttgctggctttgttactgtgtgcacatactggtatcagattaaaacaacgcacaattgaaacaactcttggactttgaggtggcagggacctagcctggcctgaaccttgacatgcattatggtcagtgtgacccagtcagagactccaagctgctggcctagtacgaccagccaagaggccttgcttgcaactccctaatcaatgtttctggattatggaagaagttgcccccccccacagcttccaaaccccttgaggaccaggtgtgagttgtccttactaccacctggtcatgcctagtgagagcctgagcaggatatggaggataggggctctggtaggaaggcaggaaggaatgggtcttgtatggactgccaacttctacctctttactcacttggccgttcgtttctttctctatacagctgccagaattgatgaagtaacacagaagtacaagatccttactgacagatttcacagaggcacaagatgatgcagggctataaagccctccctggagctttcaggagggccagttccaatcctgatcacagcctgcatggatttccacttgcctggtgcttgcagtttgaagggaaggaggaagagggaggcagaaaaggaaggcagagatgggtaggagagggaagaaataaaagaaactcaagcttaa

SEQ ID NO: 719 - DNA, 24184 bp, mus musculus; identical to SEQ ID NO: 86

SEQ ID NO: 720 - DNA, 89563 bp, mus musculus
tgtgaacaccatctgagccaatggctgtggccgcagggcggaggaggctggcaagaggggagggagcgctggctttagaagcacagctgcagagattcctaggggcagaagttgtctgagtgcttggtcggaagctgtagagccagatcagcgactctgcgacttttacgtaagtgctttgcagttccaagggctcgaggggagccggtttcctgggcgtgggtaagagtgggtcctggtgagagcatctccgggaaccttagcaggaacgtgtgttatactaggggacgggggttgggcaaagggggagatcgaagaaaatttcatctggagtctgaggctcggctcccgggcgatcctcgccaacggaatgggtgggagctccaaagggttccttattaccaccctctgccatcactttttctgctcttcgctgcgactgctctctagttcctcctaacttgttgcccaccacagaccgaagggcttaaaagccaacacttacccagattccctaaggcagcgaccacccctgaagtggaaatcctaagcctatcttccctctgccttccatttccagctacagccattcttcaatccatccctccctccctccctccctccctccctcccttcctcctcagccgctggaaaatcccagagctagcagcgtaggtcgcttcccgctagttccaaatcgcccgctctaggtgacccggcgggtttctgaggaccccgaggctcccaaagaggcggggcgcggagcgggtgcggtaccccccccccccccaggaacctggcctcggcggcccaccttctgccctctcctctccccagcccttaggctgagcttcgggactgcgccgcgactccctatgagtaagcagttttttggtttttttgtttgtttgttttgttttttgtttttttttttgtttttgtttttggtgttttgtgtgtgtgttgttgttgttgttgttttgttttgtttttcctttcggtggcagaagctttccaggctagcccggaggtaccttttggttctctcccctagcagcgccctggcggtcagcttgagtcccgatggctctggttgtgcaactcagagctagcgagcagggctgcagcacccgggaccgctctgggacccctgggaggctgagccgagatggtggctgaagccccattcccagactcagctgcacttgcctgtgtttacttttctccgcctgcttactttagcgacctaatgagaggcctgaggacgccgactagccctgcggtcgccagtcccaaagttgctgctgctgctccactagctcaagtgttggcggttctgaacctcccctggctccaggcccttgcttgctccagctttgctgacagtttacatcctgaagactggcttttcactggagctgtataactgactacaccagtggtgcaggtctagcttggatttaaactggggcgtctagtcatataggatcagaccagagggatgctgctatcacccttctactcaggggtaatgcagacagggtgaaggagcttgagtgaatacggtaggtagaagtgtaggtttaaaaacctacggaacagtaagcatttactccatttcaacatcacaatgggtttgggagactaaagttgaacactgagatgcagtttactgtgaattgcaacttaatggccgaggtcccacacttgccaattggcatcccgcatcttaagtctctgatgcccctagggtaatagtcacatgacctcttttgactttaaaactggaatgcaatggctgaggcccatgttccccaaactaccaagacaaaagtgtggagggagttggtgggaggggcgatgtgtgtcagttagcatccactgaactagatttgcatgaggggagcagaaagtgatctgttgctgtggttttaagcaaaattaaaaattaaaaagaataataaaataagaaaaaagctgctttcaaaacaaaggcttcaaatgtacttatgtggtgacatatatctgtttcccagaaattccatataccttttctaaattttaaaatcatcttctaagaaagctaatgtttaactcatgtctcatttcatccctaaatggctggttttgaagacgtatcccacaagatagtgttaaaaaataaaccatcactaccctttaatctgccctatactattctcaatattgggcatctacttaaaggtagagaacaatctcttgtgtaaaattaactatcaattattcgttgtttgaaatttattggcttagaaaccatacccagacctacttgatacaaaatttccaaaattggttgggttttgtgctgtgtggtggtttgaaagtctctgaaaggactttcccatactgtcccatagtggaagtttccctatttagattatatattgtcacatatgaaaacagtgtagaacagccaagtgtggtggtggcaagtgattataagctgagcacttgggaagctgaggcaggggcatcagctgtccaaagccaagaaggactacatgatgccctgtctcaagcaataagtgtatgagttaagaaaacaaggaaattgaagaaaaataaaaggaaagggaaacacgtagaggagtcacccaagtcaggaatttaaaagtctcacttacttgcaaaaacaggctcagtttacacatattagtacttaaaatcaagtactgcaaaccctacaaaagggaaatgagggttaggggttgaggaccctttagagatagatggttcacatgataaaagtcagtcctgactacccaagtccaaccccctggaccaattggatagcagagaactagctcctgcagtttgtcctctaacctttacatagcattcttagcacactttatgtttgcatacatacacacacactatatttttttaaagtaactgggaatatataaaagatttttgctttgcgtctttcctcctagactttttatttaagtaacctgtgaatacctcctgcactctgttttcagctgtacataagattctgagcctgaaaaccacacttatctaaaagcacagggtcctgatgtgcaggctagcctgttgcacaaattagctagcaatggatttaaactatacctgaactcatagagatgagcccccctagtggaaggaaggaaggtgacaatataattttagagtgaatttctaataaaagtttaacttaactaaaaaaaaaccacattgtttatgcagttcagcactgtgtacgtgagtagacactaataaccattgttaatttcctagctttaaaagatgtttagatagatatataaaatgatactagctgggtgaagatcaacatcatctatatgattgttgttattctgtcaagccaaaattatttcaaaatgaaaatattttaaagccagtcgtggttaaattacatctctcattccagcatttaagtggcagatacaggggaatcagggattccaggacaccctcaatcaactagcttgcttcaatgagagcctggctcaataaggcaagaagaaaaatggtttaaattgcttctctctctctctccctctccctctccctctctctctctttctctctctctctctctctcagttatactcatggttttctttttaatcattatttaattgttttcatacaaaatagtttggtcatatttttctcccccccagccctcccagatcctattcatcaaactttatgttttctctctttctctcaacaaaatgaaaatcaaagaaacagaaaacaattcagacaaacccagtgtgaaatcatttctaagaggtggaacactcctgacaagctgggctgcaggctgtctaagtcatatacaaacagaatcctgagcctgagaacccgattttgatccctgtaccacctaatggctgttgagaacagactcctgacagttatcctctgacccccacacatgacatggcaagatgtgctacccaataaatagaattaccactactttctggtccatagcacttcttgaaatgtccatacagttaaaacaactctcattgctggccagaattggaagactgtgaatctgtttttcttctttctttctttcttccttccttccttccttccttccttccttccttccttcctttctttctttctttctttctttctttctttctttctttctttctttctttctttctttttttcctatttttttctgtgacacatggtttctctgtgtaacaagcccttgcattcctggacttggctctgtagcccaggctggcctcaaactcaaagagatccacctgcttctgccttcagagtgctgagattaaagacatgtcctaccatgcctggtctgaaactctaattcttaatttctacccttgtatcccatttgggatgcaagctaaattatgttttgcttctgttatgcttcagttatgtcttttagacactgaagcctaaaatgtctagtctctttgatgatctttagagtctaattgctaaaatgtgactaggtttgtgacatttggagtaggattagtaatattttgatggagataagtctcttctacaaacaaataaacaaaaaaaccatattaaacttgaccacgattattatggtagaatagtatgactcagtatactatcagaaacccagtgaattttttctcctaggcaaggaatatgattgctgtcataataaggggggagggggcagcttggccatgatgcttgaacactcaagtgatgcccttggacaaaggaagaaagtccacttctaactccgtgttttgtttaaggtgtggttcctacttggctttttacatttcttgatatcatattcttggcatatattacaatggcagagatctatatttgtattcagtctagtatactctgggtgggaactatataaagcaagacatttattgtaactgattctaaaagtaactggtatgaaatgagatttgaaaatgaacatctatcaatatatggcagcttgaatatctgtgttttagaattattttgtacttgttagtatggcaggttggttttttttttatagaaaattatctaaaggggacagacagacctgtaaaaagtaagcataagattagaagtttcgagctgggttcacatttcgagtctgtacttattctagggagtggtatgccatataatgtaagcttaatgtgatataggattccaaagctttttggatgcattgttgtgattgttttcagtttggagtcctttgtttaaagttgtggcaactatctaatgcttacatgacaagccccaccccatgtgtgtctgtgtctgtgtgtaccttatggagatggacataaagtctctttctcaatgacctgcctcctttttttttttttttaagacagagactctaactgaaactggagcttgtccatttggttagactggctggccggtgagccctagggatccccctgtctacacctcctcagtgctgtctgtcagttcaggcacatgctacctcatctgtcttttgtgcttatatgttgagaaatccgaacacaggccctcatgccttcatagcaagcacttcactgcagagccatctccccagaccttaaatgccattcttaaaatccaatctcataatacatgggccaatttattttagttatagaggggaggccatttcaaaagattcacagctaaattcagtagtattgaacgttgccatattcttacacttgaaagtaaaatgcgagtcgggattgttctagggatgaagaaatgttctatttaatagaaaatgctgagagaggaggggtgtggtatgaagggcctgtaatctcaacatatcagatgccagtgcacacaatgagttctagactaaccttagttatgggatcttgtctcaaaaaaaacccaacaaaatatggaggtacaagtatattgattggatatagcctcagaggaactgccactgagccagaatttcatcttgagaaactcacataaaattgttatattggtaaataacatttagtccatctatgtactagacactaagcattttctcagttttgaaaagtgcagtagctcaatgattttagttggctggaattcctttttgaatatagctgtagtctggctattctcacttatatttgtttattattgtttttttaatgtatatgggtgttttgcctgcatgtatgtctgtgtatcacttgtggtacttagtgcccatggaggccagaagaagatgccaaatacctgaaatctagagttaaagaaagttttgagttgcagtttaggtgctgggaatcaaacccaggtcctctagaggcccagccagttctctcacccacttgagccatcactccaggccctgttctcagttgtattatcatttaacttcgtgttatagttgcagggctggacgtggatatcagtgcctccctcatgccaggcaattcattctctaatgatcaatatgctgggctcacatgttactttttctttcagtcagagttctgcttatgacacccagactagccttaaactcactttgtagaccgagccagcctttgaacttgtaatcctcttgagggtcctggattttaggcttgcacccaccaggcctggatatagaccgatttttataatatgaaaaagttaaattttcgtaaagcttagaaatgtgattgatgataaatgtagtgttgctgattctattgggtgttgaatctctgctctttcatttctccgatgtctggacagataggcccatttcagtaaatcactgttgtactcatagctagagtttgcttgatttttaaggcatctgtttttaatctatgcatttcacaggcatgttgaaaggataagtgagctatgcgaaagcttggctcttcagcagacaggtgctatatacatccagcatactgtagctgtatttaataactctgctagggctttaacaggccttttcagatgactggggcatagttcaatggcagaacatttgctttgcttgcatgaggttctgggttcaatcccaagaatccctcacacacacacacacacacacacacacacacacacagaggggggggcagttattgtattttcttacttaaatattattcagcatagcatgttaatgtcatcaattgatttttttccttgttactgtttatttttccttattggttgtcaatacagagtctgttctcttcaattttctttttcttttaagttgttcattagtatacacacatttaggtttcactgtggtttttttcgaacagtttgttatggtttattttcatatacctcccttctcccctttccccccttgtagccttccccaccctcctgcctgctttcagcacatgtgtgccagagtgctttctcttcctccacacctctcaccacactaatagtctcagttctagtttcaaagcccgtgcccacactcacttttgcctgtttacatacatataaacattatatgctaggatacacacatgagaggatgggaattttgtctgaatctcagcctcctcacttaaaataatgctttccagattcatccattttcctgcaaatttcagttttctttatggctgaataaaattacccactgtgtttgtattacattttctttatccatttatctgctgatggatatctaagctgattccatttccttgctgttatgaatagagagcagcaataaaaatagatatgtaagtatctctgtggtagcatacagagttcttatggtatatgccagaaatggtagctgagtcatctggtagttctgatttaatataatttcttattctgtatgtgcatgtgtcatggtccacacgaaggtcaaaggacaacctgcaggaggagttcttctatcatgtgggtctcaggaattgaattcagtcatcggacatgatggtatatgcctttacctgctgagccatcttgccagcccagttaaatagcttgagaataactgaaaatcatggctagtttgtaagagtgggtgatttttactatgaaaaatcatttttcatttttaatttgcaccttcttacttcaaccatctgtgacttaaaatagtcaccaggaaaggtattttgtgtaatactgtaacttgtgcattgaaaatagaggtttgattatcctaagttattatgcacgcattgaaaaatgaatgcatatacacattatgattttatgtaaacataggaagtccttacattgtataaaatgcaatatattctcagccactgtctctgtttatagctgagttcatgttctacactctccttgccagggctacacagagaaaccctgtcttgaccccccccccaaaaaaaagagaaagagagagagagaggaagagctctgtataaagacagaggaactttagtatatctagtcccttagagtgtgtatgtattgggtggggtgggatatagttcagctggtagagtacttgtctagcatacattagtagttcctaggtttgttccccagtataacaatacccaaacatggtggcacagtgtgtaaatctcagcactcaggaggcaaaaggaggagggccagtagttcaagattaagtctgaagctagcctggaatacatctctctttaaaatgacctacaaaccactaaagaatagataaaaacatgtgcaagtgccctgtgtagatgcctagagcccacagaggtcaaaagggggctctggtttctctggaactggggttactgctagttgtaagctgcgacatgggtgccaagaaccaaacccaggtcatttgcaagagtggctagtgctgttaactgctgaaccatctctccagccccatcatgtaataaaagtatttaatgaagacttatgtactggggttacaaagaggatagaagataactcctgcaattcaggagaagaaaaggacacaaaggtaatattggtttttatgaaatttaaaaatatttattatagctttttattaatctgtgtgtgtgcacatccaagtgcttctgcatggcacatcaggacatgtggaaactggttcatgcctcccacattattgagacagtgtcttgcactgcagcacggcatcttccagcccatttgggttatactagcgtgattctcctctcgacttgccatttccatgtaggagtgatgggattacagatgcccaccaccacatatggctttttaagttggttccaggattgaacttgggtcaatcctttcatagctattacttttgtgtgttgggccatcttcttctccgcaatatatatatcatggagaaatgaatttaaattccatttttttaaacataaagtaatttctaaatttaaactctgtatggacaaagacattcacttatatcccagtataatcaaatctaaactaagaacaaatcacatttaaacattgttatttctttgcaataattattatgtcctaaaaaaaaagagcccgctatgagttaattttacttaaatagaacattgctcagcatataaatgaaggtcagcagacactagtgtcttggaataaaatatccctttggctagaaaatgtgccacacccaattttgtttttacaaaaataaaattctttccagcttcactaaattggagagatgctgtgtacaacgacagtagtagttggctctgcaactttggaaatatccaagtatccctgtgtacagaagcccttagaaaagctgagttacacaagcagtacttgggccttctgtcgctcctgttcgcttaggttttatctaaactgtgtataaagtacaactaactcatacagctgatggctttcatttcataacttatacttcatgattttcacaaaccttaaagtgggtaggagcatctgggatttcaggtatgacagtcactccctctggaagccaggaatcaaagtaatgcatatggctttcttaaaaggcagtgagaacttcctgccagtggatggactaccacaggcagggattgagaaaaatctctgttctggttccttccttcatgcctgacacacagcaggacccatttacagcatttcctctatattcacaaggaatgcacttcaggaactctctcgggatgcagaagccccttataggaattattattatgcacattcttcatgcattttgcgagtggaggtgaaaactgaatcaaaagcctctcacattttaaacttaccactgagctacactctcccacatagatgattaaatcatccttcggttgcatgctcacctgtattgcttagagaattaggacaagaaaatattctatgcatgtccaatacagacatgggtctttcttaatatttttcacctggtgctgcttgaacccacgtggagcatatagctatagaggacccattgagttggggaaaaagaaatgatcttgaattttcttgctgataagcatgaagctgaggtctggagatatggctcagtggtttgtactgggcataagtaaggtcatagatttgatccccaacagaagggggggcagggaaggaggaagaagaaaggatagggtgaaaagaaagaaggaaggaaagaaataatgtaaaggtggtgtgggagaccaccaagttgaaggaacccgaattagcagaccattgatttatgacacctggacttcattcgaagacactaatcacatggtgttcttgcatgcacttactttttaactattttctttactagaactcttattagcataagtttgttgtacaacatgaaagaattcatctggaaatttacatgcaaatacacaatgtactttggccattactccattcccctctctctgccttggcctctaggcctcccacgggtctgtttgctttttccaaaaaggcttttgagattcacatcctatgtgtgtggcatgtgccagcgttctgtgtggtaaagattctgcatgtgaaagaacatgcagaatatctgttcttttgaatgtggcttatttcatttgatatgatccctagttccataatatttttttcctgcaaatgacacaattttattcatctttgtggctggaaaagaacatcactgtggacatagttcacagaactagaaaaaaaaagtcctaaaattcatatgaacatgcaaggcaccatgtgttccaaagcagtgctaagcagagagaatcctgcaagaaaagatcaaaattacttgacttcaaattgtactacagagctttactagaaaaaaaaaaacccacaaaaaacaaaaaatgaaacaaacaaaaaaaaatcaaacatggttcagagaaaaatagacatgtagaccaaagatatagaacaaacacagacagctatgatcacataatattggacagaggtgataaaaagtatacactagaaaaaattctattcagcaaattttgagtgatattagatccacaccttcgccccacccaaaaataaattcaaaattggttttaaaaaaaagccaaaatccccccaaaaaaccctccttttaaattttcctgcctcaggctctgaggtgctggaattacaggaattttatcagcacgcctggctgtgactatctcaaatgactgattctgagtgaatgttatgtatgtgctttgttttgttccttgttttgggagataaagtctctcgatatgtaaccccatgctggcccggaatttgctatcctgtccagcctaacttctactttacaatttacctgccttagcctcctgcgtgctgagagtgcaagcatgttccatcacttgcagctatgaatagcatctcctttctctttttaaagatttattcatttaatgtgtgagtgttttatcagcatgtacctatgtacacagtgtgtgtgtgcctggtgcctatggaagtcagaagtgggtgtccgatttcttggaactggtgttgcagagggttagttagatgccgcccaaaatgggcactggtaatcaaaaccaagtcctctgcaagaaagagtgctcttaacttctgagccatctgttcataccccagtatggatggcattttcatgctaagaactgctgaactttagaatcaaagaagctgtgatatattaatattttcacattgtagtagctttgttgaaaaactctatgtagatactcatactatcttctacaagtatatacttgaaaacattttaatccatctcctatagttatatgattatcatccatgttcttttaagagttatttattttattgtatgcatatgagtgctttgctctcatgtatgtctgtgtaacatatgcatgccaggtccccacagaggtcagatgacggtgtaggatcccatggaaccagaattaggtacagttgtgaggtggccatatttgtgttgggaattaaaacctacaccctctgtttaaaaaaaaaagtgctcttaactgctgagccatttctccattcacctacagtccattttcataaatttttattagctcacacagaaatactggactacctacccataatcttcccaccaaaatgactactaatctactttgcatctccataaatttccctgctctggaattttatgtgaattaaatgctatgacattcagtcttttttgcatttgacttctacctggcatagtgctttaaaaggtcattcacattctggcatcagtacttcactgtttttgtttttgtttttttaatgccatatcaacgtttaggttgtatagatcattggtggtcatgtgaattgtctctacattatggctattataaacagtggagcccatcagaattaaaagtttaaccacaggcaagataatgagttaaaggttgtcctgacaagattgtctcatttatttcacctcaaatgttaatgagaaccctaacttggactgatttttggctgttgttttcttggtgtgactacccactgatttatccttgagttactcccaggaaaattttccttttccttaagtaatgcaaagtacatacatgattttagttttgtgtgggtggggttagccaggccttgaacatttattgtcctgtctcagcccctggagtagtggggattccaaacctgtgctttcagtcctttaaaacaaactgtgttacagactttcagcatgtccagttaaatgtgtgttattgttgtttggtttgtgagatggcccctatatgcagataaggctgccctcaaactcaagatctttctgcttcaccttcccagtaactgggaatagaggcacaccaccacacccagccacatatttgtttcgttacattcttgaccgctgaagagcgaagataagcaatgctagggaatgcagaagtaaatagtaaatactggacaacaatggctatggttaacctaaacaattactgaatgcatttatttttcaaatgtgttcacatagaacaaatttcaaatggtacaaagggccataatatataaaaaggaccttcttaacgagtgacattttcaaaaggcatttgtgctttgtggttaggaagcacaatggtaaaaggactccgctgactttttaggagtgaatatgagaatgctatcagcactttcaggttagaatgtctcaggttcacccacatagcataagatgaaaataggtgataacaaagtgagatgggccatacctatagtgctagcacttaggagctgaggcagaaggattgtgaaaagtttgaggacaaactgggctattaggaggtcttatctcaagaacccttaaaggaattaagaaaagaactgctggtccctaaaatactattttgctcttgtattctggattcaactgtaagagaatttcctgggaaagagtccttaaaaatcgtgataaagatgctgaaatgtagctccccacagttgatggcttctggtgggagctagggtggggaaaaaaacacagttatcttttaggggctagtcactgggagtttgaccatgctccagtttgtgaatcggcaacaccagttagacttggtgtgtttgggggtggactggggaagagcacaagggtgagatggtacctgggaggaataagaccagtgcacattgtataaaattcccaaatatttaactaaaaatatggtggagaaagaaaaataaacgtactggctctcagtttcttatgcttctagacactgaaaactatgcaggccttgaggaaaggaggggtttcactgtgcaaggaaggctggaagtcagtaccatttcctggagacccattttgaatgccctatataattacttaattcttgtaacatgtctttgttaattgtctacaaagtgcctgctacactaagattaatcaaacaataagccaccatttgagcttggagtccagtccagacatttctattacaagtgaggcggtggaggtctgtttgtgactaacctaggcagacagttgttaaggtggaggagcacagtttatcatgggggatctgggggatctggattttagcagtagcccactccaccgctgttctctgcccatttcaataccacatccttggtccacactgtctgataggactgcctcttccatcctgagtcagtttatactaactgcctttttttttcccagatactaacaaaatggcaggtgctttgccacatttttaaactgccatgaactcgctggaattcctccacttatcatgaaatctgaactgggtcagacagttcatccatagtcaatagaaatgaatgaatactagttagacacggagcagggaactctttctgtgttctatctttagttgatagttctcagcatactagcaagcatgtattcataatcctgcatggttaatgctttccaaggggttggaaaactctaattcaatatatttcaaggatatcagagggtttttttttaatcactaatagtttctactaaattagaatttaatgctaggtggtggtggcataagcctttaattccagcacccaggagacagaagcaggcagatctcttgatttcaaggccagcctggtctagagagctagtacacagagaaaccctgtctcaaaaaatttattatgctattgttcttttgctataggctctcaggtatcccaggttgacctatgtggccatgtgtgcttatgtgcctgtatgctctatatgctgagattacaggcatgtcacaacatgcccagggtttaaggtattggagattgagtccatttgttttaacttcctaggtgctgggattacaggaatacgccatcacacacagcccctattacacaggaccaaaaagtttcattcaatgaatcattcacttattcaaataattattgtatatcttacataagtcgggtaatattttgtcattagggcttatagttatgaataaaattcccaaagacaccgcctttatgaaaattaacactctactagaggtcgcatagaaaacaacattggtaaagtattgctcttatgacaaatgtatgagaaaaagtatttaaatttatttagagaaacaaactaaatttattttggtctgtggtttcagtccaaggtaagctggttctattgctttgggcttgagataaggcagaatttcatgtcagtagacccttgagaatggggttgctcgctacatgacagtcaggaagtggagaatgagagaccggaaattgtgtagtaccctcaaggacatggccccgttgacctgttccctcacagtaatgccatcagattattaattcatcagtgattatatccagtgattaaatctagggccttctggggccaatcagttctcagtgattagctccactatcaggagacaaagacttcaacatttaagccttttgtggaatgtgttgtggtatgtatggtgtgtatgtgtgtacatgtggaccagcatgcatgtatgtatggtgtcttccttggtttctctcacttttttttttttatttttgagacagggtctctcactaaacctgaagctcattgattctcctgactggccagtccacaaggtttagaaatcttcctatcccctttccccacaacactagagtttacggctagtgtaaagcatccccatgcctctacatgtgtgctgaggacccaaggtcaggttctcatacttgcatgacagttactttggcaactgcatcatctcaccagccccttgtgggacttttcatttccaaaccctcacaggtaatatgttagatgctgatgtgttaagggaaagttaaaccagaatttgtgttacagtgaggaagaagtagaggatcatcatttctaattgtaaaatcacagaacttttctctgagaaatttcagggcaaggatgaaggtagtcaatgaatgagctatgtgaacattcaggaaggaatgtttatagtgatttatactgaacattatttcatttgaacaaattaaatttgtttctaattgtcttactaaccacaacataatggtgggttttaggcttggaataattcttttgttttgttttgtttgtttggttttgttttgttttgtttttgtttgtttgggtgggtttttttttttttttttgttattcgagactggctttctctgtgtattcctggctgtcctggaacttactttgtagaccaggctggcctcgaactcagaaatccgcctgcctctgcctcccgagtgctgggattaaaggtgtgtgccaccacacccagcttagaataattcttaatgtcagctcctttgtattttggtatcaaaaatatttatactctaatggaatcagtaattgattatagttttggagatggggttggttttggtttttattgaaaatttgtgttaagaatatgttagcaatatttatgctaatatcttaagaaggctatgggaacaatgtttaaaaatgagaagttaactggattaatgcatatattttattcatttattattgttctggtgttttgaaattgagtctctcactatgtagccttgtcttatctagaactcactaaatagaccaagctgatctcaaagtcatagaaatctgcctaactctgcctcctgagtgctgggattaaaggtgtgtaccaccacacgtgacttctttatttatttctgaattttatttttatttatcactttgttttgaggtaaatgtagactcacacataaatgtaagaaatgacacagagagatccaaggttgggttctccttaccagattcctccgatggtagctacttgctaaaacagtataatatccatcccggggtactaacattgatacactcaagatgtagaacattccgtcacttccagcatgtcctttgttgtccatttataacaagacatacttccttcctccctccaccctcatgcctgaaacctggaagtcaccaatatgtcgtctatttttacacttcctgtcatttccagaatctgtataatgggacatttgggatctctctctctctctttctgtgtgtgtgtgtgtgtgtgtgtgtatgtatgtatgtatgtgtgtgtgtccatccccgtttgtgtcgtcctccatcttccttctaccccctccttctctctcttcattttgttttgatgaagtctctccctataactcaagctgaccttgcttgaacttgtgatcatccagcctcagctcttggtcaggcttgggctacgaagcctggctggtaagtgactttattcatttagtgtatttttctgatgagtcttccagaatattgtgtatatccattctttgttccgtttcattactaaattgcattctgtttagcaattgttccattagtgcacatctggaccatttccaactatatcacaatattgctttaaaaataaagcttcaacattcacacaccctaagtttctggtacacgacttgttttacacaatcacccatgcatggaagatgcatctattacctttgtttatagcacccaagtggagttcagagaacaatttacaggagttggtacgctccttccactatatggctcccagggattaaactgaaatcatcattgctggggcttgaacttttgactgcaagaatactaagcatgtgccctactactgagctatactcccctatcatttccagtttttttgttttttgctgttgttgttgtcacaaataaaagcactataaacatttgtgtgcaaccatttatccaagtgtaaggtttatttttgggaaaatcattacgatttgaatatgaaatgtcttgttcaggatcatatgttgaatgctaggcggtcctactttggaaactttaagaagtggagcccagctggaagacatagctcaccgtggatatgttgttggaaactgtatcttctgctctgtgcatctctgtctctgccacatgtcacatgtcacatgctctgtcaatgctttgcctcaccaaaggctaaaaatcaatgggagatctctgaaatcctgaactaaaatgaatcttaattcacttaagttgtgtatatcggatactttgtcaagttagcaaaaagccttcgtgtaagttaatatgtaaagagtgcagttactgagttgtatggacgttgcatgtcagctttataaggaaatcccaaagcacatgggtagagtgactagactgtttgctactttttaaaaagatttgtttgtttgtttgtttgtttgtttatttattgtatatgactacactatcactgtcttcagacacaccagaagacagtgagtctggttctaggtctagaagaaactattggtgggccttgaaacatcagtattgtcttgtttggcattttcttcagtgaaagtcattgctggtttatcagactctgcagaattaatttctcatgtggggaaggcattatttcaaggggtggagctgagggtggggcaaactcttgagaatctgaagattcaaaactctcagcttcaacagggtcttcccacacatctccatcccaagttataggatcccattctttgccaattagtgcccttactttaactgttgacacactctgagactgagacttaaattttcgctgtagttcaaccaacctcacaatgagggtttcagtttgattttctgcaacatgagctctatggatgctggagagaagattctcttcaaggacacacttagcaacttttagatcatttacttgtgtctggagccgttcgattttatcacacaactccttcatttcattcatcgttttttcccaagatgaaccagccagtaaaatcattttctgattttttccccatcttgtagaaagctttgtacaccgactcacctaattcatcaagaaaatcaagggcattagcttctttaaggttgaaatatagtttcagccacgggtcttcaaaattctctgagctcccaggagggagagaatctggtgaggtttcagtagttgaaagtgctggtggatcaacaagccaattccagtattttaaaagattcatccttatacttctgctcctctagaaccactcctggtaccaacttctgtattagtcagggttctctagagtcatattactgatggttgtgagccaccatgtggttgttgggaactaaaatcaggacctgacatctctcctgcccctcttttctactttcacaagcagtgtgcactacatgagtacctcatgctttcagtggtcagagaaggtattggatatcttggaactggaattacaggtggttataagctgccatgtgggtgccagaaatcaaatctaggtcctccagaggagcagccagtgttctgaactgctaagcaatgtatccgtccctagagttttgtttttccccttgagaaaggtcttattctataggttgttatgaatggcccaagctggctttgaactcattgccatacctatttcttaggttcctggctgctgagattacagctgtgattcaccatactaagcctttatgaatttatttttgtgtaaggtttaagtagtcctggttttatttgtttgggacagaatttatggagttcattctggcttctaattcactatagctgagactggccttgagtttgtgatccttttgcctccacttcctgattatagatatgtgccactgcacatggcttttgtttaaaattttcttttaaaatagattctcacccaaggagctaaagggatctgcaaccctataggtggaacaacattatgaactaaccagtaccccggagctcttgactctagctgcatatgtatcaaaagatggcctagtcggcctcactggaaagagaggcccattggacacacaaactttatatgccccagtacaggggaacgccagggccaaaaacggggagtgggtgggtaggggaatgggggacttttggtatagcattggaaatgtaaatgagctaaatacctaataaaaaatggaaaaaaaatagattctcctttcatacaacatatccagaccccagtttaccaccctccactcctgctatcctcccccacctcttctctcccccagatctattctctgtcctttttctccagagaagaacatgcctcaagagacaacaacccagtatgaaaaaactaagataaaataagaaaaggcaaaagccctcatatcaaagccagacaaggctagctggttagaagataaagagtcccaagaacaggcaaaagagtcagatacatacctactcccactgtgagaaatcccacaaaaacacccagctgacagccataacttatgtgcagaggacgtggtgtagacccatgaaggccctgtgcttgctgtctccgtaagccgaagggagccctgcttaggtgattcagtgggatcttttctcttggtgtcctccattccctctaatcctacagtcttttctccccctccttattatttgcctgtgcttgtctagatggtacaccattattcttccactggtaagtttatgttcttctaaaagaaaatcctttgttcatgggatgggaatatagttaaatggtaaaccatatgcctagtatgcaaaagaggctgggttccatccacaatgtacacacacacacacacacacacacacatatacacagtccattacatgcacttatataagtctgtttctgagttccctattctattccaagtacagatgctttgccatcaacacactctctcttgatgaatgcaacttcatgggataactttaccactgggaaaagtcaatacacccaccctgtcaatatgttttagctattcatgttcctttctacatattttttttggaaaaaaaagtttgcttatggcaaggaattgcactagagtttttagtttttagattagattttggagattttatatgtaaatgaaaatatattttcaaatgaaaattctaataagtaaaactgttaactctattaaaaaatttaactttgtgtttggtctgatgctaaatcttattttctaaccctgtacctttttaaaagagattaaaatgccatatagcccaggctagccttaaattctctatgtagctgagaatgatttgaactcttgatctccctgcctctaccactagagtgctgaaattccaggtgtagtcttctgcctctgctgtatgaagtactgaggactgaccctagggactcattcagacaaaacaagcattctgtcagctgaactacataccagcaatatctatttttatagtctaaaataattaagccaggcatgatggcacatgtccttaaccctgggactcaggcaggtgagtttaggtgagttttaggtcagccctagttcatagatgcttcaaagctacatactgagactctgtctcaaaataaattcaatttacttctttattaatacacagatagataaaattgcatttttctagtgtgccatgtgatttgacatatgtttgtgttataaaaagtgttgagataatggtatctgttccctcagccatttatcctgttttcccacaatgtgtaacctggttgtgtgcaccctggttgtgagtacatgggaggcatgcattctggttgtgagtacacgggtggtgtgcaccctggtgggcttcaaactcatgagattctcttccctctgctttacaagtgctgaaattacatgcacatgacatccaactattgtttatttgtcatttctccatggcaaactcattgatatctttttataagttttaaatcttcgaatgaaaatgcatcttaaaaataaattgaatggcttttgagttgctaaaattgaagttttccaaaggaatgaagctttgttgttgttgttgatgatggtttataatcctcagtatgggacccaggtgcttatcttcctagaccaatgctctccagctgagctacaaccccttccccaaaattacatatactctggtgtggggcaggggcaggaaatggttgagacaaggtctcacattgaagcacagactggcctcaaactcagcctctcaaatgctgggattataggtgtttagctatgacacacagctaatatatgcttggatttagaatttgtagcaatttctaatttgttgatctttgtttaaatttaaaggataaatttaagtttcacttatggaatttttaaattttatttttttatgttgttttggatgtcttttagataggatcatactctgtggcctaggaaggcctggagcttgctatgtaacccaggctggtctctaacactgatgatagtcctcataactgagcctcttaatactcagattctaaacacaagccacaatgactacctttttctgtgatttataaagaccacccactgtaacttcttatataagtttctcaaacttcttgttatgccttaaggaaattatggcttagtccattgttggctccatcaaattcatgtctcagaatagcaaagtggggtattctattaaatccctggtatttggggcattggggtcaaggtgaatttggtattcgtgttcagtaagtcaaaagtgtttcaatgaaaatacttgggcattcttgtgctttcattatagattccacaaaaataacaccttgacagttacaaaaagacatctggtaaactgggtgatttaagagaacacagggaaatttactgtctggttgaaacaaacaaacaaacaaacaaacaaataaacaaaaaacaatggggactgccagactgattgtggctgcagagctgaaaagaaaatgacaccttgttgcttttgggtgagggaagctgagacaacattgtgcttttctttctgccctgctttcaggagaaaaggcttttctgctctcttcatattgaatgatccaaggtgggcggcaaagaacaaagccgtatggctcattttttccattctgtttttttctcaattgccttttatttcatttagtaaaatttatcactctgcctgtaacattggaaggtgagattatggggttagagttagagagcagaatcaggaaaaaaatcacagttcaaacacacctgctctaaatgtggagtagaattactgctctatactgaaagcttctttaacttacatagcacatggatcctagggatacttgtcacactgctgcctcctgtcactagtatcagtgttgtgtgtgactacttaggtaatggctacatcctcagcgaaacctgttcgtaacagaaggaagtataatctaggaaagaaagggaagcagagcagagcagagtatagtgtacctctagtgtggggagagttgagtgagacagaaggatcacaagataaagccagcctgggtgtctatggaaagttcaaagctgccctggcttgcctcatactcgacactctgtctcaaaaaaaaaaaaaatcaaaataagaaaacaaaggagaaaaatgattgcatgcagtgtagttcagtggttgagtacttgtctggtgtgtaacagctacaaagcatttttggttttgctttttaaagaagtaatgatatgtatgaaaacagatattcaagtttcttttttcacatataattgatttggagtgtgtgtgtgtgtgtgtgtgtgtgtgtgtgttactacagagcacagggtagtcaagcacacttaccactgagtggtaccactagacttttaattttgtcttttataaattcaccttggaaattcatgaattctaaaaaccagtcaccataaagtagtcaactccagtggaagaactcagaagggcttagccagtttctgctgtaatgagctgggagcagatacacgatgattaatcctaaaaatacagtgtttagcaattgaagatgatagatccctttaacttatggcaaaatcactgtcatgagatgtgtttagctttacaaagttaacaaattactaagtggaatatcagctgagcaaatctagttggtgagattccgcctctttagcaagctgaactaggttgttattgtgttgatgaatactgctccatcctcaaagctgcacaatgaagcgtcacagcacaaataaaagaaagaaaatttgtaagtcatctttcatatgtatatgcgaatgttaagaacatataaccacttttagagactgtggaatttcttttgggtcaatcttacagataaatctacattgtgttcacagttctgtgcagaggcagatttaacaatgaccattatgtgtagaaaatagcagccattgttgctgtactaaagtctctggagattaaaaagaaaataaatgaagcaaattaaaaccttaatggtaacacaccaaataaattaactagtaaagaatgattagaaacaatatagaaggactgttgaattagacctggcaaaagataattgaagtgcatagaaagatggggattgcttacttatttaaaagaataattcccaaacagtgagctcacacacacacacaaatttggatctttcagctaattatttttggagaaagcatcaaaaatatatattcagaagagatacaatgcagtctgtgcactgtcaagtcataatgccctggaattaatttagtttatgctttgacggtgtgtatgtttggaagaattatgagcgagcattgaactgacactatgcagttcttaaagtgaatgtgggcaatgttctgaatgttttattagacaacgagaccacaagttttctctgtttacttgtctctgcaatggtagcagaagacagactatatgtgaaacttcatggatgcatttaacaatctgaaaccatggcaacgtgtgataacaagcggcaaccagcatcctagcagcattcgcttcatgttaccacttcatctgaattagtcgtttagagggtatttcatatgctttgctaaaaactgacgagcttaatcttggactagggcattcaggcaggaaatgctaaaacagctctttcttttgaagatttctttcattactccctgtgaggtcaaaaagcagttgtgagtttggaaacccagagcagtgatgtcttgagagctaaatgagctttttctttcttgtagggtgagtttggtttgttcagtcctacttgtgtgccaggcactgtcttagatgccaaaaacagattactaaaagaagtagacaaaaaaaaaatcattgccctcatattctttgatcatggttgaggctctagaactatttccagttatttaatattgtttctcagctttttaaaacctccaccaaaagagtcttgaactcttgaatattttatcttatttgaatagggaaaattgatgatttgtttagaatacttggcaagaatccaaaagctggtaactaaagtaaatattttctttttggttgtcgctactgtgtttcctgtgccagagttacacctgtattgatgactgacttaggaatactttgggcttcacttgtggatttagtctttagatggggcttaactcaattttaaggggggggcaggaggctcagtgtaatgtgcaaattcatttagaaatgtgtctctgtcatgtgaagatgtatggaatccttaaatggactgaacagtcaccatggaaaatgaatatctgtctgagttatttttgcctatgtgaggagtacaagagctgactcaaagaggatgccatgctggttcctgtcctgaagtcaaacaagacagactgtgctggaaaagccatgtgctcatgcctgtgtttgctcacaccgtagatgtcttcaaccacccccataagagggcatcagatctcattacagatggttgtgagccacctattaaagatttttctttgatcttcctagcctttgaatgatgtagattgttctaccttctcccattaaataaattagtatcaatctaaaatgcaaggttttgctgttaaggtatttgactgtgtctgtttgtttgtggtatttgctcccttcatttggattggacctagagcctcatacaaggtagacaagtgctctactgagctatatccacaacctttttatttttaaatacttttattctttaagttaaagtgtagttatcaattcccgcattgcttttcctcacttcaagcctttgaatgtacccgtcttactctcaaattcatgcccattgttttttttcaattgttgttgttgtgtatatatttcttaatatataaacatacctgattgctccgtataatgttgcttatatgtgtatgatttcagggctgaccactgggtataaggtaaccaattggtgctctcttccctgagattctctctagtctatatgcccctactctcagcattccttagttgctttttaaaaagatttgtgtgtctacataactaagtaggaatctgaaggcgtgcatgcagtaagctggtttttatgttagtttggataaagtccgtgtatttcccatctattgggtgagcctagatatgaactgagcacagaggtatgatatgtacaacccaatgctttaaatttttaaatataattggccagatcactgtttcctgtgcactagatagaaaaatggatcaagtaaacactgaacgggaagagggaaagatatgtatgtaatcatcagaatgcttgaagtctttgcatagtttatgccaacatctgtttcactctaatggagatatgagtgaaacgagaaactatttttcaaatgactattgctggagtcgcacagatcaaattatcttcaattaagaaaaaaatgtgtgtgtgcatgtgtgagtttgtgtatgtgcacaggtaagtatatatatatatatccaagaaggtattggatttcccagagttagagttagagccctacattggtgttgagaaccaaagcagtccccaggaagagcaggaaatgctctttaattactgaaccatctcaccagcctcctcaaactctttcttttgagacacgatgatattatctaggctggcacaaccttgtgatcctcatgcctcattacccttcaatgcccacatgcctaacttcatcctcagtaactagaggtataggtatgtgccaccacatacagattgtttatctttgtctttttgttttgttttgttttgtctttgttagtttttcttgtgtataaacattttgtaatactacggattgaacctaggacctatttatgtcttagacaacttctttattactaagaagagaggtgtttattttgagacaaggtcttcaataagttacccaagctgcccttgcaattagtccatatcctatgcaggccttgaatttgccatctttctgcctcagcctcctcaagacctgattagaggccaggaccaccaagttggctttatttatcttataacatcatatcatatgccttacagctaaccagatatgaaagcaatgtaaagtgtttacattccaaattccaatgctgtggtcaagtctgtagaagataaagtgcatcaggatatggactgactgactacttactggggcatcttatgcttatgaaggtggactgttactgtttggcatctcaggatgctgaacttaatgtgtgcttgtgccttgggttttttttctccaaatgtgaaaacataattacagaatcttgtacagctctgtgtaaatcacttgtgtggtaggcacacggccccagattccatctgctgtgggagggaggaaaaacaaaagtattcctgaaaacagatccatttgattggttttttgtttgtttgtttaaatattttttattacatattttcttcaattacatttccaatgctatcccaaaagtcccccataccctcccccccacttccctacccactcattcccattttttttggccctggcgttcccctgtgctggggcatatacagtttgcgtgtccaatgggcctctctttccactgatggccgactaggccatcttttgatacatatgcagctagagtcaagagctctggggtactggttagttcatattgttgttccacctatagggttgcagatctctttagcaacttgggtactttctctagctcctccattgggggccctgtgatccatttgattgttaaaaccaactcgtgtgcaacaggaagtttggatagctaatgctgctacttctaggatgcatcattgaaatgttccaatctggttcaaaaattacaatagcattactatactatggtgttttatactggcacctgttttatatgttagatctctgttcatgaatatttcactcactgtgtgtgctattttttaaattagaaaacaggtaatatcttatttcttgaaaggaaattagatcattctattgaggtgcgtcattaagtaggagcggcctctaaggtacctgtgagacatgggaagaatagacagcagtgggtgtggtagggagtatgatgtttgaccgaaagttggaagcggtctgaaaaatatgctctagatttggattctagctacacatctcctgtgacgttaatgggtgtgcctctgattttttttttctttccaccctcaggggtgtgtgtgaaccttattgttttgattgtaagatctaaaaggcaatttgcacgagttttccattggctttgcattcaccctgatgtattgagactggaatatgaaactcgttttcattctgttgcctgctagtaaaaaaaaaaaaaaaaaaaaaaaagtaaagctcattattcacccttagccacaattttctattcccaaggcagttatcattggccatagtaaaaacaggttctagccacacagtcacagacatgagcacatgcacagacactgtcaccattcagcccttcctataccaccctatgcaggtgctgagtgaaaaagaagtttacaaagtggatcatgaaccaaaaaaataaaaatgaaaactaaaagccttgagtggactattgaagaagtttcttgtaggaaacatctggtgttgagggtttttttttgttgttgtttgtttgcttgtttgtttggattttccattttgggtttttgtttttctggtgctggagaataaaaccataggatcccttgaatgcttggtaggagacaggttagtaacatttgagtttgaaaacctgaaatgtatatgtatgtatatattcacatatgaccaaagaagtcagggatacattttgtttgattattatgacaggatttcactgcgtagctatcctgtaacttgctatgtagaacaggctggtcttgatctcagacatccaccagcctctgcttcttgagtgctgggattaaaagcctgcaccacaaccgcctggcaaggaccgactttctaagtagcctgttagaaccatctgtatacgagagagaaacagtgtcttctcaagctgcacagttattagtttaaaacaatcatttacccagtgatgatgttgcacatctgaaaagatggttatatagcacttgggacaaacctatctaaggggtttgaggcaataggtgtggctgaaatacagctcctgttgggaaactccagcatttctggcccagcactgctatctccttacctgaggcggttgcctctgttccagtattctttacctacacaacccaggataacacctgcataggtttctgccttccagttagtactatgggcttcataggacctccaaaaggattatctaccctgacagtccccaggacgatggtgctaggcttgttttgcaaatggagaatttgaaaaagttgagattcatatactaagtcagcaattaaaaaaaatatatgtcccctggcttctcctggtatatcctgtcttttctactttgtgttgctttggggggggggatttcatatggactttgatgattgctctaacacactgaagcatgtccattaaggcaatgaaatgtaatccagtattggtaggcaaggggaagcaaggaggaccgaacactgactcttaatgaagactacctccccagtgatggctcttcttcatgtgtgaatgctctgtgagtcacatctgtgtgctgagaacgtagtgggttatataagactcattgccttgttttgtcttcttcgcaaagatccggagcatgttatctcattttatttcctcatatggtagacagaggagatgttagtaagcaggtgttatctgggcaggttacaacactaccctccagttactaaacgccaaactggatgctgaccctctcccatacttcctccttccccagcagtctttaaaagatatgtggaattagttccacttttacagatagggatgtgggccccagagagacttaagtgtcataaagataagggtcacaaagacttcaagactgtgacttcttagatccccatgctgccatttcattcctcccaggttattaatttgcactgaatctctagaaatagtctgagcctagccagcacagctcatttttttattttgtttgtttggttgttctgattttggttttgggggggttgtttttgtttgtttgtttgatatgggttagttttggttttggggttttggttttggttttcttttatctagccattcagtgattcagttactagaataggtaagaagggttttattaagagcatctgtccataactaatgattgccatgatttacatttatggcatatacaaaatcattaaaaatgctctacactatataaagaaagtagttactataatatggattagttcatatttttattctttatactacttttgattattttatatactattattattattattattaattattatattgggtgttgagacagggtttcagtccatagccctggctgttgtggaaatcattttgtagaccgggctgacctcgaaatcacagagctcctcatgcacttgtaaccccagggctgggatgaaaggccattatgcccagtgagtatttgatatcattactattatttacagtgtgaaagatggaaccttagggccttttgcatactgggccagcactgtgtctgagccccagcccctacttcagccccaaaatgtttatagttgttgtcatcctggctgggaaggccaggctgaagagatgacaataacacataaacctattaaactgtggggcggtaagggaaggacacctagtctgatgctggagcactttctaaggtggcactgccttttccacagaacagtctgacgcactgtgctgctgtcagagctttcttccaacagaaaccaaagtgaaataagcgtgctgctccagttagaatctggagtataaatgttgtatgtggactggaatgaataatagaaaacataagcgtcctgggatagttaatttgcctttccaagtaatgtacttgactgtgcatgagtggcttggacactggggagaagctgttctttgtgttctaaaataagcaggttacttggctactgctcaaactctaaataggtatatgggttgtagctatttgacctgaagcaacttgaagttcccttggttccctgtctggttttaaaagtggagccaaaacgaaagcatgaaggcataaaagttttctctcaaggttgtgcttcagttcgaatttgaatctggcaaaggagtgtaaggcaggcaggaaggagactcgtaagtattgtatcattcctttgtcagggtgttcatttgctagcaggaagtgttgtgacttgctctttaaagttgcaattgtaagaagaatgttgggtttccagatttcaagttctgggcgtgggagacagtcctcctagtgcttcaagaaaagaagcaggttcgctccggtcggaagggtaactattttaatatctttttttttttttgtcggtgctaactttgtaggttactgaatatttaagccgagcttgactgtttaaaaacatgaagttcttattttctgtttaggtaaatctttggaatcacttttaaaatcttgattgtttaagaataagtcagatttgttgtaagacatttttgaaattaagtatttaaccttttctgtgttctctatcctggtgatttttctcttcttcgatattgggaatgttctagcggctttattttctttttaaaaatgggtttgaagtcctacttacataatcttaacttgttaagttagatacctcaaagcttaattgatagaaattattatctggcattttgagtagaagggagaagagacaggattttaaatgcctttggttcttgttaaataattttttaaaaattctgtaataaagcttgtcatgctagaacgtgtcatgattagataagcatctctgctcttacaaagtggcttatgtcaaacagttgtcccagagtttacagttcacaacacacatgatttagatggtgttcctgtgccaaagcagtgctcatcttaaccagcagggttttctcttttttcttttttctttttctttttttttttttttttttttttggctcaagtcacgtaatttatttctttttcccagcaaggtaactttcttttctttttctttttctttttctttttttttctttttttttcatttatttatttttttattagatattttctttatatacatttcaaatgctaacctgaaagttccctataccctccctcgaccctgctccccacccacccactcccacttcttggccctggcattcccctgtgctgggacatataaactttgcaagacctagggacctctcttcccagtgatggccgactaggccatcttctgctacataccagcagggttttcaaacatacgcagcagaggagcttaaaagtcttaacttcttaaagctcctgacaaaaggaagtatagctagttatagaatgatcataactctgaggtaagtgagcatcacctatgtagtatgaaacattaagtctagggagaatatttaaactggtaaggtatatgaagcagacactttagtgacaaatagattctctgctaagcttaaagagggacttatgataatacttagcagtagttttgttttgagttgaaatatgttagctgctctgattcttgcttgcacatatgtacttcacacacgtccctgaagaacactcgtgacttcttaaatatggtagtttttacagctcaggaagctggaacatccctcggggatgaagggcaattcatgtcatgagcagcagcagcagcgttatttttgcacagaatatgggtaggagatgtatgctctaagtgctgggaaaacacaaaagggctgaaagctttcaaaagaggtgtgccttatgtcagtctaagacacaggtgcccattagcttggtaaacaaataagggtaaaaaaggagtaatatgagttgagtcttttgctaattatttttaatttttgagattataatataacaccatttctcctgtccctttcctccctcttggatgagtctttcttttgagtttgacataatctaaatcattaatgtgacttgcataaaaaaatctataaaacttttgggcatcaagcatttaaagaatgtcttcaatgtaagttaagtcgagcactgctattattggaagagttggtgaattatttttaaatagccagtgcttttagatcttatctgtgtttattaagagccattggggaaaggaaacttttacttaaaatggaagtatttgatattccttcaggaaatgacacagagttgggcaccctttgggatttgagtgactcatacatactgctactgaaaaagatcaattggaatctagcttatactattctagaatagactgcaaatattttcataagatggatttgtttcttccttgatatgtagtagtgaaaccaggagatgtctggtgttagattggaaacagttccagttagaaaggtagggcaaagaggagcaggacaggatgaagaaagagtggggcatctgtgggtaaaccctgagaaatggagtatctgctgggtttgtggatggtgattatattgttttctcatactttatatcttgaaaatgctaatagcacaagactcgacatataattagctaattgtataactaggtacatctatttgtaaacattcagttttgcctgtgaacagcaagcctgtcaaaacatgatccatgcgtatgtcgtattgtaaaggtgaaatgtgctgtgtgtgtgccaaaaggcagcaagaactgtttctaaacctctttctgtttgactttcagttacagtcacatcataggctgcaaacctcttgaagagttctgtagtagttcaaagtgtgaaaccagagtgaataagtaaaacgtgatcccaggccacttgcatgtgaagaatgtgactttgttgtgttctcaattttttccaaagttttctttaataatgcttgcaactttgtttatttagtcattcattcatttattctattggcgctgagaactgtgaggactgaacccttcatactgtttgagctagaggaacattctaccactaacctatactctgaatctccctagtttggcattgcttgtttggggtgctttgtttactttttttcagacagggtttccttatgtagcctatcctgtctttgaacttttgtgtagcccagggactcacaatcctcctgccccacactcacaaattctgtaactataggtatcagcatgcccagctcaagactgcattttggaaacccatttgaggtgactaggtagactaacttccagatagctaggtcagctcgctcccatcgatcctgatgcttatttattcagccagtttttggtgtgtacttgtgagccaagatacaaagtcatatatgtgatatcttctctgttttgaaggaaccaggagtgagtgtaagggacagaaaaggcagaaggtagaccccacactgtgggatttagggaggggttactggctaacaactgtgatcatgtgctgcatctcctttaaagtcgttgaacagaaaacttgaggttggggcatggtagtctatttctgtaatcacagaattgggaagcagaagcaagaaaatcagcagtctgaggccagcctagggtacatgagagtccttatctcaaaacaaaaacaaacaaacaaacacaaaaatttaggatggtataattggttgccagtattaaagaattagaaagtgggcaaagatagcctaggtttaatatctatgactttaaaagactctctgctcttttattcttttcagaaacctttaaaggtcatttgtgtatctgcagggatcgtgaggtgacacatgcaaaggagagtgacatctctacatttctgagaagatgggtatttaagttaaaagttttgaatacatccaagttaaaattatacttaaaggaagcaagttcatgggacagagcaaagggtaaaggaagtcttcatcaacagttgtccagaatataacagtttattagaaattgaaagcacactttgtcaaggaagtatacgcttgcccttgttaagatttaattacttgaagctgtagagaaagagatgcctccgtggttaagagcacttgctgctcttctgaggatcttgattcagttcccagcatccacatggctaatacaactatccattactcaagttccagtggaactgatgcccgcttttggcctctgtgggcacacagacatacatgcaggttaaaaaaatgctcaaaatagaattaaaagtaaatcattttagaaatatatatttttattatgtgtgtgtgttctacttgctttttctgagtatgcaccatatgcatctagtgccattggaaaccagatgaggatttcagatcccctggaactagagttacagtcagatttgatctaccatggggtgccgggaatcaaactaaaatcctttacaaaagcaaccagctttcttaactgctgagttctatctccagtcccaagtaataagatttttcaagttactttaagagtgtctttgaactcttctgtttcattatctgacatatttttttatattgtcattcacgtgtcatttggtggcacacctcattgaatctagggtctcatgaatgctaggcaagctctatcactggactctaaacccagcctcctctttacgttttgttttgaaacatgatctggctaagttatcctggttagtgttgaatttagaatcccttagcctcagctttccaagtaggtgggattataatgctgctccaccaggccaagtctctgctatttaaccagagtagcaccaagatgtggggctggaaaggtgattccctaggttaagagcacatactgctcttgcagaggacttaagttttattcccagtacccatgctaggcagctcccaagcacttctatctccacctgcaaggtgaacccatgtcctcggccttccatgtgtgtgcattcataaaataaatgaaatattcttggtttgtttcaaaatgaatgaaccaagaatatttgctacatatatccagattcttccaatcagtggttttagttctcagattccaattctttacaccccaaataacctatgtagctatactggaagttcaaatgctgttggtttggtgaggaatatctaagatgctctctgctttagtttcacagtgtgtggctgaagtgtcagacaaaattaccaaaagatgtaggcctactaattactgtgctaagtcaagtctgctgtatagttgaatattcctttcatagttttgttgttgttattgttgacattgagtataaaaaaacaactggacattgactataaaaaaaaaaacaattggcaagaccaggtatggtaataaatacctttaatccccaaacttagaagctgaggcaggtgaatatttgtgagttccagaccagcatggtctagacagtgacaccttatctcactggaaaaaaaaaaaaagcagttgacaagggacatgaaagagatgtagctcagttggtagcatgcacaagtaccctgggtttgatactcagcaccacataaaccaagtatgttgttgcgcacctgtaatcccagcattcaggatctagaaaaaggtgaacaagaagtttaaattaattttatagttggttacgtagtaaaattcaagccagcttggactaaatgagaccctgtctgaaaacaataatcaaacatggtaaaaaaaatatgtgtccaaaaatgtcataatgaaacgtagtataaattaataaaacaaaaagaaaaaagacccagaagaccaaagcgatcttcatgtttttttgtgcatatgtgcgcaggcacactggttacctatggtggttggaggactgcctctgctgtcagttctcactgtccacctcctgggaggcagggttacttcattgtttgccactaaatacaccagactagctggcctcaagagcctctggggattcttctatgtccaccctcatgctttaggaacactggtattttagatgcatgctattgtgctcagctttacttaggttctggttgtttgaacttgtgtccttgggcttacatgcaagctctctacccactgaaccttcttctcatccccaaatatacaagtattacaaatgctgatgtgctatggttagtgaattgtcaagaataaataaaaaagacaccatgtctttctgcattttataactaggagcctaaaaagagtgtgaggacatttgggatttgactgctttcttttgactttcaaagcattgaatgaaaatggtatgcagggccagacttggaggagctctcaagaggcagaggcaggtagatctctgagttcaaggccagcctggtctacagagttagtttcaggacagccagagttaaacagaaaaaccctctctctctctctctctctctctctcacgcacacacacacacacagagagagagagagagagagagagagagagagagggagagagagagagagagaacagaaagaaatggtgtatagatactttttaaagatttatttcatttatatgagtataccagaagagggcatcagatcccattacagatggttgtgaaccaccatgtggttgctgggaactgaactcaggacctctggaagaccagtcggtgcttttaacctctgagccatctccccaacccagaatagattctttaccaagattccacaaaagtttgcttcaagaagaaaagttctgaaagagaaataattctatatgaaaaagtaactgtatgatgactgactgtttggttatgattacattaacacaaggttattgctaagctttgtgacagaattctaaaatctgtgctgagctgaagagagagatcagaaagagttagagaactagtcatatcaggcatctcaagaagagtgttctcagctgggcggtggtggcgcacgcctttaatcccagcacttgggagacagaggcaggtggatttctgagttcaaggccagcctggtctacagagtgagttccaggacagccagggctacacagagaaaccctgtctcaaaaaacaaaaactaacaaacaaacaaaaaaaaaccaaacaacaacaaaaaagaagagtgttctcagtgggagaggaagcgcatagcctcacagagactcgaagtgccaggatagggggtctcctgaaatatcaagcaggtggcacacacttagtgcaggtacatgctgaatatggggatctggcataattaactggttgtgggccatttttaatttgaaagaaaatccaaatgcactgtgaccaaggtttatagtaatgaatacattctatttctaccttactgaatcttggggaaagaacattcattctgtaagttgttgagagtggttaggaatattgactgtttcaaataggtctggggtttgagacgtggttcatctctttctagctatgtgaatttgaagtaacttctctaaagtcagttgctctgttaagtgtgaatatcacacacacacacacacacacacacacaaagaaataaattttaatgtcaaagtaatatttccaagattatatttttctgagaagtaacttccattttgcatatgaagcaagtagcttaccccacagtaaatatgtcctctgcaattatgagtggctaaaatagaaacttagaaggacatgctgttacttcacataagttgttattacctatacttcaggcactacgatacaggttgagtggctgccaatgagatgtgatactgatcaatgagatatggatattttcatctaagagatttgataagactattaaatgctattcttgggatatatattttctataaataagtctatgttaattgggcatggtagttcatcctgataattaaagcaccttggagatagagataggaagatggtaaattcaaagctagcctgggatatatagaaagatcctagggagaaactactgaagcttctagaattgatcaaatgtgagaccataaagggacatgatggaaaaagaatctaagtttgtaagagagaatccaggaaatttaatgactgactcactcataggaaacaaactttgtgggcaaccagtgtctcaaatgtatttgtctggatactacaaaaaatagagaagttggatatgaagcctggtatatcaggaaagagagttggtgagggaaaggaaagaggccagggatgtgactcactgaagagagcatctgcctaacatgctccaggccttgggtttgagtcatagtactgagaagaggacgggaagagatggcagtgaggtcgaattgaataactcttgttgaccttcccctcctgtggtcaggtctcagctagactctgaccttctaaccctagactaaaagcccaagccttcctgtatatctgaagctccacatagcaccttctctgactcctaagtctagaacaggtctccagtctttaagacaaaggacatagccacatccatggaaatgttggctgacaactatcactcagtgcaaataactatgataactctagtatgatgtgctgttttcttctactggacaataaactcttctagagaaaagaggctttggggtcctaattgcttgtatgtgtggcactagacgcactgcctagtatgtattaagccttcagtgaaggcttggtgagtgtagatgagtcatgagtgaatgcgttagacactcaggttgagatctgccaaagtcattaggaaatatggcactggagtttgagtaatcacaggaagagatggtgagctttagcccacagagtggcacacacccatccaacctagagactggcactgttgactttcctaacttgaggaggaggcagggtggcagtttctgttggtataggtaggaatgtgaagtgtgggtgttccaaggcactgcatgctttggatggaagaaggtgacaaataatattcccctcttttgttgcctgctctagaattgtttgctaaaatgatggctacatctttgtggtttcctcctcttttctaacaaaagaatacatctttccatgttttcttcccctctttattgctttctccttaaggagtttttttttttaaacaaaacaaaactatttttttaaagatttatttacttacactgtagctgtctgtcttcagacacaccagaagagggagtcagatctcattatggatggttttgagccaccatgtggttactggaatttgaactcaggaccttcggaagagcagtcagtgctcttaaccactgagccatctgtccaccccctccttagggagttttaagtcatatactgggcaatctttaatcaacattttcccaattccatttgtacaaagtttactagtggctgtcaatgaagtctatggtgaatatcctgtaggttagttactagagtgtttgatcagcttctttgttttctgctgtgctggaaatgaaaggcaggatatttggtagacagtctctctaacactgagctactgattacccacaaaggagttcctgaatgtgccacccttcctcctgaccctgccatggtacagaatgacacatactagtaactccactgttcagtaagctacattccaaagatgatgaaccgggatcaggaccttcctccccgctccccacttcgaacagccttcaatttttgagtaatagtttcaggtagttttaggtaaaccattctcagcaagaatttgtgtccaaggtttctgtatagttacatgagccagtgcagtggtttcataattgctgtattgttagtcaaacgctgtaattagggatgacttcataagcataagattcttctatgggtgacgccctgatccgtaccctgttgtacaccgtatccttttatgaaaaaaaaaaaaaacccaaacaaggttttgtttccttttgttttatacccagaattgaaaatctgttttcctatatctcagatggttaggaaagagagctcccccgactcccgctgatttctctgtacagaacagtcaggcagacggaagagaacaaaggctttgcagcctgctttgccaaaatgaaatgtaggaaaacatatatagagagagttctgttcagtgagtattagtactctcatatcatatgaacaaagttcacatttgcacttttgtggtaagacaggctgcgagggtggggggcaggttaaaaaaaaagacatttcaaagagccatttccctgcctgtcatacattattaaacaggctttacacttgaatcttaatcttacttctttatcttttattcagcattcttgctcataagaaaatgttcagatggagaggaatgtgacagtattaacaagctgttgatgacttcaaagtatttatactaaagttacttttattttttaaaatgtatcgcttgcctacacctcaagttctgtctagaggctggccttgtgaaagggccaaattgagtcataggtaaaatgtgactgacaggtttttattatgctcatccttcttaaactaccctgagtgaaggcttgtaatttttatatatgagggaggcttgttatactctgtagtcaataattataagggagatgagacagctcttcatgtatcccatttaaaagacttttagtagagccaatgcctgatatttatagtctctcacaattacttatggagttatttattccccattttctttcactgaggatttgaagttgctgtataatgctttgtagcttataatttgccttcacatacgtcatctttaatctttatgaggatcccgggaaacaggtattattagtgctatttgcaaatgagaagctgagcctcagagaaatgaaataaactaactcatggacttacagttaggaagtagcaggaccagggtattgattgagggcctctcattgcatgcctaagaagaatatgtccttgagacagcaagcaatctccgggcatgacaagcattcaggaagtgtccagaagcagcaatgataacaaattatctgtttcacatgaaagccagtcttggatactttctttgggggaacttgtatgaaaatgaagacgaaaaaaaaaaaagaacagaaattgaaataatttcagtgagatctaagcatttcccaattctataagaagatcacatagttctatttccagcacccatggggtggggggagggggtgtcgggggtggcaggtcacaactgtctgcacctacagatgtagtggactgatgtcctcttctggcctctacaggcacagcactcaagatgtgcataaccaaacacacacacattcaaaaagaataataacatatttttttttgaagtatggtgtgaggataacaggggaactcaaaggcctgttgaggagggatttgaaaagggaggaagtggaacggaaagatgcccattcctgtcagctggaataagagtgacaagcacaaggtcaacaaggattgtaagtgctttaagtccaggcttaactctttccagtttcttactgatgagagagagaaaaaaaaaacagaaatgatatgtagtatgtgaatgaaatcagttgtatagttttattattgcttgaaatgtgttttactgacctattttagataattatggattcaaactacccaaactagaaagggcctttagagatagaggtcaaaccatatgttttagattttctcactcccaaggctgttgttcgatatatgtagttcatggaaatggctaataatttttcattaaaaacaggattggatgggcatggtggaataagcctttcattatagcttgatgaattgtagaggtaagaggattgccagtagtttgaagtcagctggatctacatagggagtgcccgtccagccagggatacagaatcagactccaatgtaaaacaaactgaaatgatcactgaaaatgtatgtaaataaaattataattaatcctatctaatatttttgtgattgacactgttaaacatcattagtatgatacataagacaaacttagaattcttaccatagggatacagctttatgttgtaggatgtttgaccatattatgaacctagagactgtgttctttactgaaaaaccttttcctacttgtggtgcagctcagccctagcacacacctttaatcccagaattttggacgcccacgcctttaatccaaaacaatgaaggtaaagatagtgcatagaaagaagaccaccatgttcataaacggtgtctaattgagtgacagacaaagtgactaataagatttgacggaatagggtattcttatctcacgagaagaaagaagaaagggaagcttccataaggggcagtgtaaagaggaggcagtctgttttactgggagaatttgacagaagagagaggacaagctagacgccagtaaaggcagaaagaaccagaagattagaaagaacatgttgccaacgtgagtatgaagacaagcagagccatttaggaggagggaagaaaagtcagattgaataagataacatggggaggagtttgagccagaatagctgagttgaaccagccagtgagagttccgaaaggaatagaaagggatgggtttatttagcagtaagtctcagaatccgaaaacattctaagcctaaataagattgtacagaggctagaaacgtccagatctaggcctagaagacagaggcagtaagccaccacgacaacaattacttcaagtgccacagaccctctgggtccctatgtttgcttggaacaggtctctggggcaggtgggcaaggcgtcggcgggtgacagacagactaacacgcaagattgtgtagaatctgaatgtaatgtcaggtcgagcatcaaattttttatacccaagaaataacaagaaaccaggcaaaatacaatccatcaatttacagtgacacaatacaaaaggaatgtatatatcaaaagaaggcggggaccaggccgctgccacaaagggtaaagctagtcacaaagggtaaaactgccacaggtgtaaagctagtctattgttaaacctaccaccaggggttctgcactagaagaccttttcatgaatactgcaatactccaaccccggtatttcttgggtcttcagaagaatttactaacttgcttctaatatgaagcttgctatacctagctgtagagatctctgtctcagtgggattccctagctctattatggtattctcttgtttgggtgagatttcctactgtccttagtaaatactttgcagaacagctctgagctactggctctgtcttttgtaatgcttaattagctactgaataggttaagttccttactgcattcttacaggattctaagctcggcttctgggaccttggaacactggggagatttaactctaacagaatttaatcttaaaagggatttataataaaatattaaaagagagttcgtagttacatacaccagactaatgtgggaatagggtatgagtatatgggtaaatgaaaacgccaaagctctaggaggtgagtttccgtgaaactcttttcctcgttaagtgcttactttcagcctgtcaagcagacttgagcagagggcgtggcattcaagcaaatacaacttacaggtacagctacatcttaatttattttaaaacattttatgacttttaaacaaagtggctactttattttgagtcaagattgtttgtttctttacctgtttatttaagatagggtgtcaccaaatagccttatcagcctggaacttgctgcttgaaacaaaatggccttaagctcatagcgactggctcacatctcccaagtgctggtattaaaggtgtaggtcaccgctgcttgactccacactttttcaaaatgtgttttctttttgagattagaatgtaatgacataattttttcctttcctccatacagcatctcccatggagagctctgcttcaattcagggcctccttggccttagttcttattatttaaaatgactacctctgggctcaggtgagagctcagttactacaatgcctacttagcattcctaaactgtaggtcccatccccagtactgaataaatcaggcaggacatggctgccatctcagcatttgcaaaaggaggtgaacagataagcctgagagaaggtcttagtcaaaacaagtttgaggccagcctgggctgcacgagatcctctatcaacaaacaaacaaacaaacaaacaaacaaatggtgaaaacgcacaatgacaaaatgtatgtctagctggagatacttcttacttttaaggcatttttatatttgagatcataatttacttttccctcttacctctcctccctttaatcctttccatgttcccactctatatcaaataaattcatgacctcttcttttttctccttgtctttattattgttgcatatatacatatatatttaaattataaatgtaaaatcatatgtagtagggctggtgagatggcttagtgggtaagagcgcccgactgctcttccgaaggtccggagttcaaatcccagcaaccacatggtggctcacaaccatctgtaacaagatccgacgccctcttctggagtgtctgaagacagctacagtgtacttacatataataaataaatctttaaaaaaaaatcatatgtagtatataatatcaacaatttaacatagtattgtgtgttaacatatactcgtggaatctatatcaaaaccaaatatacttcttttgactgctttctctttatcttcctttttttttctccctttgcttttaaagatttatttatttatttattatatgtaagtacactgtagctgtcttcaaacactccagaagagggagtcagatctccttatggatggttgtgagccaccatgtggttgctaggatttgaactcaagagaagtcggatgctcttatccgctgagccatctcactagccctctttatctcccttttaacaagagtgcttgataggtgtcaatatgattgatgtttgaaatcagtaacttattttacaagaattattagccaagtgattttgaccttcaccatggcgcgcgcgcacacacacacacacacacacacacacacacacacacacacaagattctgtcatacaatgcttttgagttatatcttggtgcattcttatcctcttttagtgtagcttaagattttatcattgggaagttgccaccaggtgagacctcctgagttcaactcccaggaaccacatactgaacagagaatctatgccaatagttgtcctctgacttctaaatgcatgctgtgacagacgtgtacccatacccacagaatggataactgtaaatatttctaaaaactaaactttattcttgattgattcagtttctttttcttttttctttttgttttttttttgttttttctttttttaatagatattttctttatttacattgcaaatgttatccccttttctggtttcccctccaaaaatcccctatcccctacccttttccctgctcaccaacccacccacttcttggccctggcattcccctatactggggcatagaaccttcacaggaccaagggcctctcttcccattgatgatcaactaggccattctcttctacatatgcagctagagccaggagtccctccttgtgtactctttgattggtggtttagtccctgggaactctaggattactggttagttcatattgtagttcctcctagggggctgcaaactccttcagctccttgggttctttctctagctccttcattgaggaccctgtgatcagtctaatggatggctatgagcatccacttctgtatttgccaggcactggcatagcctcacaagagagagctatatcagggtcttgtcagcaaaatctttctggcatctgcaatagtgcctgggtttggtggttgtttatgggatggatccccaggtggggcagtctctggatggtccttccttccatctcagctccaaactttgtctctgtaactcctttcatgggtattttgctccctcttctaaggagggacgaagtatccacactttagtttctttttctatatagcttttgatgaatgagaacttgccattgattgtttttttttattttgggtgtagatacatggttacctattcagagtgttttagtactttgcaagccatcttactgtgtttgtaatttagcaaatgctagtgttacatattcttcatgaacttttttgaagaatgagccttttgtttccctttagatctttacatggatgagatggcgaccacccagatttccaaagatgagcttgatgaactcaaagaagcctttgcaaaagttggtgagtgcattttataccacaacatattgttagaaattaccataaatcagcctttatctgagaaatatagtgagattgactccaaaaatcaaggttagggttagatggataaagttttagacattgtagtcaaaactatattaattctggcagacattactcaacagttaatggtgcatatctgaattcaatcctgaagacccacttggtggaaggagggaacttgcaggagcaagttgttatgtggactctgtgtgtgtgtgtgtgtgtataggtatgtatgtataaattttaaaaattttaaaatattttaatagaatctagtatttaatatggtcaatcatttttagctcagagtcctagtcattaaatctgtcctgctgtggcacttgaaaatttaatgacatatgtatgttattagaatattttccatatcatgttttttctaaggggagtatttggagtgaccgctgaagcattacttagatttcactgttcctgtggtattttatttgttgaggaaagagtctcaatctgtatccaggctagccttgaactcattatgtatactgttcatccttctaagaagcatcaaatgaagagggaaaggcatattgtgatgtcattgttttcccctggaacggagtattgaacccaaaatttcatgcatggcaggcaagtcctctacagctgagctgcatcctcagccattaatattttcagacagtctcactgagctatcctgggtgatataaactgtgatcctctcacctaacccaagaatcataattatagatacatgccaacatatatggcttgttttcttttttgtgtatttgtggtatacatatatactagaccaactaagcctataagtagcatgaccatcttttcctttcactttttattttgagacaaggtctcatacccttcccaaactgaccttgaactgactccaaaggccagccagatcttgaatttgctctctatgcctcttcttcggcttctccagtagctggggttgcaagcctgtgacaccaggtcaagttttattttgttttgaaccttttaacatcatatcacatgccttccaattgagtagctatggaagcaatgcatagtgttttcattctatgcaaagttcaagtccataaaggataaagtgaatggagtgaaaactaactactgatacaaatcctcacaagacacagattgtgcttaagctttggctctcaacctgtggctgtaaacactttgcaaaacctctgtctccaaaaatgtctacattataattcataacagtagcaaagttacagttatgaaacagcaacaaaaataattttgtagttgggggccacccaacacgaggaacgccattaaaagcatttttctgcattagaaaggttgaaaccccctcgcttgaggtgaactgaaatcaaagggagtaaagttagaatataatggtttgttatttaaatcagaattactctgaaactctaaaagtcctattagtataacatttaaaatgatagctatttctgttccctttacattcactcattcattcattcattcattcatttttgaaacagtctcttttagagcagaatggcctccagattcactccaaatagtccacgatgacttcaaactcttattcccatcctcccactctgtagtgctgagattgaagacattaccacctgatttaggattttattgctgtgaagagacaccatgaccttattaaaaaaccaaacaaacattgaattggcagtggcttatagttcagaggtttagtccattattgtcatggcaggatggatggcatgaagacagacattgtgctgaaggtatagttgagagttctacatcttgatctacaggcaccagaaggagactgtgtatatactgagcatagcttaaacatataagaccatgaagcctgcctacaaggccgcacctaatccaacaaggctatataccccctaatagtgccactccctatgggccaggtattcaaacacatgaatctgggggcggggggcaaactttttcaaaccaccaggcttttatgcatactatgcaaactctccatcaactgagctacatccctacatatgatcctaatttctgtaatggtatttatattaatagaaacagcataccgtgaagagaataataacctccctagctagagtggctattcatatcctgtcataaggctagacagaaaaggttaaactgttctgaatcatcactttatctgtgtatattttacaaggcaatatattaacttgctgcacatatgactcactgggagaatggagttacataggtagatattcaactgatgaaaaatagaaaatgagtccttggtcataagaggtggtgttattttttattcatattttctctttcatcaatatcccattagaactgttcttaccataattgcttcagaaacatattttctcccccccccccttttttggcattttcgagacagggtttctctctgtagttctggctgtcctgaaactcactctgtagaccaggctggcctcgaactcagaaatctgcctgcctctgcctcccaagtgctgggattaaaggcgtgtgacaccactgcccggctttctttcttccttatcttttgtttacattcatcttttagtgttaggaacagtttgtttctttatgtgttagaatagggaccatgaattactatgcctagcctcctgaaggaaggccttgacctcatatattgccttgtagaaatatttgtgttcactgtttctttaaattaacattaaatgagatgtgatttacttgatgggacttggagtactttttttttctatttatagtgttgggttttgttttctttatttttttcattttttttattagatttttttttcctttacgtttcagatgctatcccaaaagtcccctataccctctccccaccctgcttccctacctacccattcccacttcttggccctggcgttcccctgtactggggcatgtgaagtttgtaagaccaaggggactccctttggagtactttttatgagttagcagcataactgttttgataagatataatagagaattgaccaattattgccacggtaagaacaagattaaaatatacttactaaggagggatcaattagaattgtggtccttaaccttcctaatgctgtgatcctttgaaacagttcctcatgtcctagtgacaccccaaccataaaattatttcattgataattcattaatataattttgctacttttatgtgttataatataagtagatgatatgcatgatatctgatatgcacccccctgtaaaagggttgtttgacaccctcagtggtcaagacgcacatgttaagaaccattggattagaatttttactgaaagaaattcagaacagcagcaaaaacaaaagcctatcactgtgtgagtctttgaatggcataggcaggaggtggggatgtatgaattactgaaacctatacccacaacaggttttgctctacaaccccaaactaatatatacaagctgtccctcaaaaattaggaggccagtatttctgcctgttttgattaatactcttttttaaatttccactgtaaatacctagtgcagtgttgtctacatgttaggttctcaataaatacttaattacttacataccaaagaaacacagtcttttgatatactgggattttaccagtatcaattgtacactcaaaaggtccttgctgggaagaatttattactaaagtttttttgggcattacaccaaagcacataaaagcagcatggggtgtctgtgagggtgagtgtgtatttgtctgtgggggtggggtactgtgtggaaaatgcttgtgcagagtctatctttcagaaactcattgaaaagctctcctgactctggcttttcctacaaacctctgtagtttttacatggcgttggatacagaatcctcaagaggcagctctcaaaggtgttgtggaactaattttttaatttaaggatcccttatttatgaaacaaagctctagaacttattttccttgccattgtttcctactctgtgtggaaagggagagcagagacaattactttgtctcacttcatttgtgacaaaatatggaaatcgttttccttatctattaacaataatagccttgattatctgcttagaaactcaacaaaatcacagtgggcagagaaaaatctctgtaatcatgactaatcacaggttttgttcaatcaattaatagtgcttcgaaactctttaccagcaataaattgagtattaggatttaaagttctttcactagcttcttgcacctgctctaatcatatgcaattattttaattataccaacaattgtctcaggatttccctctgggttagtggaaaccatagtgctaccctttttccccaacacaaacttttcctgttttaatgtaaatgctgacatcctgcatggttttataaaagagaataaagcttggtatgttgaggcctgccaggcatccttgcagtttataatccttgtgctagagtggctacaggaatatctcaagagtacgaggttagccaaggctagatagggagaccctgactctatatttttcaagccagaagtgatggcacacacctctaatcccactacttggccacatctctgagagttcaaaaccctgtttcaaaataaataatcttgatagatagatagatagatagatagatagatagatagatagatagatagatagatagatagatgtagttttcctcctttgggcagtgacagtacatggctttaagcctagtactgggaaggcagaagcaggtgaatctctgtttgttggaggctagcctggtctaagaagtctcaagacagacaggggtgcatacagagaaccctgcctcaaaaaccacactacacacacacaatgtgtatatgtgattttgttttcattttatatattaatttacaaagtgaatgtttaccagatacaagatgtcttttacattctaagacttcaattttatattgttacttccctcaaaaattgaattttggatggcttaaaatactctcagtttgactttggtctgttgcaagaccactttcttaaaaataggactttggagtgctggaaaggtgactcagggtttatagctactcttgtaataggtctgggttcaattctcagaaccaacatagggggttcacaaccatctacaactccaagtccagatcagacaccctcttttcctcttctgaactctgtggacagctgcaatcacgtgtatacatattccacaacacacacacataattacaacaaagatatatctataaaaatagtaataaaatatgattttttttcttccccagagcatgctctatctagtaaacttttgtaaagatgaaagtcaggatatttgaaacacaagaatactggggttgcttaagtggccaggaatagtatgggtgcattcctttgaggttcccaccaaatgaagccaaaaacattttggttgtggtgattttagagtaccacatttctctcagtccagaaaatggaactgtttccaattacttgatgttctctagtatatagaaaccacatcatgatgtcacacaaaaaaatggcagttgagtccagattactttcaatgttaaataaaactacacagcacacatttgtttaattataccttcaaatagaaaactgcaaaaactaggaggcagttctgtcggtaagttgtagagctattggttagtttatagatggaactgggcattcacacacacacttacaaatgtgggggggggatgtatttataggcccaaactaacagaaatgaatgaacaagcagataaatgaataaaactgggcatggtgatatatgccagcaagtcaaaaatttagaagtagagacaagaagagggattcaaggctagtcttagctacataacaagtacaagaccagcatgtactaccttctattctgtctcctaatactaaataagtaaagaaatactgcatctcaactaaaagataaattagctagtgttctttcactgtgctgtgtggtccattatcaatgcaatattagaagtggatgtttggggatagcctggagaccatgtgctgatggaaagttctctgaggacctgtgtgaggattcgagctggaccgcacacatgtgagaacatgaccacaaatatgtgtatgtcaatatgtttagagagaagagagtagcagcaggtaggcagctatcagcaaactgctagaaacatacaggaaaagattagaaacatttctgaatacccattcctggccctctagattgctcaagtgttcacatctaggtgaactccacctttggggatccactcctgaaagtccaatataaaagatgaataagcaagctctagtctaccctagactagactcattaaatatccacttatgttcattatgttcctatcttagaaagtagaagctgagctacagggttagatccacatctgaagatatatatagtagcatcctttccttggcatttttccaagacagggctctctgggtagccatgaccatcctagaacttgctctgtataccaggctggcccagaactcagagattgacctatctctgcttcctgagtgctggggttaaaggtgcccacaagcagtatccagctaagttttcaaacttcaatacctaatgaaagcttggttttactacttggaccttagggtgtaataaagaaaatatatgtatatatgctcctgtcaaaaaaaccttttggtcagttgtgttccaaaaattgttttgggatttattaattttgtgtgttttctgtgtgtgtgtgtgtgtgtctgtgtgtgtgtgtgtctgtgtatgtgtgtgtctgtgtgtgtgtgtatgtgtgtgtctgtgtgtgtgtgtgtgtctgtgtgtgtgtgtgtgcgccacatatgtgtctggtacctgcagaggtaagaaagggatgtcagattccttggaacaaaagttctgaatgttgacaagctatcagatgggtgctgagaagtaagactgagttctctgcaagagcaacaagtactcataaatactgaaccatctctccagcccctggtcaagtctataaatcaatgattttgtattgtagactttcaacttttatagactttcaacatcatgtgtgtttctgtaaatccattattagacacatacattctctatcaatgttttttaatttaaaacattttaagaatacattaggtaagctaaactgaaatttttaaaattccagccttttcaaaagattgtatgactgaactggattgattttcttcttttaattgtggacactgtccacaatgggttaatgtaggagccatatgtgcattaaatatgatggcccacagttgcaacctcttttttagaaaaacactatatttagacagattcaagaagagttaaagcaacacacacacacacacacacacacacacacacacacacacacactccctgagggtcaaaggaaatcctcatttttcttactgtcagatttataacacaaagtagcaccttaaaagatgcttttgaagggatgggttatactgcataccacctaggcaagggcactgtaaaacagcagccaaaatcaaaaccacttgaattctggctcaaccttctccagacaaggacttaaaatagcttaaataacaggatgcaaggggagggaaaacatttccttttaaggatgtgcattcttggtgtgattcagacttctgcaggaacatggcaggaacatgagtttgtttgctttgaggtaacttgggggagggtgttgaaggaggtaactggcatttaaactaatgcttggtaaaaagagaagaatgagatttcctttaaaacaaaatgcagatgtgactctacatgtgtcatctgagacacggagagacagatggagagtgaattccttgtaaccaatagttagtgtgtttctgatgaattcagcagccagaggaaaagatggttctgcctagtacaatcttgagtgcctcctagtgattttttgcccaagtataatgtttttcagtgtttgttttttaaataaactttttacatttgttaaatgttagctcattactttgtgcaagcacttggtttggcagctaggtagccttccttttttttccccctgtggcatgttagtgtccctataataatcatattttcagaactacaatgctcgtagaagcattgtgactgttgtggataacataagctatatgcaaatgatttatatttttaatcagtcattagagaatgtggtggtataagaggcaagtcttccaaatacaaagcctcttccttctcacatatatatatatatatatatatatatatatatatatatatatatatatatatatatatagtgtgtagtgagaagcagtgagtgagccagaaatgggttccagaatgttggcagctttaatgagaaaataaagaggtaccatcgtgcctgctgattgcaattttagtttccagttaaaaccgcttttgatctgggtctgtttcttagatgctcatattattaaaatgttatgttcatatcaaattcagaatgggaaaagttcaccatcaaccatgaccttagctctcggtgaataacgttactggtaggatggattctggtgaaaccagcgtgctccctcatttctctggaacgttagattgctgtcattgcttcagagatgtactgctaggtttgatttctgcttttttaaactggagattggaaagacaatcacataaaatgcttggaatataattacacactcttctgtgccttgtaaggattttaccagctgggaggttttgtaaaattaattcttagcggcggccattttctggctctctctgccttcttaaagacattgaaattgttcccttccagtccagtcctaaggacgaccgacccattgtgatttgcttaatacaagcaccaaaatgccacaatgtaaataggattagcatctactgagaacatacaagaaggtagccaagtagaatttaggaaagaaagatcatacagtgatacacaatttctcccttccccacacctctcttttcttaggacttggtttctctgtgtaaccctggcctacttaggctctctctgtagaccaggctggcctcaaacactgggatctacctgcctctgcctcctgagtattgggattaaagaaaggtgtgtaccattgcctggctagatgatacacattctagtcgctaaaggtgaaaaatgtaaatatcctcagggttgtcaacgatgtacaaaaatttaagagatattggttcaagtgagacccaagggttttaacttaatttaacttctcatttattttcttcttttatttaggcccagccttgtgtctctgacagatggctatggtcacttagaaaaccaaattacacatcaggtggttgctgggtggggacaggattagaacaaagggagaaagattaaatgttatttgagagatatctccgtcaagttttggcttcctgatgaactggcatttcgtctgttttgggtgctttttctgtattttttggtcttcgctgctaagttttgttttgaaaacactcatctaggattagagcattcttcctgcagttaatgtctgagaattagtttgtgcagtattttagagcattgactctagagcgtggggcccagcaatagagctcgtccttagcatgcataaagccccagtgctgggactaaaggtgtccaccccaactatccctgccttggcagaacttccctaatcaaattcctaatcaaaccatttccatcttggtcatcttggtccatttgcttatttgtagattattacttcccttacattgtaatatacctaagctacagtagcctaaagattattagataatttatagaatcattttaatgcctgctttactcagtactccattctcttgaattgtgtttgtcttagaataacgtttgtttatattaactcaaaaaactggcctccacagctatgttaccccaggtcagatgtgctttgacataaaaatctgtgtgaaaccataaaacctattttggaaaaagaaaagaatacacataaaaatcctacatgctgcatagagatagtagaaattgttacaccatgacacagtttgttggtgtttaaagtattatttctaagactcctcttgtttctatgatttaataatagctttacacactagaaactatactttcttataatcagggatgctatttctaagtaaagctttgtacacatttttaaaaatacaaggtacacgatatgaacaaaacattgccctttcagttaaaacagacattcctcctctgtacatccttagattccaaaggataaaaaaatattgtaattaggcaggcatgtaaaatgatgatattcttacaaatttatttctaatcttttttctgttttatctttctgtttgtttcttggctatctttttccttccttttcacaaagatctcaacagcaatggattcatttgcgactatgagcttcatgagcttttcaaggaagctaatatgccactgcccggatataaagtgagagaaattattcagaaactcatggtggatggtgacagaaataaagatgggaagatcagctttaatgagtttgtttatgtaagtatatccaaatcggaatatgaaaattcattgttgttccactgtatgctgggaaacaaagtataaataccactgtattgatggttaactatcatattaatactctactaccttgtaacatttttgtcattctgacttctaaatttaaattcttcagctattagaatatttttaaaaatatgaaaaaatggtacattgaaaaaaccaaagctatagcacaatgctcacttgtggccagaaacaatctcctttggggcatcattagagagcatctattaagatgctaaataacagctttgaggcattctttctcttccccatatagaagatcatggtacacaagtttactgatatcatatgactgagtcttagaagtttcctgagctaaagtttctaatgaaaaggtgttttctcccacaccccactacttgtaatatttaaatgtctcgttttccccagggtgaccatattgataattaaaagctagaagtatatctttcggtatgtttggagaagtgtttacaattttgttttcttgtatagtatcatcaaatattcctcaaggtttatggctaatttcataacacttctcctccataaacacttagttcagttcctgtagcatgtgtgacaggcatgagcttctttatcaagatagaactattttagctgcctgaattacagccaacattgtagtgaattacagattttcagtctagatttgttaagaaattattgcatgatgacattttaaatagctgttgcttcttctcacttaagaacacccttaagggttagcaagatagtttgacatttaagagtactagctgctcctccagactacctaggttcagttcaaatggaggcttatgactaagtgtttgtgattccagttgcacaggaaatgcgcccacttctggtttccctaggcactgcacatgagttggacacagcctataaaccaaggcactggtggcatatgcctttaattacaggatttaggagacagaggcagacggatatttgtgagttcaaggccaacctggtctaaagagctaattctagaaagcaaaagttatacagtgaagccctgtctcacaggggaaaaaaataattgaaaagaacacccttaaggcagacatggtggtacagacctttctcaagttcgagacagtcattgctgcaaagagagaccctgcctcagataagaaacattcatggttggggttttgtttttgtgttggggtttgctttatttagtttgttttgagacagtctgaatttaaagtcatgatcatcctgccttggcctccagagagcttacttagcctacctctagattgtatggatgttactatttatttatttatttatttatttatttattgccttgttttttaagactacctttggctgtgtagctcagactggcctccagtttgttatttcttcctgcctcagcatccccagtgctgggattttaggagcatgctgtactgctcctataaccggtgattattttaagcttgaatttgagttgatcttgcaaggcattgttttcagtatactgcaaactaggaattactttttcctatttgtcaccaagatcccagcgtgcatgttctccttttccatacttcatcttggcaccaatacatctgctgttatagcatatgctctcatcagttaccatgactcattatgacaactgaaattcagatatgttccctctgagcagaactaacgcaaagaacacagcatatggtctggaaacaaatagactacatagggctgtagagatggcagtggttgagagcacagattgcttttccagaggacccaggttcaagtaccaccacccacatagcagctcacaactgtctgtaattccaggatctacactctcacgatttcttaaaaccaaatagacctgtcagatgtggggaatgggtggtcgttactgaaaaatacagacgtgtatcattattatacttacacagttcttgccattttccttgtgaaaaactgatttcctcccatcatttctgtctccagttatgtccaaagcatttgctttgaattctgtgttcaatagtaagttacaaatgttttgcggtgtcagcacttgcatgtctctgttcgtactttgcatgtgtcgctgtgaatttcaagcagatcagagaagttgggaactatggttaggtgcttttcatataacttatagctgagagtttgttaactactaggaagaagcagcctaagccattagcatctgtactctaactggtaatgttgaggacaccattataaacttgtctaccaaaaaaatgatcatgataaaactttcaattttgtattttttaaagactgcggtttctacacatcatttagtggcttttaagtgacaaggtaatgttgacttagtatgtactttaaaagtagaggcataataatttgggcaaaaccaaggattttttggaataaaaaagtaaggaggggctggagagttggcatggtggttaagagcactagttattcttccacaggtcctaagttcaattcccagcacccatacggtgactcagaactatccagtatgatctgatgccctcttctgtcatgcagacatacaggaaaacagcagtcaaatacataaataaatataacaaacgacaaaagaatatattttttagaaaattaaggagggcatttaagatcaaagtaatatttagaaggatttccactctcttgtttgagacaggatctgtctctgtagccctggttgtcctggaactggctacgttgaccaggctggcctcagactcacagaggtggacctgcctttgcctcacgtgctacaattaaaaatgtgatcacggctgggtggtggtggcgcacgcctttgatcccagcacttgggaagcaagaggcaggcggatttctgagttcgaggccagcctggtctacagagtgagttccaatacagccagggaatacacagagaaaccctgtctcgaaaaaacaaaacaaaacaaacaaacaaaaaaatgtgatcactttgccttgcttcaacatgaaacaagcatatgaaaatgaaagtgagttgaccagcactgtctggagggtgagaagcctttctttgttggtcctctgctaatcaagacccttgaactgggacctgagaaatggctcagcagcactggctgcttctccagaagtcccagcactgaaacaatctgtgactctagttccaagaaatccattgccctattctggtctccaaggacatcactaagatgttaaagtgacccacataaactatcataatcctgtggccatcactgttagaagaaagggggacattgtaatggctgtccactctcatgtgctttgctgctgatttaatgctttccaagttctcagagaaaattgactcatggccgaactacactagaaccagagactgcaactcttttttttttaattaggtattttcctcaattacatttccaatgctatcccaaaagtcccccataccctcccacccactcccctacccacccactcccactttttggccctggcgttcccctgtactggggcatataaagtttgcatgtccaatgggcctctctttccagtgatggccgactaggccatcttttgatacatatgcagctagagtcaagagctccggggtactggttagttcatattgttgttccacctatagcgttgcagaaccctttagctccttggatacattctctagctcctccatttggggtcctgtgatccatccaatagctgactgcaacccttgctttagcataaggaaaggaaaagaagggcagtggtggcgcacgcctttgatcccagcgctcaggaggcagaggtagtggttttctgagttcaaagctagcctgatctacagagtgagttctaggacagcaagggctacacagaaggaccctgtctggaaaaaaaagaaagaaaaaagaaaaagaaacatgttctccgatgctaggtttggtgttaggtgaagtagagtataaagcagtattcagtgtaagctaagctacaaagtatatcagtttctattttcaaggatagatgaagggcagaagaggctcctaatacagtaaacaaacttcaaagccaggactgtaattaatacttgtttttgttttgagtatcacaagttgaagttactagccttgtttatttatttatttatttatttatttattttagttttttgagggagatttcctctgtgtaagaactcaagctctcctggaactctctgtagaccaggctggcctcgcactcacggagatctgcctgcctctgcctcccaagtgctgggattaaaggcatctgctgtcatgccgtgctactgggctttttaaatgttgaccttttttctatttttacttttcttgtgctatgatttaaacactgggggccttgcacatgctaggtaaatgttctaccactgaaacatatatacagaacgctaggttttatacttataaaactaacacaattgtttcctctgattgtgaaagactgattggacaatatattttgaaacagagatgattacattcatttcttgttttcacagtgataaacttgcctttacatactggtaataagtctttaaccttttgctaataaattcggcccacaggattaatcatttcaagatagcaaagtacttagaacaatgtcaggcacagagtaaatgctccatagctcttagtggtttaaataattattgctacttttattgatggattcctttgagccagggtctcaccaagttacctaggctggacaaacctcattgattccgtggattttctcgctctcagcctggagcaattgtggggttcctggccccttactactctctctctctctctctctccctcctatttaaaatattttctcctatttaaaataaatacaccagtacacttttccaactttaggccggcaacaatttccataagaaggaaaaattcaaacctgctaggttggaaacaaaccccatactggaaatagtcaatattttctgcaaattctttctgcaatctttccttcttaagtcatacgcctctgcactgctcggcgttggctgcttggcttgtgcaggactccctttggggtcaaaagaccttaagtgcctgctggagattttgagagatagccggtgaggcttaggaaaggaagagccagagatgccagcaaagagactaaaagatgcataagatgagagtggctgtttgccttctgagcgtagtacacaaggaaattgtctccagatgataaataccaactttgtcctcaagaagggaaaacagcataacacagagaactcattagggtcacaagtgagccttgaaaaacttccctgggcatcctagcagtcttgtgctggctctgatttctgagatgcctgtgaagccaaagcctatactccaacggttttgtcatccaatccagtaatgccttccctgagtagaaagaaaaatgcagactttcatggagtgcaccaatataatgtatgaattgtctttttaaaaatattattaaattcatttactcactttacaacccaataaatatcgacccttcctctcctcccaggacccctcaagcaagtcagccctcccccattttcaacttccccgaagcccccctctgtgtcaaatatcacccccacacactctccccaccgtccacacacctatcccacccctaccccccccacacacacacacatcaagtcactgcaggactaggggcatcctctcccactgaggccagacaaggctatccttttaggggttcaggatccaaagatagacaggcatgcaacaagctcatgggcagacagcctctgtttcagttgttgggggaaccccataaagaccaagtgactcatctgctacataggtgctaggaggcctacctaggtctagcctgtgctcactctttggtcggtaattcagactctgggagcctctgagggtccaggttagttgactctgatgtatgaattttcaatgctcttattaaaaaaaaaaaaaaagaaagaaagaaaagaaaaagaaatagttataatgagatctggtgccctcttctggcgtgcaggtatgcatgcaggcagaacactatacatactacatcttgttttaaaaaagggggaaaaaagttttaaactaagaaacagaacaaaatactatgaaataaaatttgaggttggctgaaatgtgtttggaaatatttggaaggcagaatttggaatatagttcagtggtaaactagactctgtcctcagcaccacaggaaagggcatttaacaaatttaattagactttccacatcattcacaagcactgcttcccatacgtatgaaaaaaataggctattttaccacaaagatattcttattgcattattcttctctctctctctctctctctctctctccatatatatatatatatatatatatatatatatatatatatatatatatggaatatagtggatatatcattcagttagaatcatgatcactgaaacaacttaatttgttagaagactacagtgtgtaaagcagaggcacagagaataagaaaaacagctcttcctgtgttcctccgaagcagctgtaacaggttttggtctggcactggtgactggtatgtttggtatgaggaaatgcacacctgtccaatttcaagattttttttttttttttttacaaaatggagtggagtttcaaattaggaagactaactttttactgagcagatactttttttttctttgttttgttttatttgagaaagtgtctcgatctgtaaatcaagcagactttgaactcctggcaatcctcctgctttgatctcctgaagtgcagggattacaaatatgagccaccaggctctatttttgttttgtttttgagacatggggctcattctggctatagcataaaatttcaacttttgaggacacagcattaaaactagaggaagcaactgtgcacagtggcccacgcatttaggcccatcactcacgaggaagagacaggagatctctgagttcaaggctagccaggcctacaggatgagttccagaatggtgaaaggtacacagagaaacctggtctcaaaactaccacacacatgcacacttgcaaaaagctacagggaacttaattgttaaaagctaattgcacagtattttcctaaacaaaagtatgattatggagccaaagttgggatttgagaatagtagtgggacaatatgactgtgataatcagtgacaatgtccattacagaaagtcccttttttgttgtgcacatatgtaatcccagcacttgggaaggcagaagcaagttagatctaacaaaccaacagcaacaaaaaggcccattctcttagtggattaattacaaaagggctttgcccgaagcttgcttgttattgcatgggctagactgttccagtctgcactcactactgtactttgtgaacttcaactaaaggtaacctccttcagggactagaatggcactgtccacgagtcagcagcactaaaagcctttgacatgggttatgttctgctcagcaattctttctattagatattttcttcatttacgtttcaaatgctatccctaaagccccctataccctccctctgccctgttctccaacccatccactcctgcttcctggccctggcattcccctgtactggggcatatgatcttcacaagaccaagtgcctctcttcccaatgatggccgactaggccatcctctgctacatatgcaactagagacacagctctgggggtactggttagttcatattgttgatcctcctatagggttgcagacccattcagctccttgggtactttctctagctcccgttcagcaattcttttgtttatggctccacttagagattctaaaggcatctagcaaaatttcatgaccctgaaggatggctcagtgggtaaagcatttgcttagcaagcccactgacctgaatttgatctccggagtgcatggaaaggtggcaggagagaaccagcacctcagaattgtcctctgacctctatgtgtgtacccctccagtaaaaaaagaatgtttaccaagttgccagacttgttcctagttgacagtggtaaattgaagcatgcacattgtaaacagggggaaattttggaaggagacaaatttgagaatatcaagagtatagagaaggattttaaagatgctcattcatttatattattaaacctggatagaaagcttacatttttctaccctgtttaacttttggtgctggagaggtggctcagtggttaacagcaatgtgtgttcttcaggggaacccgggttcaattcccatgcacccacgtggcagctcaacaccatctgtagctccagttctagtggacctggaaccttcagagacatacatgcaggaaaaacaccaaagtacataaaataaaaataaatcttttctaaaaattgaaaatttatttttaaaaagttagcatgttatccatgttctgcaatgggaagaaaagctgaactcaaatgcccaaataggacactcattaaaaagccttagatgatccgggcagtggtggtgcacacctttaatcccagcactcgggaggcagaggcaggcggatttctgagttcgaggccagcctgatctacaaagtgagttccaggacagccatggctacacagagaaaaccctgtcttaaaaaaacaaacaaacaaacaaacaaacaaacaaagccttaaatgagtgtgttttctcttctgtctccttcctcacataactgaggtcgaaaccctagcacttatgtgaacaaggcaagtgctctgccactgatcaatcttcacagttctaatttcactttgttttaaagatttctttatttacctattttatgtatgtgagtacactgtatctgtcttcagacacaccagaagaggccatcggatcccattgcagatggttgtgagtcatcgcgtggttgctgggatttgaactcaggacctctggaagagcagtcggtgctcttaaccgctgagccatctctccagccctaatttccctttttgtgttgtttgttttttgagacagggtttctctgtgtaatagccctggatgtcctagaactcactgtagaccaagctggcctagaattcagagatcatcctgtctctgcctccagagtgctgagattaaaggtgtgctctactgcccagtcgaaattcagttttaatttttatttttagacaaggtctcactgtgttgtccaaagtggccatagacttgcagtccttctgcttcatgacagctctttttagtcagtgtctacgccattactccccatccccttcttgaggtaaagattttctacattgccctagcaaccaggaacctcttacagaagtccagctggccccaaacttgtacagatcctcttgcctctgccccctgggttttatgattacaaatgtgcccaccatgtcctggctttgttgtctatgatctttcttattttttagaatagtttgttgagtccaccccattagagcagtggacaatgccatattaacaatattgcctacttcctactttctctccttgagaatcatctatgccacgagcacttttgtccattattactctgttgcttttgattgagtgaactcttagctaccacattatgccacaaaatacttttttggtcgagtcatacatttttgtctgtaggtaagaattgtgactgaagaaaggaccacccatcagcctcttctaagaaaagaacaaagctatgcttcaccatgggaaattaacagttttacctgtgcctttgaactacactttttttttttttacttaaaagtgcattcaatgcatgcagcactgaatgtgtttggcgagtgtgtgaaattgacgcttcatctttagtaacagccctgtagccttgcaaaaacccaagccagttttcctctttcatgctcaccacctgtgaagaatactgtaggtaatagacagatacaacggagttcaatgtgcttgttcttgtgcccacttgaaaatggtgactcaacacccttgttttcattgatagattttccaagaggtaaagagcagtgatatcgctaaaaccttccgaaaggccatcaacaggaaagaagggatttgtgctctgggagggacatcagagttgtccagtgaagggacccagcattcctattcaggtaatcatgacatggttgtgcttaggtgggtacagcgcactgggcaggtacctactgtcatgccttaaaaagcatgtttctctaattaaatagactaagtagtcttagtggcatggttgggtcttgggtcacatattggtcagaaagctatggtagacattggtggcttgtaagacacagagtaaaatccaagtaatagtagtctttattacagtggaggtgtacagtaatataaatacattgctatatattttgtaacttccctaaagatcggtcaacctgttcttttgtttctactaacttattaattagtccctaatggccactatattgcttccatgtctctgagtattccaagaggatgagcacatatttgtgaagcattatctcttagcagcactctgcaacaagcgtagggcttgggggccaaatgattaacagagagtatgaactgatttcttgcttcatataattttagaggaagaaaaatatgcttttgttaactggataaacaaagctttggaaaatgatcccgattgtagacatgtcatacccatgaacccaaatactgatgacctgttcaaagcagttggtgatgggatcgtgctctggtaagaggatagtttggttttgtactgagatttccaaagaatctccacagaatacatgtatttggttgtgtgcttggttatttagctgtttgatgtcaagaaggggtggggggggcaattgcccaggttttgtctttttcatttaatatctaaatctatgtgtaaaagtaaaagtcaatcacagagtggggacctcttttatagggtaaaattttggcttccaatttctcctcatcactgagaaagcagaacattataattttttcaaacataagtgtgtcagtgtctattcattctgaagtaccttggcttccaacaagagaaaaagaagctagccttcagttctaactctccagtgatctaattctgaaaactgcttttgtcgctttagctgcattagagccagcagtatcttggcagaagtgatataagattatccacactgtccattactgctcctgttttcagagatggctttgccacactgttctaaaatgtacttcattataagttctgagttcctatgcaagccttcccacttagtagctgtggatggggtctagatagtcagagccttttacatttcactttcccctgtggtcttcatagtatggtacagtttggacatcgtgaaagaaaaaatccaaaatctgaacctttagttttatttttgttcatgactttattagcatatattaataatatatgataatgggttgcattatgaccttttcatatacatacatgtatgtatgtgtatgtatatgtatacatgtgtgtgtgtttgtgtgtctgtgtgacagattttgatcatattcctacggacattcctgtctgctccctctctcattcctactgatctccatcttcttcccatcttaccctcttctattttcatatcttttttttttttcaaaaaaaaaaacctgtaagtgtcatcaggcatacacacaggagcaagggttagaggatagttacaagaccatctgaaacttcaaattctgataaggacactgtaagtggaatatccgtagctgacctcaggtgatagatataaacaaagagcagattcccccaaatactgcacaaaattgcctctgttccagcgccacacctcagtggcataagatgaactagcatgttcatggcaatgattttcaaactcagcaatacactgtgcagggtggcatattcctgtaatcccagcactcaagaagtggggtcagacaaatatctgtgagttcaaggccagcctgatctactatgtaatcagttccaggacagccagggagacatagtgagatcctgtcccaaaataaaaaagaaggagagaaagaaggaaggaaagaaagaacagaaaaaaaaacagataaaaaagaaagaatagggccgggcgtggtggtgcacgcctttaatcccagcactcgggaggcagaggcaggtggatttctgagttcgaggccagcctggtctacaaagtgagttccaggacagccagggctacacagaaccctgtctcgaaaaaccaagaaaaaaaagaagaaagaataaaaaacaacaaaaaagcaaacctgccaggcagtgatggcacacacctttaattccagcacttgggtggcagaggcaggcaaatctctataagttcaagggcagccttgcccacatatcaagtttcgggccagccagggctacacatagaaaccctgtctcaaaacaaagcaaaatttaaaaaaacaaaacaaaaccttacaaccttagcatcacaaaaaaattaaaagcaaaacttagattcaggttgtatgtatgtgtgagtgggtgtatgcatgtctttgtgtgtgtacatacatatgtgtaatggaatatgaataaaaagttgttttcagacctgggcactccaatatgtcatcatattttgtctaatcagcagtttggacatacatagtttttgtggtcaacatgataaatgtcatctctggcattttgtatttttttattatatgtgtagcttcatgggtttatgtataccacattgtgcaggtatctgtgaaggccaaaagagtatatagaattccctgaaactggaattaacaggcagttgtgagctgttcagtattggtgctaggaaccaaacctgggtcctctacaagggaagtaaatgttcttaacccctgggccatctcttcagccccagattgactttattttttatatattgcatgaaagatagtttataataaactttaccattcatgaccattcatgaagatgtattcaagtgttgttaataaaaaagcaagtatgtcccaagatagtctcaactcggtatgtggtccaggatggcctcaaactcatgattcttttgccaacatgctctagtgctgagactatagattcctctatgtcctaattaagtgatgctggggactgaacccatgacctcatgcaggctaggtaagcactctacaaactgagctacatctccaaacttgaaggactctttaaaagtaaaccaacatttgtttgtttgtttcagcaaaatgatcaacctttcagttcctgatacaattgacgagagagcaatcaataagaagaagcttacacccttcatcattcaggtgcgcggtgttctctgctctctcttccatgaactgtgatttgaaacagaggctatagactgtctgctggcctctaatcctcagagcagctctgagtgtagaatgtccattgatgttttagaccatgagctgggactcagaaaggcttgcggttgtgggtcttgttggagaagttcacactggcactgaggtgttgttccatattgaactcaaagccctgtgtgcctttcattgcctattgagttaagatatgaccaaagtgatcaaaaggatttaagcgctttcttagctggtgtgcttaaaggatggagtgtgtttgttttccactgaatgagtaagtatagtacagcaaaatcccatcacgcagcagtgtccttgagatgtacagattggttatttctaaagcctggatgtatgccatacgctgctggattccaattcaggcaattttagaaaaatccattcacatggatatatttcctttggttacttgactttttttactttagaattgacataattcaaaagcaaccagataaaaagaaaaggtccacttcctgtcgaattgtggaaaaaaaaaaagaatacaagtgagactgagaattgctgccactttgctacttaacgctgaactctgcaatttgttttctgtaaatgtgggtggatgaaattaatacctcgtattaatttctcagcttactggtatttttcagtgaaggctgaagtggactgggtgtggaaaaaggaaaaggtcaagaagtgcataatttggctgtcttgcaggaaaacttgaacttggccctgaactctgcttctgccattgggtgtcacgttgtgaacattggtgccgaagatctgcgggccgggaaacctcacctggttttgggactgctttggcagattattaagattggcctgtttgctgacattgaattaagcaggaatgaaggtaatggggcacagttgttcttttgaaagatggatattgttcatttttactttctcttcatggaaattgccaggctcgcacttaaccgagttgagctgatggtaactagaatgaatccagagctattcaggaaatcaagccatacgcctctgttctttatctgtagctaacatgacagttcacattggattttagtataaagacataaaaacacagagacgttgatattgggtgccttcctcagtctctctctaccttagaagtgtgtgtgtgtgtgtgtgtgtacatgaacctccgacttattaatccagctatccaagctggccaacgagccccagggatccttctgtgtccacctccccaacacttggattacagatgagcaccactgcacccaggtttatacaagtactgtgatctaagcactggtcttcatacttaaacagcaaataatttaccaagcgcttccctccatccccaggcttactttgagtcaaggtctatctctaaatctagaacttgccaatttggctagattgctgcacagcaaactcccagagcctggcacacactccaccccatcccaccccaccccagcttccacttgtacagctctaaagagtacagacttgtgctaccacacttggcttttctttcacatgggtgctgccaatcgaacctgggtccttgtggtttcacagcaagccctttactaactgagacatgtctttagcccagcgtttggggacctggaaactaggtctcgattaccaaacaaagtttcgaaagactgatgctgcatgcctgtaatcccagcacttgggaggttgaggcatgggtttgtttcaaagtaaaagggcggggggccactcaagtgctcggcctggccactgtcacatgacacactgactgaggcgtttctatctacaagcactggcagctttgcttcgagatggtgagacactggaggagcttatgaaattgtctccagaagagcttctgctgagatgggccaacttccatctggaaaactcaggctggcaaaagatcaacaacttcagcgctgacatcaaggtaactgtgcaaaaaaccatagcgttcaggtagatacgatggcttcagggattttatcccattgtaacagagacaaaaatgataggatatcaccaggccctgttgtctttcatgttctgagataaggtcttgctcaaatctgctcagtaattaaagatgtgacttgccatactcacattttgtggggtgttcaggattaaatccagagttttctccattcaagtcaagcatagtgcaaatggaagccattgtgatttttttcagatgtgattggactctgtaggccaggttggcctacagctcactctgtcagccaggctggcttcaaaactgcagtgtttctgcctctgcctaaaacctatatacaggcctatgccaaagtacctagtcagtggaaaccgtttattatgaagcctgttttgaatatttttgaaaagcaaagaatccttgcattagttgatcatgggaagccttcacctcaatccccatcactgtgggagaaggggagagagatgagctaatttccttaagtatattctgattttaaaaggttaaatgctctcttgccaaccatatgtgtttctcgtttaagcttttctgtatttcaacttttgatttaacatacaattaacatagtagatgttgtttccataggttgctactcatcatgctttgtaatgccataatgtgttcattttctctttccctatgcttcctggatttctgctcttctatttcatgcttgtttatctgtcaagcttattgacttcagtaattcagtgaaggtacagaaatacttaatagctttattgggttgatggcatcgataaattgtcaagtcctaacaatcacgtgcaaagacaaaaagaaagatctctcaaataagaagacagagaagaatgccttatattatcacaaaagctgctcccaatgtcctcatcaccaagggacaataagatgcagctactctttggcagtgtgatcacactattatgttcaattcttttgtaggattccaaagcctatttccatctgctcaatcaaatcgcaccgaagggacagaaagaaggggagccacggatagatattaacatgtcaggtttcaatgtaagtataggtgctttttcagattctagtcttttaccattgcatgttcccccccacccccctttggattgttgagacaaactcttgttacatagggctctaacctgctatgtaaagcaggcttgtggttaactcgtaggcatccacctgcctctgctttcgctgtattgggtctaaagatatgtgctgccacacccaaataattttgcttaaattctatcaaaatttctgtggaacttcatgtagtggtgttgacacttttcagattgctttagaggacgtggtacacgtgactcacaggagagaaagtatactgatttattttgagaacttgtgagttccataattttgatggtactgtattttatgaatgacataaacattcaaagactatggggaaataagcattactcctggcttgttccccatggtactggtaaagggccagcccatgcattaagagaactacctgggatagtttgttctctctcaaaatataattacagacacagtcagaggtatgtctccaagttcattcgaaatcaagctgatatgctagagcacagtcctctcacccctactcccactggatcccctccccatttcagaggcccctcctcttgtggtttgactgtgatgtgtcccccacaggatcatgtgtttaaacactcgcttcccagcaggtggcgctgttcagggaggtggtggaatctttagatgatgaagccatgctggaggaaatccatcactagaggtgggccttgagtctggccccacttgctttgttggctgtttcctcagtgcagaatcaatatgagcagccagtttcctgatcctgctctcaagccctccatgcctcacgtcacccttcccaggcatgactgcctctagccctctggacctgtgaaccaggtctttcttccttaaaaaaaaagaaagaaaagaaaagaaaagtaaagtaaagaaaagaaatcaagctgaattgatggtcaagatgaaccatcccactaccaggtcctccctgtttgatgtttttctactgtgtccctttgagtcgtcccccacaatccagccaggattcccctactggctttagaatttggtccatcagcttaacatttaaattcctacaaaatattacccacctctgtcagtctgccctccaaaacctcttttcaccttcatatagctgtcttaaacttgtccaaacacccctcccactttacagttattgagacagtttctctgcatagccctggctgtcctgaaactcaatctgtagaccaaattggccttaaactcatagatatctacctgcctccacctgcctctgcctcctgtgtgctgagattaaagacatatgccacaaccacccagcccaaacatcctttttaactccaagcctatgattgcaagttttttcagatatgttctttaagtaaaaaataaagggtctggtgagatggcacagctgttaaaaaaattcttgctgctttagctgagaccaaagtgctgttcccaaactcacaagcagtaactccagatccaggagatccaaatgccctcttctgttcaggcatgtgtgtatgagagatattcaaaaaagaagaagaaaagaaaagcttttttgaaaataaaatatcctgagtgagctaaccaaatcacaaaagaacacacatggtatgcactcactgataagtggatattagcccagaagctcagaatacccaagatacaattcagaaaacacatgaaactcaagaagaaagaagaccaaagtgtggatacttctatccatcttaaaaggggggagcaaaacacccatggaaggagttacaaagtatggagcagagactaaagaaatgaccatccagcgactgccccaattggggacccatcccatatacaaccaccaaacccagacactgttgtggatgacaacaagtgtttgctgagaggagcctgatatatctgtctcttgagaggctctgccagtgcctggaaaatacagaagtggatgctcacagtcatccattagactgagcacaggatccccaatgaaggagctagagaaagggcctaaggagctgaaggggtttgcagccccataggaggaacatcaatatgaaccaaccagtacccccagagctcccagggactaaaccaccaaagagtacacatggcgggactcatggctccagctgcatatgtggcagaggatggcctagtcagacatcaatgggaggagaggcccttggtcctatgaaagctgtatgccccagtgtgggggaaatgtcaaggccaggaagcaggagtgggtgggttggtgagcagggggaggggggaggggatagggggagggtgtttttcataagggaaatcaggaaaggggatacatttgaaatgtaaataaagaaaatatccaattttttaaaaaaacacgcttttttgaaaataaaatatttttctgaaactgtccatatttaaagttaactcttaaaaggaatgtggatgaaaagttgggaaacggcatttttttttccttcttcattttcccaagagaggtaaactcaatggaatactttattcagttcttagatgtactctggcgccatcttggggaacttataggtactacatatccctcatggttttgcattcaaaaccaattttataagtatcatgtgctagaaagtactatcatttacccaacctatgattggattgtaggcgatgtgtgtgtgtgtgtgtgtatacacacatatatatgtatgtatgtatgtgtgtatgtgtatatgtatatatgcacatatatatacatatatatggatggcctttaaaatatgtcttcttttacttcaacaggaaactgatgatttaaagagagccgaaagtatgcttcaacaagcagataaattaggttgcagacagttcgttactccagctgatgttgtcagcggaaaccccaaactgaacttggcctttgtagctaacctcttcaataaatatccagcactaactaaacctgaaaaccaggatattgactggactcttctagaaggtaagtcaaaggtcctctaattctaatgtacagtctgtaccataaaaccccagaggccacaatgacgtcattccaagccagtgagttgctttgtccatttagatgccatgccgagtgagaactggaaacagctgggtggaggtggtgatggaagcaaaatatgcaaataaaacaatctagttgaggaatgtggctcagtgccagagctcttacctagaacagccaccactacaaaagaaaagaaaaaatccagactcacctatcaggagaaacacttagtaaacaaatggcttgcttcaatgtttagtgccatatcttccttttttcttttttgttttgttttgttttaaaccaccttatttattttgagcaaagaatctcttgttctgtttctttgaggttgtttttaaggtagtcgtctattttgggacaagcatttaatgtgtctccagtcgacctcagacttagtacgtagtaaagaatgaccctaagtttctgatgctcctatctctaagtgctgggataacaggcatcatttgtgggtttgagggtgctagggaatgaagccagaacttcctgcactctaggcaaggactcagtaaactgagctacattccccagagccttggaggtcgttgtgagacagggtcttaccctgtagtggatgcttaccctgtagtggtggccctctgtcctcagccaaatgagggctgagattatagatatgagccaccatgtctgaccagatcacagaaaggtatacatacatgcagaatttaacttataaacttttgtaatcatatttcatttatccgtagtcagagtgacatactaacatgtggtgattatcaactcagaataaagcatataaagtaaatcaatacatgccctggtgctatatggacaagacatttaatcaatgaatgcactttgtggatgttttcataggggaaactcgggaagaaagaaccttccgcaactggatgaactctcttggtgttaatccccacgtcaaccatctctatgcgtaagctgccctactgctcttaggaagttgtgaatagcatgaggagatgtagcatcaataatggcaactctaaaatctttccacatgttcatttgtagcagatattcttattatgaagtattcgtgatttccatcatcattttccaaatacacaaaagcccaaattctttctttgtctgactattggctctaagtgatagaaatgtgtcttgagggagtaggtactttaagtttcttaaatagtcctggaatactcataacaaagtgttcatgattccttcagcctttggcttcttggccagactgttctttgctgacatacaatggtttgtatcctaatattccttaccttcactattttcttaccatctaccattcactacctgtgaactctattaatcgcatttacatatatgtcaaaatcatattacttgtttagatacatcgttgtttattatacatctatttgactctcaagtaaggtttggggttttcatcttgtgtttccaacctttataacactttttgcttacaataagtgtgcatccttacaattatcattgttgtcttcgtcgagacagtttctctgtgtagttctggctgtcctggaacttactttgttgaccaggatggcttcaaactcacagagatctgcttgactctgcttccaaagtgctgggattaaaggcctatgccactactgctgccccttcttttttttttttttttaagacaggtcaggaactcactgtgtagccctgactgtcctggaactggctgtatagaccactctgaactcactcacaaaggtcaccctgccaccccctcccaagcctgggactaaaggtgtgtgccaccttgcccagctgtgctcacatactattaagtgagctgaatggtcttggctctattttcagcacaaacatatgagtcgtaggaactgtgactttatagatcttgggtgatttgtgtccctgctcatgatcactgatggagttctgtttcccattgttagtgacctgcaggatgctctggtgatcctacagctgtatgagaggattaaagttcctgtggactggagtaaagttaacaagcctccatacccaaagctgggggccaacatgaagaaggtagagaaccttgaaccttcttcatttctttcttttactttaacacctctagacccggaatagagagatggctcagtgtttaagggcactggctgctcttccaggacacctgagttcaattcccagcaccacatggcagcacacaactgtctgtaactgtagttccaggggatctgaacccttcacaagaacatacatgcaggcaaaacacaaatgcaaatgaaataaaaataaaaatgatagataaatagatagatagatgaaaaacctctagaccctaagctgcttctggaggaaagaactagatcttggcattgagaagatacttaccattatacaacacacacacacacacacacacacacacacacacacatacacggggtggggagagagaatagagattgaacaaatgacaatatttaaccgttactttgcttttgtccatttgcagttagaaaactgcaactatgcagttgaattagggaagaatccagctaaattctccttggttggcattggaggacaagacctgaacgatggcaaccctaccttgaccttggctgtagtctggcagctgatgagaaggtatcgtgcacagtattggctatggaagcgtcagagtaatatgcatataggaattcacccttagtatattttcactgcttaaattaatcatttagttcaatgaatatacttcagagctcattgtacttagactctaaaatgactttgctatgagtgtatgttggagcttcactgggagatacctccttgtgagttaggtagaactgtagctgttgccagtcttggcacaaaagtctgaggtatagacttaaacctgatgcaatgtcactgaataaccttaacagatgttctcatggagttccctgactaaaactgtcagagggtttgcagctccagcccagtcgtctaggatatacttagcatgcatggaggctatcctcagagccccgaaatgaataaagaaatgttgtcagaagcccagaattgtggctcatacttgaaatctcagcaccgaggagtctgaggaggggaattggctagtttgaggccagcttgggctacatagtgaattctaggacatcctgaactataaagttcaaccttgcctcaaaggaacaaaccaagaacattaaattatcagaagtctgaacatctctatgtctccatttggatatgaccatcagggccagcagggttagagctcctgtgcctggcttgatgacctgagttctgttccaggaactcatgtggtgaaggaacaaaaccatgtcctgcaagttgttccctgatttccataggggtaccatgacatacatgtgttctagtacatataaataattacaatttttataattctttaagaaattgaagattcctttacttgatctatttttaataattctttgagaatttcatacagtcagctctaataacttccagtcccacttccagcccctccaaccctgctggattcccccacttctccttccgactttaattccttttgttataacttactgggttatataatgcctcccatatgtacagtgtggaatcttgcatgtggcgcatgggaacctattagaagccacattccataataaaaactgagtctggcacccagtcatatcaattgtcaaaactaggagtgtggcaccatgggtcctttctctatccatgctgtaattctgtgtctttatcttgtatgggtcttgttcaggcaatgacagctgctgtgaattcaatgagggcaaacagacctgtcatgaacctggaggcaggagctgatgcagaggacatgggtggcgggtacaagggtgctgcttactggcttgctcctcattgcttgctcagccttctttcctataaaacctagcactaccatctcaggaatagaagcacccacaaggggctgtaccttctcccttcaataaattaagaaaattactaacagccaggtcttgtggaggcattttctccattaaggctccctcctttgtatgtcaagttgacacaagactagccagcagagagaggggggtgggagaggaagaaggagaggggagagaagagaggatgacctcaggtgtcatgctcaggaacaccatccgcctgctttgagatctgtccactcccctgagataaagatcaagcttttcgcagggacctgggcttagctctttggctaggttggttggccagtgagccccagggatctgctgttttcagctgctcagcactacaattacaatcacatgcccacatgcccggcatttctttatataggtgctcctgtttgaactcaagtcttcatgtttgtgtttgtaacacaagcactttacagactgagctatttccccaattcctccttgatacacacacacacacacacacacaagcatggctctttgcacaaagttacttttattatgtgtgtatatatactaattttgtatataatttctatacatatgcataaactgtatgtgcaagagtgagtaaatagagcaaggctcataccactgcctcagatggatgtcagagtctaagtttggggaatcatttttcaccatccaccctgtaggaatcagattcacgtgcatcaagctgtttttcccacttgcccaccttgctgaccccccatgaaatatttatgataaaaatgtacatgaggtatatttctaatgtttgcatttttcttcatagaatccattgtgactctcttctgctgcttttcttagatatacccttaatgttctggaagatcttggagagggtcagaaagcaaatgatgacatcattgtaaactgggtcaacagaacattgagtgaagctggaaagtcaacttccattcagagttttaaggtcagcatactgattaatatacactgtgtttgctagataatatcagttgttttaaggacaaccttgagtttttttgtaagagttattattgttgagctagtggcaaaatgttcctttccttggtcaggctaacataaagaagcacatgatcgtttgtaaatagtgaaattcttaggcttgttgcctttttcataataggacaagaccatcagctccagtttggcggttgtggatttaattgacgccatccaaccaggctgcattaactatgaccttgtgaagagtgggaatctaacagaagatgacaagcacaataacgccaagtaagggcagccatgtgcaatcgttcggagtcatacaaagaacactggtccggccaggcagatccactctaagtcaagctctccctctttgttagtggtgacatctggggaagatctcttcttttttgaaggctttaacttttactttttgtcttagttagggtttccattggtgagaagaaacaccatgacgaaggcaactcttttttttttttttttttttttttttttttggtttttcgagacagggtttctctgtatagccctgactatcctggaactcactttgtagaccagactggcctcgaactcagaaatccgagtgctgggattaaaggcgtgcgccaccacgcccggctgaaggcaactcttaaaaggacatttaattggggctggcttacaggttcagaggttcagttcattatcatcaaagcaggagcatggcaggcatggagctggaggagatgagagtatacatcttgaaccaaaagcagtcaggagaagactgacatcctctggcagctaggaggaaattctcttctgcaatgggtgtagaaggagacctccaaagcccacccccacagtgacacacttcttctaacaatgccatacctcctaacagttaccactcctatgggtcaagcatattcaaaccacaattttaatggcttaaaggggatccagctcacagatagacaattcactcatttatgtatacaatctaatggttttgaccttgctcacactgctatatgaccaccaacacaatcaattttagaacacagttatcagataaaagagaccctccctgagcacccagcaaacctaggttctagctctatacctgcctgcctttaactattttatctgtctgctctttagtgtcaattatatagccccttcaccaacatctctcccttgtacaccttgaccttactactctcttctctgtcgttttataagaattgctttgtagaggccacatgggataatgaaacacaatgagacctctagtaagaatgtgattctatcatttgtaacaacatgactgaatatgaagatgatgttaaatttcagatacaaaaataccagtatggtgtgatcttagatctgtgagaggagacatcttttgtttggttggttagttggtttggtttcattgtgtttgtttgttttgagacaaggtgactcacaaggattaaagggttcacaagaaataccatttttaacctatattgttattgtttgtggggagggtgttttgtctgcagggatgttggtatacaacttctgtgtgtgcctagtgtttgaataggccagaaaattgtgtcatatcctctgaaactggagttacagattgttgtgagctaccatgtaggcacgtggaattgaacctgagtcctcaggaagagcagccagtgagccatctctctagcacatgagacaaatatctttaaaccacaaattcatcatgaccaaaaaacaaagctaatttttattatcttagaaggttttgaacatgttttaagaatgtgttatctcgagccaggcttggtggcacatgcctttaatcctagcacttgggaggcagaggcaggcggatttctgagtttgaggtcagcctggtctacagagtgagttccaagatacagctacacagaaaaaccctgtctcgaaaaaagaatttgttatctcattacactgcacagagaatttcataatgattatgcagtcaacctgactaattacacacacacacacacacacacacacacctttttgttgtgggggtaggggtaggctgtttgtttgtttgttttttcaagacagagtttctctggctgtcttggatctctctgtagaccaggctggcctcagactcagagatatccctgcctcccacatgctggaattaaaggtgtgtgccacatgccctgactaaaaatttcatttttatataaactcagtgcttcaagcttttcctttcatttcatattgggaagaaatgagtaaataaaatccaaaataataaattgtaaaaaattagtataacttggagctggagaaatgagcacttgttgctcttacagacgacctgggttcaattcccagcacccgcatggtggcacctccacttccaggaaagttaataccctcctctgacctcttcagtcatcaggaacacacacgtggtacacaagcatacatgcaggccgaacactcacacacataaagtaaatctcatggtttgatctagtataagttaaaaatcaattcaaaacaaaaattaagcagaaaataaatgtgaaattattcatttgtactttatgttttctgagacaaagtgtcactgtgtacttctgactgatgtcaaacttaacagggactctttggcctcaccttctgccccaagagcaatatggtcataggattatgagcattgccatcatgctcagctctttgagttagacattcaatacagaaattttacatcccagccttcaggttataaaagaggaagtacatctcttaaatggtgtccttgggctggagagaggactcagtggtaaagagcattggctgttctagaggatgtaggctcgggtcccagaacccacatggcggctcacaactgtccataagttcagttttaggggatccagcaccttaacacagacatacatgaaggcacaacaccaaagcgcataaaagaaaattacttagttcttttttttaagttaggtatttatttcagttacatttccaatgctatcccaaaagtcccccacacactcccccacccactcccccacccacccactcccacttcttggccccggcattcccctgtactgaggcatatagagtttgcacgaccaatgggcctctctttccactgatggcctactaggccatcttctgctacatatgcagctatagatatgattcgcattcttctacattataaccaccagttgtgccagcaccatttgttgaaaatgctgtcttttttccactggatggttttagctcccttgtcaaaaatcaagtgaccataggtgtgtgggttcatttctgggtcttcaattctattcgattggtctacttgtctgtcgctataccagtaccatgcagtttttttcacaattgctctgtagtacagctttaggtcaggcatggtgattccaccagagaactcctaaacctgataaacagcttcaatgaagtagctggatataaaattaactcaaacaagtcaatggcctttctcgacacaaagggcaaacaggttgagaaagaaattagggaaacaacacccttctcaatagtcacaaataatataaaataccttggcgtgactctaactaaggaagtgaaagatctgtatgataagaacttcaagtctctgaagaaagaaaataaagaagatctcagaagatggaaagatctcccatgctcatggattggcaggatcaatatagtaaaaatggctatcttgccaaaagcaatctacagattcaatgcgatccccatcaaaattccaactcaattcttcaacaaattagaaagggcaatctgcaaattcatctggaataacaaaaaacctaggatagcaaaaactcttctcaaggataaaagaacctctagtggaatcaccatgcctgacctaaagctgtactacagagcaattgtgataaaaactgcaaggtactggtatagcgacagacaagtagacgaatggaatagaattgaagacccagaaatgaacccaaacttagttcttttttaaaagagtgcaaatgtgggggctggagagatggctcaggggttaagagcactgattgttcttccttgacatcctgagttcaattcccagcaaccacatggtggctcaaaatcatcagtaatgttatttgatgacctcttctggtgtgtctgaagacagctatagtgtactcatacataaaataaagaaataactctgtttttaaaagagtgcaaaggtgttcttgctaggaaaaaaaaaacaaacatcttgatttttgtttcctccaaaactaggtacgcagtatcgatggctagaagaatcggagccagagtatatgccctccctgaagaccttgtggaagtaaaaccgaagatggtcatgactgtgtttgcctgtttgatgggcagagggatgaagagagtgtaaaacaaccaatctcaatagaaccaaccttactctccggtgcatgattaccaagtcagctagtcccaggtgaagtgctcatggcttcagaagtcttggtcatttaaaggacttttagttttgattagcaaaactaattaatcgtgacagcctttggagaaagcattttagtaaacaagcaactcctctttcccgtagagctgatctgttcagcacacctgaacatgctcacagccaaccttttgcactctcctcctagaatgctgcccttgacattccggcttgctttgtattatctatgtatcttttccctcctgggatatccatctcttgagacttgcctagatgtgtagataggaatattcttagctcatccttttgctttccacattctagcagttctttctggagaatcctgctctgatgctgtgtggagatgagtgttctttgtttactctgtagtgctgaaaatccgctgaagtaactggctgtgcagaatgtactagaagcttttctcattcttttagtcttaaaatcagtatctttttacagtattctttctacatggatattttttgtacatttaagaatattttgattacatccgacacgtctgctgatttgctactttttaaaaaaggggtcttcatgtaagtaaaacatacaaaagcataaattataggtggaagaaagtggaccctaaggttgcatttccccctcacacccaggctcaaaggaaatgaaatattttgtcttcaataagttggtccgatacatgcttgtttgtttggaaatctttatcacaaaactctttttcagtctaaaatgctgttgaacatgacacttttgaagagagggtgggctcagaatttagacgggaatttgataagcaaagaatgctaaaatgtacaatggatttttaattttacacctataacaaggagatgtggtctcagaaatgggaaagtatgtatgtcggacttgatgtactcttgctctgtcaagctctttgctatagttctcaatatcattatgttaatctaaatctgaaaagtgatgtaatctggtagcatcatagtagtccaaataaaggcatttgcataataattattctct

SEQ ID NO: 721 - DNA, 1517 bp, mus musculus; identical to SEQ ID NO: 19

SEQ ID NO: 722 - DNA, 3518 bp, mus musculus
gggatttaaagggcccgctcggccgcgccgccctgggagccactgctggtcccggccttgcggcctgcgggggaggctgccaggaggaggtggcgacagtggcagcggtgcgcgtccccggcccccaggaccacggcttcctttctgccaggtaggtctccagtagtgtgcgcgcggttcccacgttcccatccttaagctggcctgcggggcgcggatctataccccttgtcctgggacctagtccgcatcacctataggactccctccctgctatgttccctgccggcacttccactttcctgcagtccctcgaccagggcaaggctttgttgccggctttttgctgagtagggtgagatgaagctcgcggaagatacatccatacaaggagagatgcacacggcccctaagtgtcacagactccccctttctgcactccacattgagtgactaccttggaaacgaaggagcccacttcttccgccccatttgatatataggtctagaatgcatatcatttttatcatcattgaacaagactgttaacaacattctagatacacaaggtccttcattccctgcgggtcacagggcatccagaacacccgctgatatcacagttggtggctcagcccgatgtacctgatattcatatcctcccccaaagccttccaatagcaccctggggggttggcagccccaagctgaagtcctgagtgctcaaatcccaaccttgattgtggacagcaccacggacatctcactccctctgtgtcctccctttggcagctccatctgtccatccatctgtgtgggtccacaatggccaccttcagccgccaggaatttttccagcagctactgcagggctgtctcctgcctactgtccaacagggccttgaccagatctggctgcttcttaccatctgcttcgcctgccgcctcctttggaggctgggtaagtgcctaccaaactgtgttccaccacaacagattttatcttatctgtgacattcatggatatcaaactacaccttaccccaccacatcttaccatgcaacgtcctgcaatgccaaagcaggtccctacaggtccagccccatcatatcccattaagctaagccccaattccaccacaacacatcctttacatacagccacctcaagccacaccatggcaagccacatcctgttaaaccaagacatgaccttcagcattcctgcactctgagacggtgggatccggaactgtctgtgttccaaggtgttccaatcagatcctggaatgctgctgttacaagtatcctatcccaaagcgtcctagttactaggtatgaagagtctgccaagttgacattttcacatgctggacttccaaaaatgtgacattatgaatgtctataatcaggacattgtgaaatttctggattctttgattctataatgttcctgcagttatagcaaagtcaatatccaaatgggaaagttctgaaatccccaggattcctctaggatacaggcatttgtgaaaatcaaacgttctctaatcaactctttcctcttcatcttaagtgggtgctttctttcccccccccccagctttattattttgggacatgtcaaagctactgaaaagctgaaacaatattaatatacatttacatataaaagccagtcaccctggtttcacagctagccacaatagactgctctgtcttcctgcctgtctatcccgtcctcctctttctgaatcatttcaataacctgatggcatcaggacccctcacctcaagtccttccgcatatggtccttgagaacaatcccaccccatacagaaccctagccgcatccatcatccccacccctgtgacattttaatatggatgcagtcctgtccaacatcaattgataaattttcctttcagggtccctgaaatgtccttggtagatgttgctttttaaacccaggccttgccacacgtgccagctctccagtaccagctttgggtccccttagaccccagcatgttctaggcttttgcccaagtccttcttctcttgccagcctaccaacctcccgcttcttgttttcccaccctgcctctgtctctccctctccctctccccctaagggttaccgtcttacctgaagcatgcaagcaccgtggcaggtggcttcttcagcctctaccacttcttccagctgcacatggtttgggtcgtgctgctgagcctcctgtgctacctcgtgctgttcctctgccgacactcctcccaccgaggcgtcttcctctccgtcaccatcctcatctacctgctcatggggtatgggtgtgcatcctcaccctccccttgttggcagaaggcaggcgggggggggtccccaaggccttgatgaagtggtccaagataggatggcatgagattctaagaaagtgaaggagtcagggaccagagaggatgacgagtgttccagaaggagacctgaaacacgtgtccttccgtgaggctgtacaggataggttgaacatgggctttccctggaggagggggtcctggggattttttttttcttaatgtgttatatgggttaggaaggcagaaccccttcaatacctccgtgcccccggtagtgtccaaagccctaggaggcataggcccaagaccatcaccttttttcctcagtgagatgcacatggtggacaccgtgacatggcacaagatgcgaggtgggtagctctctgccctcccacctgccctcctcacctcctgagagccctcctggaccttccccttcataaaccaaccaccatacagtgcaggcttccctttcccctgacatctttgtctctgtctctttctacctatcactgtgtctcccttctcctctcatctcacacttggtgcgccctatctttcatggtgacatgctttcttatccatacacttgaccatgggccccacacataggggcccagatgatcgtggccatgaaggcggtgtctctgggcttcgacctggaccggggcgaggtgggtgcagtgccctcacctgtggagttcatgggctacctctactttgtgggcaccatcgtctttgggccctggatatccttccacagctacctacaggctgtccaaggccgcccactggtgagcttctgggtggccaggtgggcagggactgtgggagccgccatggggcagtgctcatggatccttgatcccacagagccgccgatggctgaagaaggtggcccggagcctggcgctggccctgctgtgccttgtactgtccacttgtgtgggcccctacctcttcccctacttcatccccctcgacggtgaccgactccttcgcaagtgagcacagccttcaaggccccccgtgtagcagtgagggggttgggtagaaggctgggtcttcccaattctgagcctgtctcttaatgcttctgtctgtcttctgttactacagcaagaaacgcaaagccaggtaaatgagggcaggtgc

SEQ ID NO: 723 - DNA, 15404 bp, mus musculus
tcccggattggcccgccgcgaggcgggcagttggctctaccagtctagtgcgtgagcccagcctgggtaaggcgggagcgagcgaaattcaagcgcggttttaactgggagtctcctttcctgggctctccggattccctggccatggaggcttcccaaggcttagcggaagtggagactttgagcccacaactggccgagagttacctgaggtatgtttgggtctccggacgggtcgaacttgcagtccctggcctggggttgaggtggagtggctcccacctccccctaggatctgctgtggctttgaccagatttctatttcggggagctcgccctgccaagtcactcgtaagtcaaataactcttgagtatgaactctttaagagcctgaattttaattaactgatgaaatctttgagtctttctaactcgccaaccgccagacctgggagaaaagaggaaaaatagtccctaagttgttagcaattgggtagtgaaaatgggatctgaaacagaaatactttatggtgtttgatggatgctgtaaaatgttttatttcccgaccagagtgctgccattaaaagaaagggggtccagttacgaagggaagacatatgcccccaaaggaaccattaagcccagtgaatgaatacgctttcaccagatgcctaggttggaatatttaactattaaaaattgtagtgcagggctggagagatgactcagaggttaagagcactgactgctcttccagaagacccaggttcaattcccagcacccacatagtagctcacaaccattatgtaactccagtcctacaggatcctatgttctggtacctatgtgatgtacatgcgcccccccacccccgccccgcgcgcgcatatgcaaaacacccgtctatgcctatataatttttaaaagactacataaaatattagcaaaggatttgtagacatttctcttaaaaaacacataatggcaaacaggcacatgaaaaggttgctcaaaaccacccctaagtagaggaaaaaagatcacaactataatggggtgtgtgccatcccctcctgagactgaagatacagagggttgtgagccaccatgtgggtgctgggaactgaaccagagtcctctgaaagagcaagcacctagtcctcttaactacagagtcctctctacagtatgtagatttatgttgttaacttgtagggttttttttccttggagacaaggtttctctgtgtggatcaggctggccttgaactcacagagacccacataccactaacttttgctcagtgcttggattaaaggctagcgccatcactgccaggcataggttttgtttttttttgttttttttttttttgaggcaggctgctcttgaactctatccttctctctgagtccacatagtgatggaattacaggtacatagcaccatgttccagtgaatcaacgatcagtcagtggacagagccaccagtactctaagtagagttttccctcgagggacctcctcttagataaaaatggagaaaagaatttcaagacataccagagggaagcaaagttaatgagtctctaaataaacctggagtcttgtaagacagcccatgggcgtatgcttcacaagagagttgactctcgggggtcttcacagtggccaccactataaaaaaagtaagtggctttccaagtttaatatcacaaaggatgtaatttactataaggcttaaagattaaatcactcttaaaatgtaattaaattaaaaaatagacgagctggcttacttgtttttctccaaggatgctcctttacaactgaaattctaaggtggttttcttaggctcattgtttggatttaggatgagaagagtgctcagtcagtgaaactcaagaagttcatgcaacttctggcctgaaataaacagtttgtttgctgtttttttggtctggtttggtttggtttttcgatacagggtttccctgtgtagccctggctgtcctggaactcactctgtagaccaggctggccttgaactcagaaatccacctgcctctgcctcccgagtgctgggattaaaggcgtgcaccaccacgccaggctctgaaggcatttttttttaaagatttatttatcatatgtaagtacactgtagctgtcttcagacacatcagaagaggtctcatgacggatggttgtgagccatcatgtgattgctggggtttgaactcaggacctttagaagagcagttggtgctcttaaccactgagccatctctccagccccggcatttttttttaacagtttttttttttttttttaatctatattagtggtctgtgtgcacggatgcggtgtctgacaaaatagatgactagagagacaaccgtgggtactgggaaccaaactcttatattttggggtgtgagcctagcctttaatgcctgagccatctctccagcccttttgaggttctcttatcctttccctttacaccatttaacacaatagttgtaccatatgccttgctgctaccagttactaccgtccttctggtactgactacctttcagagacatggagagatcctgttgtgtttttttgtttgtttgtttttggctttttttcaagacagtgtttctctttgtagccctggctgtcctggaactcactctgtcgagcaggatggcctcgaactcacagagatctgatagcctctgcctccagattgctatgttttcaccatgacttgattccaccaaaactctggtggagatttaattgcccaagtaataatcttgagaagtaatgggctaggtgtcagactctctgtcctcatcaaggggttagatgagaacacctctcagaagagcatgtttgcttctgtgttagtcactttctgttgctgtagcggaatatgtgggggaaacagcttaagatttatttaggctcgtgatttttgaggttgtggtacatgtttggctggctccattgcttttaggctttctttgggcaaggcaaagcttcatgagggagtagcaaggcagaggaagcaggaagagaggggtaatctgggacaatgtatacccctcctggccacaatggcagtcacatgcttcctccacctgggtctcatcttctaattcccacagcctcccaataccactattagattataacttcaagagattattggtcagtcctttggttaggtcagagctctctagatccagtttgaggctcaaaagccacacctttgaacattacagtgggactaatccttcgatgcaagttttcttcctcttttaatgcattagggttttctttttcatttatttgtgtgcatttgtgcatctgcacacatgaatgtggaagtcagaggacaacttaatgagttgattctctccgtctacacataatctgagttctggaaattgaattcaagctatcagacttggtggtaactgccttcaccctcttaagccatcttgctggcctgaggttttatttgggggggggcggtagttgtgagtgtaatgtatgtgcatgtatatgagcggatctttgtgcaaatgcataaaggccaaagaaggacactgtttatccctgctctgtcattctccattctatttctttgacataagatcgttcagaaatgtatttattttttattttctgtgcattggcgttttgccagcatgtatgtctgggtgagggtttccgatcttagagttacagacagttgtaagctactgggtgctgggatttgaacttgggtcttctagaagaatagtcagtgcttttaactgctgagttatctctccagtccccatagatcatttctgatacaaggtgggtggaggaaattcacatatatgcacatatactttcaagcaatttcagcagtgttttgagacatattttccctttataatagcactggctggctattctggaactcattttgtagaccaggctggcctcaaactcaaaagaaatccatcagtctttgcctcctgagtgctaggattaaagtcatgcaccactaccacctggctatggaaacattccttaaatttccctctttctaggctgggcagtggtgatgcatgcctttaatgccagaactggggggtgggaacagaggcagtcagatctctgtgagtgccaacctggtttacagagttagttccaggacagctagggttacacagagaaaccctgtcttggaaaaagaaaaacaaacaacctttttctactcagactggtggtgtgtgcctttaatccagcaattgggaggcagaggtaggcagatctctgtgagttccagaccagccttggctacatatcgagtttagggctagctagagttacatacgaccttatctcaaaagaaaaaaatcgggctggagagatggctcagtggttaagagcaccgtctgctcttccgaaggttctgagttcaaatcccagcaaccacatggtggctcacaactatccgtaatgagatctgatgctctcttctggtacatctaaaaacagttacagtgtacttagatataataataaataaatcttaaaaaaaaagaaaagaaaaaaaaatcccttctcaggtatgtatacctgacacatacctatgtataggtttgtgtcaagttgccaaccaacacaggctaaaagtcctagctccttggcataaatacttctaatagtctgtgatgatttgtgtgataggtgtgaggagtattaggtatataggtgtgtgggtgcatgtataagcgtgcatgtgcatatatgtatataatcatgtgtaggtcagggatagccttagctgccattcttcaagttctgtctaccttgctttttgtaaaagcatcccacatctgtcattaggctaggctgacagcccagcaagactcagggatcctcctgtctccatcccccaggtttggattacaagtgcatgccacctttgtcactcccacataggtactgagtagcaaactctgctctttatgtttgtgcagtatcttagttagggttttactgctgtgaacagataccatgaccaaggcaactcttttttttttttaagatttatttatttttattatatgtaagtacactgtagctgacttcagacactccagaagagggcgtcagatctcattacagatggttgtgagccaccatgtggttgctgggatttgaactttggacctttggaagagcagtcgggtgctcatacccactgagccatctcaccagcccaccaaggcaactcttataaggacaacatttaattggggttggcttacaggctcagaggttcagtctgttatcatcaaggcaggaacatggcagcatccaggcacacttggtacaggaggagctgagagttctacatcttcatctgaaggctgctagcagagtactggctttcagggagctgggatgagggtcttaaagcccacacccacagtaacatacttcctacaacaaggccacacctcttaatagtgccactccctgggccaaccatattcaaaccatcacatgcagcaagcattgtactggctaaactgtcctttctttgtttgcaacattttattttatatgtgtgtgcttatgtatatgtaccatgtacatgcaggagccttaggagatcagagtcctaccttatacagttttgctttgttttggagacagaacctttctatgtagcccttgctattctggaacctcactgtgtaaactggagttacagacagagctgagcccatgttctctgcaagagtggtctcttgtccactgaggcccctgtaatgagttttttttttttggtttttcgagacagggtttctctgtatagtcttagctgtcctggaactcactgtgtagaccaggctggcctcgaactcagaaatccgcctgtctctgcctcccaagtgctgggattaaaggcgtgcgccaccatgcccggcttgtaatgattttaatatgagttaaatgtactgtgggctgcatagttttctgtcaacttgacacaagctaaagtgatctgagagaagggaacctcaattaagaaagtgcccttctaggcttgcctaaagcctggtcttataaaagcattttagacaaaatgattcctgggggagggcccagcccactgtgggtggtaccatccctgggctggtggtctggatagtatcaaaaagcaatcagagcaagccaatagggcttccatctgtcagaaaggctaagatcaaaatacaactgacaattcatgctggcaaagagagaatgtagaacaaggagaacactcctcttttgctggttgtaatgcaatcttctacagccatcatggaaaacatggcaattccacaggaaacttggaactaacatatctcaggaccctgctctaccattcctgggtatatatccaaaggacactctaccataccacaagcatacttgtttaatttgctgagtattctctgtttagagctggtaccccattttaattggattatttgctttgttgatgtctagtttcttaagttctttatatattttggatattagccctttgtcagatagggaattggtgaaaatattttcccattctctagtctgccattttatcctgttgacagtgtcttttgcttcctcccttcctccatccaaccaggaagtccctcttactcgcccagtgattggctcctttattcattaggggattggttcacaagaagtaagctgagtatgcccattatccacagctcctcctaggagagtggaattaccatcaaaatacaaacaggcctatccacaacctttccccctttctgttttaataaaaaaccaaaacctttctctcaaatataaatagagaacaactattaccattttgtaatttataagatataagatagacctaacacccagtccatcatttgtgtcattaggatagaacactgtcctctatcctaacttaaaggacttagaatttgctatgtaggccaagctggcccgcttctgcctcctaaatgctggaattaaaggtatttactaccatgcttagcaatttttgtcttagtaatatctgagtatctttattgtacaaatatcctgtatattcctgtggcctccgggtgaaagcattaacgtcagccacctggctactttcatggatctatgaatttttgcatctcaataaagagtcagaaaatctgatgttgatgttagaaatctgtgtcttaacaagcccccattccaagaaactctagaaatagaaaattgagaatcattgcccttaatttttttgtggtactagggattgaatctagggctttgtgaatggtaagcaagtgttctactattgagttatatcaccagcctgagaatcaatttttaagccttttgagacaaagatcatgagagcaggctggccttgagctcatgatctttctgcctccactggaattacaggtgtgagacatcacacctagcttgggaaatctttaaaggctgagtgaggtgaagttagcttaataaaagaggagagtgttctagcaagaggacagtggtgtgaacctgtacttagaggtaacagagaagcatactggatgcatggacttagaataatatttgtaaggtagaagggtcaagcgtgatggtggatgcctttgatcccagcactcaggtggcagaatcaggcagatctctgaggccaggccaatctgatctagcctacacagtgaatttctgaatagccagacataccctgtcttcaaaacaaaaatgtgtaaggtaggatgtgactggtaagattagaggggtcatagattgctggctatgttagagaggacttgtaataccagattaagcagcttaagctttgtagactatgggtccaccagagacatttttgagttaacacctttattgaatgcctatgccgggcatttgcctattgatactgtacagttcagtgacattcattatattcacatatttgagaatatggtgtgttcaaataattgtgcacttttcactatagccaatttttggatattttcattacctttcaaagacattattttttaaaaaacctatagtttatttttattttttgtacattagtgttttgtctgcatgtatgtctgtgtgagggtgtcagaagccctggaactgggctataaagggttgtgagctgccatgtgggtgccagaaattgaactcgtgtcctcttaacctctgagccatctttccagccccacaaagaaattcttaactgtttagccatcattccatttggttttggtttccatttccctgataactaacatggagcatctttttatgttcttctctttttaaaaattataaattttagtgcagagtaaatatgcaaatgaatgggattctcagattttgcatatatgtttatagtatatattgatcatgttcaccgtacctttatagagcaggctggcctggaatttagggatccacctgcctctgcctctcctatgctgagattaacagtgtgcatgacactatacccggcctcacccacttttatgccttcctctgttcctttcctttcctcttctctttctcctatcccagtccccaatagatacctcttctttaagcttcaggttggttcaggttggtttgtggctttttctcctcttggggggttgggaagggagatcttgctgcaaataagtggattgggggggggggggcactggtgatatccctatattcaacccttcagaactatagagaaaaatatttcattttttatggtcagataatgctcaattgtgtgttttattattattattttataattcctataaaggtaaggaacttttctatgcctgccctagctctgaaataatggcacagaccaggtatattctaagcttctttgactatagctgagtagggtactcatctattctaacctgactatgctggcctggcctatttcccagccacctgtcctgttacttgcctgagttacttgtctgagtctggtcctgactaggatcagaagtcctgtctttctcctcccccacccagtttttgggtgaatcagctctttattaaccaatcagaggtgatagaaaacaatatatatattgtcctggaactcactctgtagaccaggctagccttgcactcagaaattgacacaatttctgacatattttaacatcattgagacaggagatgttataacaatcatgacagtgccaacatctggactgcgaccagatctctgggcacggaaatcagcatctgaaatatacactgttgtaaaaaaaacatccctcaacaaattcctttttattttttatatgcagtggtgttttgtttgcatgtatgtctatgtgagggcattagaccctttggaactggagttacagacatttgtaagctgccatgtggttgctgggaattgaatcagggtcctctggaagagtagtcagtgctcttaacctctgagccatctctccagcccttcaattgtatagttgtattacatatatgtatatggggagcctggctgattccataacatgggtattatgtatagcgctgtgatgaacatgggtatgggtctctatactaaggtaagtgattttggtgggtaaatgctcagaagtgatataattggattatatagtggttttgttctcattcttgagaatgtcttccatagagacttactaatgtacgttcccaacagtaattgtttacttattgctactgtgtgcgatctgtgtgcaggtgtcagatgatggctttgggatttgcttgacggcattagaaacccaatttagttacagggctggatgagcctcagctggtaaagtggttgcctagccatgcacaaagccctgagttcaatctcagcactacatataaaactgggcatagaagatgcctaaaattcccagcactcatgaggtagaggccagaagatagtttaaagtcaaccttggctatatagtgagtttaagaagaatttcaagggatacttgagagtgccttaaaaaaaaaaagcccaactacagtgtggattccaaaatgaactgtaaagctttcataggttaactattcagtctgtttcctctcttgagaattggcttcagaggctccttcatgccaagcaaatattctaccacttgagcttatttccaagtcccatgtcacattattttttttattttttcttttttaaaatagatatgtgcaagaagccaaagaagcagctaagaatggagatctggaagaatcattgaaacttttcaatttggcaaaggacatttttcccaccaaaaaggtgatgagcagaatccagaaactccaggaagctttggagcagttggcagaagaagaagatgatgatgaatttatagatgtgtgcagctctggcttgctgctttaccgagagctgtatgagaaactctttgagcaccagaaagaaggcatcgcttttctctatagcctgtataaggatggaagaaaagggggcatcttagcagatgatatgggactggggaagactgttcagatcattgctttcctgtcaggtatgtttgatgcttcacttgtgaatcatgtgctattgatcatgccaaccaatctcattaatacatgggtcaacgaatttgccaagtggactccaggaatgagagtgaaaacctttcatggctccagcaagagtgaacgcactagaagcctgacacggattcaacaaaggaacggcgttgtgatcactacctaccaaatgttactcaataattggcagcaacttgcaagctttaatggacaagcatttgtatgggactacgtcatccttgatgaagcccataagatcaaaagcgcctctaccaagtcagcagtgtgtgcacgtgctattcctgcaagtaatcgcctcctcctcacaggtacaccagtccagaataacctgcaagaactctggtccctgtttgattttgcttgccaaggctccttgttaggaacattaaaaacttttaaaatggagtatgagcatccgattattagagcaagagagaaggatgccacccctggggaaaaagccttgggacttaagatatctgaaaatttaatggaaatcataaaaccctattttctaaggaggaccaaagaagaagtgcagacgaaaaaggcagacaatccagaggccagacttggtgaaaagaatccagctggtgaagccatttgtgacatgttttcccttgccaggaaaaatgatttaattgtttggatacgccttctgcctttacaagaggaaatttataggaagtttgtgtctttagatcacatcaaggagttgttaatggagacacgctcacctctagctgagctgggtgtcttaaagaagctctgtgaccaccctaggctgctgtctgcacgagcttgccgtttgctgaatctaggaactgccacattctctgctcaggatgaaaacgagcaagaagatgtctcaaatatgaacagcattgatcacttacctgacaaaaccctgatacaagagtctggaaaaatgatattcttaatgtccctgctagaaagacttcaagatgaaggacatcaaactctggtgttttctcagtcgataaaaattctcaacatcatcgagcgtctcttaaagaacaagcactttaagacattgcgaattgatggcacagttactcatctttgggaacgagaaaaaagaattcagttattccagcaaaataaagaatactcagtttttctacttaccactcaagtaggtggtgttggcctaacattaactgcagcgactagagttgtcatttttgaccctagctggaaccctgcaactgatgctcaggctgtggatagagtttaccgaattggccaaaaagagaatgttgtggtttatcgactaatcacttgtggaactgtagaagaaaagatatatagaagacaggttttcaaggactccttgatcagacaaactactggtgagaagaagaacccattccgctatttcaccaaacaagagttaaaagagctcttcacagttggggacctgcagaagtctgcgacccagatgcagcttcagtgtctacatgctgctcagcggagatctgatgagaaactagatgagcatattgcctacctccacttgctgggcatagcaggaatctcagaccatgatttgatgttcacccgtgatctgtctgttaaagaagagcttgacatgctagaagactctcagtacattcatcagagagttcaaaaagctcaattccttgttgaatctgagtctcaaaatacagtgcaaagacaaacgactggaattgaggagacctggctcaaagcacaggaatttccttctcaacagaagaagaaaggtactgaattcaacaaacctcagccccagccttcacgccttctgactaaacctacccaggtagaggctatcagttctcaaatggccagtataaccatttgcgatcagtctgcagagagtgagccccaagagcactctgaggtacatgatgtcacttcactgcaaggtagtcaccacttcaacagtacatctgatgctggcactatagcttctttaccccagggggctgaaagtataggcgaagtttctactgactctttattgagccctgcaaaaggttttgcagctgaaaatgatgctatgcagaagaagggattacaagcatcacctgggcaagaggccccatcagagaacctgggaagttttcattatttacctagagaatccagcaaggccagtcttgggccaaatttagatctacaggatagtgtggttttatatcaccgcagtcccacagcaaatgaaaaccaaaacctagaatcagatgtacccatgattgaaatatctgatgacttgtctgaacctcctagcgcactgcagggtgctcaagcaatcgaggcccagttggagttgaaagaggatgaccctttaaaatcaccaccacaatatgcatgtgatttcaatcttttcctggaagactctgcagacactagacaaaacctctccagcaagtttttggaacatgttgagaaagaaaaaagcttgcaaagccctgcagctaactccagggcaaagtcagcacttactctcagtttggattcttctcctaagagtgatgaagaatcagaagtgattagtgtgaaaaccaaaagcaaaactagaaggatcctctcagatgatgaagatgaagatgaagaagatgcttttaaaggtagtcatacaaattcaattaacatctctccctttccattctcatctgtgaaacaatttgatgcttcaactccccaaagtggcagcaatccatctcgaaggttcttttcacctaaaacaccaggtgaagtgaatacgtccttacattctaggaggtccctggcttctaggaggtctctgatcaatgtggttttagatgatgtggaagatatggaggaaaggcttgataacagcagcgaggaggagagtgagccagggctttcagaagagaacaatgaagaagaagccttagcctgcacagaagagcagccttctggggcaacactggcttcaggaaacaagtccagcaacttgaccatgtctgagcctacttctccagccccacaaagctctccctgtgctcctgaaccttcgtcaagtgaccctatgcctgatcctccccaggatctggcagtggaggctggtaatgactatgagagtcttgtagctcgtgggaaagaactgaaagagtgcgggaagatacaggaggctctcaactgcttagttaaagcacttgatataaaaagtgcagatcctgaggtcatgctcatgactttaagtttgtataagcagctgaacatttgagaactttatagcctatttcttatgtctaaaatgcaattgaatataaatgttttgttcagcagttcttcccttgaatatttcattttttcccctttaggcatactttgcaaactttcagaagtgttacctaaagttttgtgaagctgttctggctatttttactgtgaaaagggccattttgtctgttagctcagttctgaaaattaaagtgccttttctccagagtgtttccattcattttctttcacaaggtggtagacagaaactctttagttccaataagctcgtcatttagcattccaaatctaagatagccttaataatgtgccgtttgtgcttccagcttagctgcatacagtacctgtactagcattcttgggcacttgtagcctgccctggagttgctctaccaactggttagctattcttcacttactctggactatgcttttcttcaacccagttatgtggtgtgtgtgtgtgtgtggggggggtgttcttcagttttttgagacaaagttttacatagctctggctggcctggaactcagggagatagctccacctgcctctgcctccctggagctgggattaaggatgtataacactatgtcccacttatactggtgtttggatgctatcacatcctctcttttgattgttgactacataagaatccgattcaccttcagaaacaccaagtgcagcatatgctgtcaccaaagatttagtgtttacaatgtgcctactggatattgagtatatcacacaggcctcttgtttaatccttaccataacctttgaggtggagggtggtgtttttgtgtttgaactgaaacatctaagactcactgtgacctgcccatgatgaatgacatagtaaggcataaaactgacttaactttgtactgaatgaaaagcaactttgtaacactgagttcattttactttcatcaccatgacacccagtgtggtggtggaagtccataccagaacacttctctggacaccaaccagtgacctgcaattcagtttggacacaacccagagttagtgggagactacaagttttaggcctcagttccacaaagtctgcctttatagggtagtgttaaaagaatattctcccagtgtgtgtggggagccgccctcacattcgccattgcaagatggcgctgacatcctatgttctaagtggtaaacaaataatctgcgcatgtgccaagggtagttctccaccccatgtgctctgccttccccgtgacgacaactcggccgatgggctgcagccaatcagggagtgacacgtcctaggcggaggataattctccttaaaagggacggggtttcaccattctctctcttgctctcttgtgctctggctcctaaagatgtaagcaatagagctcttgctctcttgctctctggctcctgaagatgtaagcaataaagcttttgccgca

SEQ ID NO: 724 - DNA, 15404 bp, mus musculus; identical to SEQ ID NO: 723

SEQ ID NO: 725 - DNA, 130282 bp, mus musculus
cacgctcgccaagggaggcggcacccggggcgctgacccgctgctgtcgccggccttcagtctcagggccgccccggtctccttcagtcaagcggaggatgccggtgcgccacccggggaccacgggagactgagtggagacggggtctttgccggccgaagcctagaccgcgggaggctgagccgcggcctgaagtggactctgaggccgccggaaccaggtgacgcgcgggaaccattggccacacgagcaagggagcgtttagaaggtttccgtaggcctggcgtccgagcttcccgtgtgtgcagtgggggattagggacgtggcaccatgaggagccgcagtaactcgggagtccgcctggacggctatgctcggctggtgcatcagaccatcctgtgccatcaggtaagtgtaggtaagggtgaagtgtgagctccggacactgactctgggtgaaccctgaacgcatttgtctctggagagaccttaaaggatcccgaaggaaagttgcatgttgaacttggagtaaaatcaaagtgtggcatggagaatcacaatcccccaccctcgacccctctgcagtgattccagagtgatggtttctgagctcagacagaatgccaccccttcccccaactccccaccctcccaactatggcaggattccagggacagagtttcaagaaataacacttttttattgccctcaccccaggtttgggccatctacttccactccacttccccaaagatgtatgagaacatagagcatcctaagagaccttagactactgtgaaggtcaaggcactttgtacatacttttaaacagttttgcacagtggctcaggctggccttgaacttgggattttcctgccatagccttcacagtttggacaacagaccacaagccagtgggtttttttgtttgtttcctaagccgttgttgttttatttcttcctttgttgagaggattttaccttgtagcccatgctgacctcaaactccccatcctcgagcttcatctccccattgctggggtaacaggtatgcgccactgcacctggtttatatgtgctctttggagttgttggtttttgaaaccaagtctgtctttgtagcccacgatggcctgaaactcactatgtagctggcctcgaaggagcgtcagtctggagaattataggctataaggcactgcacctggctgtatatatttctagatttctttcctactcctttacttcagacttttcgttgctagttgaatttaacttttatatttatttttcttttaaaatgcacttagtggcatccttagtactacatttgataatacccctaataatgcctttattttaataatacctgtgttttggacttgtaagctttcagccagctctttccttattcttaagatagtgcatggaaatagaagaaactttctcatctcatataaatatgttctgcaatgctgattagcagcagtagcagcacactgactagtccatactactttattatatatatatatatagttgaaacttgctgagagaggagatccctcctatcaaaaagtgaggtaatagatgtattaacttgattgtcatttcacagtacattcatgtatgtatcaaatcgtcatgttgtatacagtaaatatgtacagcttttattgtcagttataactcagtaaagctgggggatagtatctacctgcaactggttaaaagagaagaaaggtcgaaaatttgagaatggggaagtaggagaaagactaaagtttctaagtaaaatattccctagattttgttccctttaacattctgaggttagttgcctgtcctctctctctcttaattgatcttgcagaatccagtgacaggcttgcttccagccagctatgatcaaaaagatgcctgggtccgagataatgtgtacagtatcctggctgtgtggggtttgggcctggcatatcgcaaaaatgctgaccgtgatgaggacaaggcaaaggcctatgaactggagcaggtaatcaaaacaaaactatacagagatgtggggctctgtgtgggtgtaatgggggagcaggaattgaaggaaaaatagcccttgtgccaccttgctcaaattgcattctataaggttttcctactattgtatctgcagtgggtttggtttggtctgatgtggtctgctctggtttggttattgtggtggaaacttgaaaactataattcagggaagagggctcagactatttattactttacttttgaaaatcctacttggatatatttcccaagattaataattctctaagtgtattttcaggttctaccattttattttcattgcaaggaatatttgggagcaaatgtgtattattttatttctctctctctctctctctctctctctctctctctctctctctctctctctctccctccctccctccctccctccccaaagtgtactattttatctcccccctctctcttttgaaaataattgtggtatctgtatgagtggacctgacagatcaacaggttttcttcattagacaaaaataatgacttcgttgatctttataactatgaccacaattttagagagcctgttgcctggggtcaaattgaggtcagagtcagcagatgactttaagccaacttttaaggcaccttcccctcaataaattagtatcctttctagaacttctgaacagaaaggaactacttcatcttaagtgtttaaaaaggcaatcatttggcatcatttgaattacacaagacctttaatgataaagtactatgctagttgtaagtatacgtagatcttttcccattagtgagaaggagccttaccacagcagctgtttctcctatcgtcttccttgaacttaagaaatctgagctccacttctgatttacaaatcaggttattgggatctggttatttttaaaagcagcaacatattcagaagttgttcttgggagtgggacaagtctcactgtattatcttcagcatcagtagccatttggaattccttcaagccattactgagagatacaaaagagtttttgctctagtgaagcaagtacagacttttatagaaataatgccataatagaaatttggaagacatagagtgtatttttttttaagaaaacctctctagtccgatatcctatcctgaatgttttgctgttttgatctcagttgtttgttccttgttttgatttgctatacattaatatcagaataacttcagttatgtgcctgatataatttgatcaaaaattttcagtattataagaataaatctgttgttccatcattcattggaattacttggaaagcttttcatcgatatcctaactggatagacctcactttaaaacagtttaagtaagaatttaaaaattatatccatgagcactggtctttttcaaattacctaggtgattctgataatgtgctgagataataaccgatgtaaaactagtaagtgaacatagattaagtccaatacatccacagattaaatttctacctgctgccaacttgccattactgtgtggatttcccccaaagcattgttagtcatttatataccctttcttccaactctcgtttttgcttctctttcataaaatcagaaaaccaataagaatagcagatggaaataagaaatgggtttaactaacttccttaatctatattgtaaatagaattatacacaaatatatatttacagattccctcctttcttgatcacatagataaaaaacaagtctcagggctggagagatggctcagtggttaagagcactgactgctcttccagaggtcctgagttcaaatcccagcaaccacatggtagctcacaaccatccgtaatgagatctgatgtcctcttctggttcatctgaagacagctacagtgtacttatttataataataaataaaagaatatttaggccagagcaagcagggccaactggagcaagtggggtcgaccggagtgagtggggttgactggaacgagcagaggtcctaaaaaaattcaattcccagcaatcacatgaaggctcatagccatctgttcagctacagtgtacacatatacataaaataaataaatctttaaaaaatgtcttatagctataaaaataaacactcaggcagatcaccatctctttggctgcccccacttctggttcttagtttcttctctttgtattgtctctcatctgtttctcatgggttttccattacctttttaggaatgatttccagctctcttcctttagctctgacctcagttgagatccaaatgccagtttttatgtctcttcttactagttttccctgtgtgtcctgtggttctttaaactctgtgtgcctgagagcccacctttccaagtaaaacacaatacaacactgtacgaaacagtagtaacttgccactgtgtttctcttaacagtgttcttaatttacagtcgccctcacagtattacttggaaaattttctcatagtatggtctgtggaacacaaagatgacttaagatcttctagactgtaaaacagaaagatttgtagagaattggggaagctgttccatgctgtgatgttctaaaacatactccctactcatgccaggtgtgcatgagatgtacacatatacatataatcaaaacactcatacagatggaatgaaaaaatgagtctttaaaaataaaatgagattttaactaagaagatgccatcaaggctagagggcatatactggcggagccttagagcccggggagtgagctaacttgcgccttttctctaggtggattctcaactattagatggttggctcatttttaggtaaaagtgccttagagtttttatattagtacttaaattcaagggatcataaagcatggcttttgatttaacttttagctgcagtctgttttgtgtgcctataaagtaaatgccatgcaagtagagcccaggatagggttactagttctcaaaggtcatgtactgaccgaagctgctgaataagtgttcttgtatctcggtatgtttataaccgtctggtttccatttatttttgcagagtgtagtgaagttaatgaggggactgctgcactgcatgatcagacaggtatggcactggtaacaacttctgataaaacataacatcttaatgatgcttataaccttttattcagattcacaaattgtagtctctaattttagaaggttcagaactctgggatgggcatggtacacagaccctgttacaactagaattatttcctttcagtctttttcctccccttatgaatgatttttctcaaaaagaatcattatcctatttgcagttatgcgcactagataaagcatgatacaggttttttttttttaatcttatctgaaacttttaggcccacatcccttctaaaactaatacattttcagatttttaaaaagataagcacactgcacgttatataatttctcatgtcttcagtagatagagaaaatactctaaggagctgaagtggtttgcaactccataagaagaacaacaataccaaccaaccagaccccctccccagatctccaagggactaaaccaccaaccaaatagggagccttggctccagctgcatatgtagtagaggatggccttgacatgcatcaatgggaggagaggcccttggtcctgtggaggctcaatgcactagtgtagggggatgccagggcagtgaggtgggagttggtgggtggttgggggagcaccttcatagaagcaaggggggatgaaatagggggtttctggaggggaaactgggaacatttgaaatgtaaataaataaaatatccaattaaaaaataaataaataaagctgtgtaccaccacacaaaaaaagaaaatactctgaaattaaaaaaaaaaaaaactctctctaggaaaacattccttacacactaaatgggataaggcctataaagaaccagatgttgatttgaatttagtgtttacacctaatttagtgtttgaagtttgaattttgagttttgatacaaaatttacgtggaaaaaatcattcaaagtattctcaattttaagattggggcaaaggaatcttgaacttcaaataattggtcttccctggccttgtgtgtagctaaacatccttttatatgtgaattgaaaatttgcagttccttactggtgaattacctgctagagctttgcctctttgtaggttgtctgtttcttgcttattgacttcttgtgtattatggatgttaatcatttgtacattgcaaatatgtttatagtctaccatttacattttgagtttatggcatttttccacacaaaagtattttactaagaaacctatattctgagatcttaaaacatattgaacctgagttaattagagcaaagtagaaaggaacagatctcaacttctaaacttcatgatttttaaatgaatatgaagttatttattgtatgtatctctttactagtctcacatatatcactttgtgtctttatactttatttatattttagatagttatgctttgtcctgttaaatagatatagtcacaaatttcatgaaccatatttaagattatcatacatcagagacataaataatcatatctacatatcaggaactaggttagaaactagttgcctgttatctaaggtctggatttctgctctgtgtgtgtgtgtgtgtgtgtgtgtgtgtgtgtgtgtgtgtgtgtgttagggattggacccagggccttatgcatcctcagattacagtaccgctgaggtatatccccagctcccaatgagcctcttctaattagttttctataataccagttttgtgactctatatggctctcattaactctttttatggcatcttcaaaatttatcctcttggggttagagagatggcttaatggttaagagcacatattgctcttgcagaagacctgagtttggttcctaatactcacttttgttgggtggcttacaactcttataacttcagctccaaagagtcgaatgccctcttctggcctctgggggtacccacacccacaaacaactatgcacaggtacattaataaaaataccctcatctgtcaatttatctgcacattcctactttaaattcaagaacaaatgtatagcactgcattttctcactaaactgttcttatacatttgagcgtccagtttctctacaatatgacaaagtaaccatttgaaaagcatagaaaagaggaaatgaacaagaaataggtgggtttttaaaaactatttcttattttttattaaaaatgctagatttccccagtgtagaaaaaaagcaggtaatagtatatttcccatattcacaatttcctgaaggcagagtatggtgatgtgtatgtcagagccctacagatagatgcatagcatataggttgatttatctgactggccattttatactgtttccttgtcaggtggataaagtagagtccttcaagtacagtcagagtactaaagatagcctccatgccaagtacaacaccaaaacttgtgccactgtggtgggtgatgaccagtggggacacctgcagttggatgctacttctgtgtacctgctcttcctagcacaaatgactgcctcaggtcagtacaagaagagaataactgcatgcttgtaagtttggatcatctctggttcatctactttctctgtagggattgactagaaaataaagtatctgtttagggtactcaatgaagcaaattgcaaataacaatagtttgtaagtttgctatagctagataactttttttgaggtataggcaatatcttattttattgagaagcaaatttgcagttctaattaatactcttttgaaatgggaacccagaaaagtgggctagatctttagctaggttttttattattatttattaattctcagatgccaggagatgggaaggaagggcaaaggtttgttttttttttaattttcatattctacaccagtatgcctttggtcactgtggctacagaaccacccagtttatatattctttattagtatgatctgaatctaaatgtgtatgtttcattattaagcagtattctatttaagtagttttgtgataatagttagatgcctgatatgtaaaagaaaattaaaaaaaatatagtagctcacatctctctgtatcctagcacttgggaggcagatataggccagccctagtttacatactaacttctaggtcattcaaaactacataaagtgatgctttatagatgtaaaattggaggtgaaaacaattctattatatggagttcctaaacttaataagaacatttccagatcattcagagtaagttaatgtatttacaatactatgttttctgtggtgttggggtttcaaagaagggaatcatgcatgccaaacaagcactctaccactaagctaaaatcttttttttaatttctttcttttttttttcctttttttaaaattaggtattttcctcatttacatttcccaatgctatccccaaagtcccccatacccacccccccactcctctacccacgaagctaaaatcttaaccctttacattttttttgagagaggatctcactaaattgtccaggccagagagttccttgatattaaaggaaacaaatctctctctctctctctctctctctctctctctctctctctctctctgcctctctgcaaataaatgtttggtaataaactccttaacttttttctttttacaccctagagtttgaataagctttctttgaaattatgagttgatcatccaattaatctccttttggaggagaaatttcttccacaacaaatttaattttgttttatttctttaagtagaatggtagttataatttcactttgaataatatttttatttcaactctgaaagctgtttaccatttttaatttttaaatttaaaaaaattggggtgggtggtattttgagacagggtttctctgtgtagctctggttgccttggaactcactctgtagaccaggctggcttcaaactcggagatctccctgcctctgcctcccgagtactggggattagaggcatgtggcaccactgcctggctcccttgggtattcgatggctagtgtttttaagctcccaagtattctgacctgatagagttgtaaagtaagtatgacgttgccaccttcacctagctttttattttctctctttaaagcaggcactgactaaatatccctgatggtttttaaatatgattccccaaaatggaagcaaagatagattaaaacatttcatgaggacttctatagcatgctaaatattttagaattatattctgcaaccagtagagatgtttgatgtggataatcaagggatggttcattctagtagcaggaagataggttgcatgagatagattagataaagaacaaaattaaggtagaagactagtaaagaagtcagtgaaatactttagcaataaataatacaaattttgtataatgcatttggattgaagttaaaaagcaacattgtggtgaaaagaatataataaaagatcttcatagagaactagcaatagcttgaatgttcttgaatacttagttattgcccgagcttttgttccaccggcaagaacacgctcagaacaaccggaatcttctgcggcaaaagctttattgcttacttcttcaggaggaagagagaaaatggcaaaaccccgtcccttttaaggagacttatcctccgcctaggacgtgtcgctccctgattggctgcagcccattggccgagttgtcgtcacagggaaggcagagcacatggagtgaaaaactacccctggcacatgcgcagattatttgtttactacttagaacacaggatgtcagcgccatcttgtaatggcgaatgtgagggcagctccccacacttagtgaagatagatttaggcagaaattgaatgaaatttatagaatagtagcatgaagagctccagcaaaacagccaaagatgctggaaatttaagaacaaaccaatactttgaaattgtccattggatattgttcaaaaggatttgcagtaagtagagaagcactcaaaaaacccctaattattaagaacatcaagggactgaggtatctggcctcagcttaacctcctatcccaactcaggataatagaagcactattccaggctgtatagacagaacacaggcttcctctctcctaagctctagtttagtggttctcaaccttcctttaacttctttttttttaagattcattcattcattcattcattatatataagtacactgtagctgtcttcagacacaccagaagagggcatcagatcttgttacagatgtttgtgagccaccatgtggttgctgggatttgaactcaggacctttggaagagcagtcagtgctcataaccactgagccatctctccagccctggttctcaaccttcctaatgcttgagatcctttaatacagttccttatgtgggagtgactcacaaccataaactagtttttatggctacttcattttgcgactgttattaatcataatgtaaacatctgtgtttttaaatggcctttgggagtcatgatccccatgttgagaatcaccatgttgagtttaaggttcctgaatgtccctcagaaaacaagctggcatcatttattacccttccaagctctgtattgcaagccctagtccaggcaagtacagctttaggatcccccatatccccagacacttaggaaataggatctcccttagatagagcagagtgagaccactatgtcatctacttcttgactgaggcaaacatcctacactggaatatgcaagctgggaagatcagaagctaccactctgtccagagcttagtgtctaaaacaggaatgccattccaaaagaaatggtctgcagcactggcatgaatattctcatggaaggtagcaacacactgtaaaaacaaagctccttaactcttctgaagaaaattgcctttacaaatgaagtgtgagaaaattagataattacttagtaattatgatgtagggctggagaggtggctactcttctagaggatctgggcttgattctcaacatctacgtgatggctcacaaccgtttgtaactctagttccagggggattccatgtcccttctggcctctgcaggcattgcacgtacatggtacacagatatcatacaggaaaaacacccacacacatcaaaggtggtcttagtaaaaacacatctaaataattaagatgaagttaattgttcagtaacagcaagaaactaagaaaaagattagctagaaatttttaaaaatccaaagaaagctaaggagtccttttaagtgtaagaacaagtatcaaagacttgactcaaagattgtaccagaaaggacctgagtctaattgtttaaaacgatagagaaatttatttttgaggattcgacaaaatcattaaacaatcagttgaaaccaggggttgggccttagcttcataccagcagagacagccatctactagatcttggaaagaattttttgtttgtttgctttttaggtgaaggatgtccttttttctttttctttttattgaatattttatttatttacatttcaaatgctatcccctttcctgattcccctcccctgaggaaccccctatcccatccaccctccacctgtttctatgagtgtgctcccccactcacatccttgccaacatgtgttgtcacttgatcttagccatttttttgatagaacatgattttaatattttcaactgttaatattcaacaaacagaataattgttttaagatatagtttgttgttatgtctcccttttcatttctgattttattaatttggatactgtctttgtgccctctggttagtctgaaaagggtttatctatcttgattttctcaaagaaccagctcctcctggttttgttgattctttgtgtagttctttttgtttccacttggttgatttcagccctaagtttgattatttcctgccgcctactactcttgggtgaatttgcttccttttgttttagagcttttaggtgtgctgtcagattgctagtgtatgctctctccagtttctttttggaggcactcagagctatgagttttcctcttaccactgctttcattgtgtcccatgagttttgttatgatgtatcttcattttcattaaattctaaaaagtctttaatttctttatttcttccttgaccaagttatcattgagtagaacattgttcagctttcacatgtatgtgtgctttccattgtttttgttggtatttaagaccagccgtagtctgagctgatctgatagggtgcatgggattatttcagttttcttgtatctgttgaggcctgttttgtgaccagttatatggtgaactttggagaaggtactgtgaggggctgagaagaaggtatattcttttgctttaggatgaaatgttctataaatatctgttagatacatttggcttataacttctgttagtttcactgtgtctctgtttagtttctgttcccatgatctgtccattggtgagtaggatgttgaagtctcccactcttattgagtggggtgcaatgtgtgctttgagctttagtaaagtttcttttatgaatgtgggtgcccttgcatttggaacatagatattcagaattgagagttcctcttggaggattttacctttgatgagtatgaagtgcccctccttgtcttttttgagaactttaggttgagagttgattttattcgatattagaatggctactccagcttgtttcttgggaccatttgcttggaaaattgttttccagcctttcactctaaagtagtgtctgtctttgcccctgaggtgggtttcctatatgcaccaaaatgttaggttctgtttacgtaaccagtcagttagtctctgcctttttattgggtaattgagtccattgattaagagatattaaggaaaagtaattgtttcttcctgttatttttgttgttagagttggaattctgttcatgtggctatcttctttaggtttgttgaaagattactttcttgctttttctcgagtttattttccctctttgtgttggtgttttccatctactatcctttgtagggatggatttgtggaaagataatgtgtagatttggttttgtcatggaatatcttggtttctccatttatggtaattgagattttgctcggtatagtagcctgggctggcattgttgttctcttagggtctgtgtgacatctgtccaggatcttctagctttcatagactgtggtgagaagtctggtgtaattctgataggcctgcctttatatgttacttgacttttgccctcactgcctttaatattctttatttactgcatttggtgttttgattattatgtgatgagaggaatttcttttctggtccagtctatttggagttctgtaggcttcttttatgttcatgggcatctgtttctttaggttagggaagttttcttctataattttgttgaagatattagctggccctttaagttgggaatcttcactcttttctatacctattatccttaggtttggtcttctcattgtgtcctggatttcctggatgtttttggttagaagtttttgcattttgcattctgcattttttgtctgttgtgtcaatgttttctatggtatcctctgcaccttagattctctcttccatctcttgtattctgttggtgatgtttgcatctatgactcctgatctctttcctaggttttctatctccagggttgtctccctttgtgatttccttattgtgtttgttttgagttttagatcctggatgattttgttcatttccttcacctgtttgattgtgttttcctgtaattctttaagggacttttgtgtttcctctttaagggcttttagctgtttacctgtgttctcctgtatttctttaagggagttatttatgacctccttaaagtcctctatcaccatcatgggagtagttttagatccgaatcttgtttttccagtgtggtggtgtatccaggacttgctgtggtgggagaattaggttctgatgatatcaggtaatcctggtctctgctgcttgtgttcgtacacttgcctcctgccatctgattatctctagtgctacctgccctccgtatatctgacaggagcctgttcttcctgtgatcctggttgtgtcagagctcctcagagttcagctgtctctgtgatcctgttattatgggattctgtgatcctgagatcctgggtgtgtcagagctcctgggactcaagctgcctctgagaccttgggatcctggtgtgagcaagctcctgggatcctgttatcctgtggtcttgggtgcgttagagcgcttgggaatggatcttcctctgggtgttgtgggaatggctctcatcctatgatcctgtgtagggctgtgggtgtgtcggaagaggggagttggagagagtgcctgcatcccgcccgagttctggtgttctgggcaggcagatgagcacatgctttctatgcagccccgggtgggcatctggctgtttgaagccactgaccccacaaggcaggggttggacaaggggcagcccccggtaccagattctcagcctccagcatcccaagctggatactgccgagaagctgagaacagaataggggccctggggtggcacttggccccagagatacggggagagagggcagggggaaagaggggtgctgggtggtttccacgcaggtgagagtccttcagagacagtctatagttttagagctttattatagaaaggcagggagaaagagaaaaggtagaaggagagagggagaggccagccatggccacgaggagagaagggggaagagagagagagagagagagagagagagagagagagagagagagagaaggctagagagtaagagaggtaaaagcttagagagtaagaaagcttagagagtgaggaggggccaagcagcccctcttatagtgggctttgttatcttgctgttgctaggtagctgtggaggagtctagccagaaggccattgggacattgtctacctgactaatagccacatgcctctcctgtgggggctataggggcggtaacttcgacaggagccaggggtccaggagacatgagggaacgcctaccatcccatgtaggtggaaattaccacacatagggtaccgctggggttcaatggagaccaggctgtctgtcctataatcctgggattgttagagtgtctggatgtagatcttcctctgggtgttgtgggactggctctgatcctgggtgtgttagagtgcctggggtggatcttcctctgggtgttgtgggatttgtggtggagtttgcacccaatgtctgacaggaaggagcacatgctactgaatgggcagaattcctagttgcctgggtcctgctggtctcagttatttccagtgttggggcagatgtgtctttctcacctctgatcctatgatcctgggagtgttagagcgcctgggagtagagcttcctccagtgttgtgggactggctgtggagtttgcacccaaggtctgctcagggcagtggcccagacagaaaagaggaaagaaattgttaacgagctccaataacatcatcttagagtgacagttcatgttcctaagactgtgtcttctgatggctaccagaggctgcatgttatgggggaatagattgtactgaattagttcagttaaacctctaaataaatagaaacagtctccagagaatagtctcggatcttgcattctcacaacatactaacatataatactacccagttttcaacctaaaaatttagatgcaaaggaacaagaaaatagaaatatatagtggtacacacctatatcctagcactcaggaggcagagaaaggaggattatgagtttgatgctacctgggatatatatcatggccctgtcaaagaaagtggggagaggaaaagagagaaaaggttgaaaagagtggaagagggagggtagaagggaggacaggcgtgggggcacacacctgtaatcccagtgcttgagaggtagacacaagaggattgggaatccaaagccggggttggttacatagtgagtttaaagccatctttggatacacgagactcttctcataaaacagaaacaatataaataaataacagcaaagggaagcaggagtgaatgttctcttggatatgatgccaaatgtataaacagctaaagaagaaaatcgtaattgcaatttaccaaaattaacatcaaggacccatctaagaaagtaaaaaagaatctgtgtatagtatgatgtctgcttgtaatccgagcacttgggaggtgagggtgggatccagagttgaagttcatcttcagctaatagcaaatttgatgctaacctatgagaccctatttatttatttatttatttatttatttatttatttatttatggaagcaatggtaattcaatctctgggtgcaacaactaaaacccaattgtgtaagcctttaatctgactcctccagtggcgaatcctgatggattcaccatgataccaggaaactctagcagctacatcttgcccttatgctattcctgttccaaaaagctgagaacccattaaaaaaaaacacccagcctttctcagtgtgtgtgtgtgtatgtatgatatatgtatgtatgtatgtatgtgtattgtgtgtagtgtgtatgtatgtaaaatcaacctatatagaaggaaatatttgcaatcatatataagctatttatattgagtagaaagaattctcacaactcattgtttagaaaatatcagaataactaagtcagatatgttggggtggtatatgcttttaaacctaatagaaggcaaaggtgtgaggatctcaaatttaaggtcatcctatgatgacactgtctcagagagagagagagagagagagagagagagagagagagagagagagagagagagagagggagggagggagagagagagagggagagagagagagagaaatagcctcctttaaaatggctagagtgggctagagagatgggctgctcttctagaggacgtgggttcaattcatggcacccacatgacaggtcagaactatctgtaactccagttccaggcaatatgatgtcttcttctggactaaacagacagagcatgcatgaagcacacagacatatatgtaggcaaaaacactcatacaccaaaaagctcaatttattttataaaaagtggctagaggatatgaactggattttcctctatggagtttgtagaaataaccattaagtacattacaaaatgctgtgcatcatcagtcactagaggaatactgacctgaataactgtaatgaccacttcagccacaacagaatggcaggaatcaagatgacagattaaaaggtgttgctgaagatattgagaagttggaacctttgttcactactctgggaaatgtaaaataagagcaaaggatatgtctcagcaggtataagtacttgctactaagtctgacaacctgaatgcaatacctggatccatatggtggagggagagaaccaactacccttagttgtcctgacttccttgtgtaccatggcatgcacacacataaataaatagataaataactaagtaaagaaatttaagttttaatgtaaaataatacaatcactttgaagagcagtctagcaatgcctcagaggcttaaatatagagttaccatatgatccagcagtttctctcctaagcgtgtgtgtatgcatatatgtgtatgtatgaatatgtatatatatgtatgtatgaaaaatatgtccacatacacaaaaagtatatatgaatatttatagcagcattatttacgatagctacaaagtagaaacaacaacaaggtctatcacctgatgattggataatttaaatatggtgcgttcacacaattaatattttttggcaataaaagaagtactaatgcatcccacaacacaaagggagcttcaaaatattgtgttcagtaaacaaacactgataacataatatacttctcagtttatatgaacgcccaatgagtaaagaattccttcttgtgatgatgaatatgtcccagaattgatgtaatagatatatactgtaatacaataacaaccattatattatatgaattacacgataagttatatgaaaggtctatctcagtttataaaaatacatgtgctggtcaggtcagtaaaggcaattgaagtgaagttgattgaagcagagttcactgagtcatttccattttggggcaggaggctgaagtgataaccaactaactgtctttttccctcaggactccatatcatccacagcctagacgaagtcaattttatacagaacctcgtgttttacattgaagctgcatataaaactgctgtaagtacttactttagaatgaacttaaacatagaatgtttttgtttccaaaacaccaaacaactcacttctccttataatgaacgaatcaaaaaggctcatgacaaaaccattttcagtttctttactaagaccttcattcccctgtttgccctgtcgtcaatgtgttacagagataaatgctgtggtttcagttccttcaaatcttattcttcatagtatgtgcttggcaatggaactaatttgtagtcattttattatattactattttcatttaatatattttattagagcatctctaggctaggctcatcctgaactcaatacatgaaggtgatcttaagcttctgattcttccgtctctacctcccgagtgtgttggagttataggcataagctaccatgatcagttttatgtggtgataggatttgagccctagcaagcactcaaccaactgagatctgtccccagcctctactagtcttattttaactgaaacctttaaaagaagcatgataactgagtaatgttatgggccatttggctgtacacaaataaaatttattcatgtttttgttgttgatctagtgtacaaaaagtttttccccttatgaactaccatatgaagtaggttcatattaaatgtcatcaataatattttctctgtataaaatgttgcattggacactacagaaatgcatttttcctttagtctaatatgaagggttttgttgctgttgttcattgacactttccttataatctcccaatcttcaaatcatccaaatgcccaggaacaaatacaagggataaacaaattgcagtgttcatgaaaggtcattttgttcaacaagaaaaaaaatgaactgtgagccatgcaaaaacgtgaataaatctaaaatgcataatggttagtagaagaaatttcatagaaaatgtacacaagcccgggcatggtggtgtgtaagcctttaatctcagcatttgggagaggcagagacaggtggatctctgtgaatttgaggctagcctagtctgaatagcaaggcccaagccagccagaactacatagtaagagcctctctttaaatgtgtgtgtgtacatgtgtgcatacatgcttgtatgtgtattatatatatatatgtgtatgtattatacacatacatacaagataattacactaacaaaattctagacatctgtaatgacagtaagcagatttgtgattgctttataacaggggcagaggaagaaatggattttggaagccaggaagagactttggaagtttttgaacctatcttttattgtgacaatagattcacatatataaatataattaattaatcacagtggtaccagctagtttgttcagtggttaaaggtgttctctgccaagactgatgttctgagcaagatctctctcttcctctctctgtctctctgtctgtctctgtctctgtctctgtttctctctctcacacacaactgtactaaacattttaaaagaggaatcatatagtttaactatattccggtttaactacaccattatacatcaataaagatataaaactactgttgtggaatggatgaatacaatcactctaagattggacaaatactacacttgtctctgattgtgcttttagtatgtgtccattgttactgactaacccccttgtatttaacatacctcttttcttttattttttgtggtgctaggattaaacaaaagtccttacacatgattggcagatactctgaaaccgaactctatctccactcagaattctttttcactttcaagtgtcatattattttaaaagatactactttaaaatgcatttatcacttttgataatgttcatttctccatgcatatgtatatgtaactttacccatttcttttttgatggacatacagtctgcttctgtaacttaacttttgtaaatagtgctatagtaaatgtgggtatgtacgtaatatgtgtgtggtatgctggctgattagattccattggctctatttctggaagtggtatagctggatcagatggcagatctatttttagtttttaaaggcactcccatactgattttcatagtgctggactaatttacatgcccaacagcagtgtgtaacattttcttacatttgttgttagttatttttctgatgatagatattctgaatggggtgagatgaaatctcaatgtaggttaggtttggtttggtttggcttggtttggtttggttttttgagacagggtttctctggatagccctggctgtcctagaatttgctctgcagaccaggatgacctagaacttaaagatccatctgcctctgactcccaagtactggggttataggcatactgcaccactgcctgcatgtggattcagaggtctgcttacttctttcccgtgagtgctgggattaaaagtgtgtgccattacacccgcctaaatccatagtcaaggttgagattgaagcatcttgtagtactaaacactccagaagtattcagggaggaacagggaatgtcaaaagtacactagaaaatgtcagaaccaagaggcacaggagcctaccagtggctagacctggaacaattaacaatgtaggcagcaaaataatgatagcattccataataaaccagcaaacatacacacaccaataaataaacaactgaaaaagaaaaaaaacaaggaataatggactgccttccttggagaaggattataattaatgaccatagaggtagcaaggaaaatagattaaaattatcatcaaaactatacttattgtaagcaattaaggcagaatgctgaattggtggatggttgtttaaggagaagcaaactatttacatgatcatcttgtttttctgagatagagtctcatctcaggtttgcaacaaggagcaaccccacctagtgatatatttatataatattgaacaatctctcaaagtatttactaattaaaaagagaaaagtaaaatggaaaatgccaatgcgaaccaaactgtttagctttcagtagtttttacttaggatcaaggtcacaaaggataagatttgagaaagcactattgattggaagtcactaaggagacatggcagggatgaaattgaatcttggaatatataaaaagcaccagtcaggcatggttgtgtacacttacaattccagctcttggaaagtatgggcatgaagtccatagttaactcagttgcttagttgagttgagtccttagctttagcagttgtcctgtggttatggtcaatgttaacattaggcaaaactaagtcataggtgttagggattcattgtactatttttgcaattttgtgtaattctgaagttttttttaaaaaaataaaaagtattaaaattaattttaaatattttatattgcctagggaatgtttatagctatggctaggagtaggttttggtgtgaaattccttagaatgtactctggattctgtcacttaccaagtatacaaccgtgggttagttacttactgtcattcttgtaatttagtttcatcatctgtaaaatgtaaagattaagggtagagagatggcttggttaagagcacttccagagaacccaggttcaattcccagcacccacacagcagctcacaactctttgtaactcctgttccaggcattctgacacctttttcagatatacatgcaggcatagcatcaatatacatagaataaaaataaaaagcatatttttaaaaagtaagcattaaggtagataatgcatgtattgtaaattttaagaaccaagagattaagataagaatgtaagtttcacataaaaataccaactgttgcttagcctctatgtgttagacttcatgggaatctcctttagggaaaacttgagaagtgtttctagatgatctgattaagtgttgaagagactcacaactttttagaggccccaatttaacttaggtcatcatctgctccttaatagcctatacagaggctattaagtgagtgagtatatgagagtgtatgtaaaaatttgctgctattaatatttttattaaaggattatacatctaatgaatgtttagtggttataatttgattgtaatgagttatatcttgattattttttgctaggactttgggatatgggaacgtggcgataagacaaaccaaggcatctcggaattgaatgcgagttcagttggaatggccaaggtacattttctttcttatttttaccaagtcttgtcaatggagtttagtttatctttgtgatagataaaatcttaatgtacatgttgacccatcaaattgttctttaaaccacaaacaaaatttagattcctccatgaaactatgaatatataatttgaaactttttataagtttcaaatttgaatcatatggcttttaaggcatgtctctgcttatatttcctattagaataacaaattttaaactgtactcaccatttttgccattgcataaactaagggaagctctttcccttccaacagtccagtcacccaagctcagtatcagatagccacctcacggtcctccatcctctgtactctcctcaatctcccatatcaccagcacctttccacttggccatatttctagaaagagtaagaatgtataaaataggatagcaggagaaagttcaaacattattatgttaaatgtacatggatcagccacttgtactaaacaggaaaatgcagatttttttaaaagaagtatacttcttatatcataatgatactgaaagtttaaaaccaagttaggagaagtaaaatatagagactaaaaagaaatgaaataacgattcaaggcaaaaaatattacatggaataaagtggacaagagggttatgatagaattttgacataacctataatgagacaatatggtctggaatgtagttccaattaatacagaacacaatatatttgaaatacaagacagatgtagttgcataaagaaataacttgctggacagtggtggcacacgcctttaatcccagcacttgggaggcagaggcaggcagatttctgagttcaaggccagcctggtctatagagtgagttccaggacagccagggctaaaccctgtctcgaaaaaaaaaaagaaagaaagaaagaaaagaaagaaaaggaagaaaaggaagaaaaggaagaaaaggaagaaaggaagaaaggaagaaagaaagaaagaaagaaagaaagaaagaaagaaagaaagaaaaaataatttaacagcaagactgtgatacatgtagaaaaccccaaacaaatcatagaaaagttctatacaagttttccactgctgagttctatctattgctccttccttttttattttgaaataattttaaactaaagaaaacaatttaagaatgttagggggaaaattccatacatcattcatgcaaggtttattgatatttgctttatctttccgtctactgtgttagacattcatacacatgcatgcttgtgcacaaacacacactttttcctgaactagttgaaaatacacaaactatggacatgatgaagtactactacaactcaacatttcattgtgcacttcctcaaagactgttgtaaccatggtatgattatcaaaaccaggaactaagtgattacacataccacaggacctattcagttttttaaaattatcccaataatgttaatataggcttttgtaatagaatctgatgatttttttttgcatttcctcagattctgttgttatgtctcccttttcatttctgattttttaaattaggatgctgtccctataccctctagtgagtctggctaagggtttatctatcttgttgattttctcaaagaaccagctcctcgtttggttaattctttgaatatttcttgtttccacttggttgatttcacccctgagtttgattatttcctgctgtctactcctcttggatgaatttgcttccttttgttctagagcttttaggtgtgttgtcaagctgctaatgtgtgctctctctagtttctttttggaggcactcagagctatgagttttcctcttagaaatgctttcattgtgtcccataagtttgggtacgttgtggcttcattttcattaaactctaaaaatctttaatttctttctttattttttccttgaccaaggtataattgagtatagtgttgttcagattccatgtgtatttgggctttctattatttatgttgttattgaaaatcagccttagtctgtggtgatctgataggatgcatgagataatttcaatatttttgtatctgtagaggcctgtttttttaatattcactttctcttattgtggtactggtaactgaattcaggatcttgtgcgtgctagacaggtactttaccacagagttataccctcagcccaacacacctaccattttaaaacaacaggatgctatgaagtacacaataacatcgctattttttttaagatttattttttattagatgttttcttcatttacatttcaaatgctatcccctttcctagtttgaccaattatacggtcaattttggagaaggtaccatgaggtgctaagaagaagcacttcttgttttggataaaatgttctatagagatctgtacaatctatttaggtcataacttctgttagtttcactgtgtctctgtttagtttctgtttccaggatctgtccattgctgaaagtggggtggtaaagtctctcactattgttgtgtgaggtgcaatgtgtgctttgagttttagcaaagtttctctaatgaatgcggatgcccttgcatttggagcatagatgaattgagagttcatcttggtagattttacctttgatgccacactttggttttccttcttgagtttcatgtggtttgtgtttcatgtggtttgtgaattgtatcttgggtattccgagcttctaggctaatatccacttatcagtgagtgtatatctttctaaatcttggaaggtaagagttcacctgaatagcggcctctttttgtcagttgagtccacaaatacactgaaatctcacatggctggttggctttatctcttgccactactatgccccgttcttcttccctgagtcacggggattctcttccattcctcttttcattctagcctgcacaactctaagtgtccaccccatgtccagccattggctgttagcatctttattgatggatcacaaaccaatttgggacaagaaccttcagtgtttggctggacacgcagattccagattgaatcaaagccttagaaccagtctccaacaggtatccctcattggattgaagaaatttctttctattgttgatttttaaaatttgtaaacatgtattgaattttatccagggttgacagcaagctgtaaaatccttgctttttttcttgtgacggttatctagtcttggagcatacctgttccatgtgtgtcctcatggtgaatcttcctggtccttctctgcttcctcctttctgcttctctccttttgtttgggaccaagataccttatattaagaagaatattgtcatatactgagagtgatgcattatattgatataatatgcataaaaagcaatctagcattgtatctcaataatcgttcacatactttaagccacagattatctactttaagaaagtaatgcttgggagaactggccatttctctcgccagccacaacactcaggagagggggcctgcaccttgcctgagcagcagagtagaactggccctggttgctggggctgcctgtgatctggcctgagggcatgagagcagcttgactggatagtgatacaaactccattttaattttccctgggcactgtgggaggcaaagtgcaaatcccaagctcctaggaataaggaatgttattttattttctatttcattaaatatattcaaaagcaacatcatgtaacatttataagatactaagaagaaaatatgtataatatatctcattcttgattttctttcttttttttttcagttctgggatttgaaccctgggccttgcatatactaagcatgtgttctgccactgaagtcctctcttccattgcttcttacaggcagccctggaagcactagatgaattagacttgtttggtgtgaaaggtgggccacaatcagttatccatgtcctggctgatgaagtccaacactgccaggtaaagaaagaatggaccatatcatagcaagtcttattcttgctcagagtcagacttagcatgagatttagcttaaagagagcaacccatcttgtgactattaccatgtgatcagaaatgtctttatcaagcattctatagtgagataaacctgatatagcatgagctataatatagattatggatatcttagttagggttttactgctgtgaacagacaccacgaccaaggcaactctgataaaggacaacatttaattggggctggcttacagttcagaggtttagtccattatcatggtggaaagcatggtagtgtccaggcaggcatcgtgcttgagaggtaggtgagagttctatatctggtaaaacttcattcttagttttgtttataattgctccctatattgaaagtttcttttctctggtatatgaagtttctccctttcttcaaaccctgattatgtcctatgatatcccagtgaatataaattaaacttctaattttgaaaatagtttttgtggataaagtatgtcatggaagaagcagggagagcttttgtggctaggaaggaggctagtgggactgctgcgggggcagggagaattctagagaggaaatatgtgcaaagtgcaatgagacgtggctgcaaatagaaagaagcctagtattccccatacttgatgaaaattaatttgaaaacatctcagaagcatagcgatccttctctagtctgcccaactgctgtattttgtcttagttttattattttaaaatttttataatttttgtgtatggaatttttccctgaatgtatacctgcaccatattcattcatggtgctcatgaggccataaagagatgttggcattatggatggttgttagctacccaatcctctagaagaatagacagtgctcttaaccactgattatgtttctagcatctctctccctctctctctctcttttttttaacctagatgctagcaaccaacagaactgtgtgcatcccacagatgttagagtctttatctatgaacagcagctctgcaatcaggatggggaaacactgaaacaggattaagaaaagagatgctataccaagcaaactacttgtttaagagtctggctatttaatagagtttggcttattctttccgatatcttttgtttccacatcaatcatttggaaccaaagtttcactttaaaaccaaggtatttagtaacaaaccctattttgctacttttctcttagtctatcctgaattcactactgcccagggcttcaacatccaaagaagttgatgccagtctgctctcagtggtctctttcccagcctttgctgtagaggacagccatttggtggagctcaccaaacaggagatcatcaccaagcttcaggtatggccatgtgtgactttcttctctttagggctgtgacttgaaagggagattctaggggccatgagtgtaaacttatgccaggaacctcccctcttcctaggttacactctcataagtattttttttgtttgtttgtttgtttttacaaattgtcaaaagcttctgcagtcgttacaattgtaagtggtatatccacttaggaaaacagttggtatattcttaggaatttaaacatatatgtaacatgtgatccaacaaacatcctatctatgtactgaggttatccagatcttgatttttaaataatagtcttgataaatggttgatttgaggatcaaactagggatgatacaaaggatcctgaagcatctgaaaattttagaaggtaaaaacttcaaaaggatttgggtgtggctaggcttggtgggacaagcctttaatcccagcatctgagaggcagcatctgttaattcaacagcagcctgcagagtgagttcctggacagccaggacaacacagagagtcagaccaaccccaaaagaagacacttaatgtcaaatttcttcttgctgtagaagtcaattaacacagagactcataactggacaatgtgtagagagtgagagcctttgtattgctcagccctaaataggatggttttgtcaaagccctaagcacatgacccaggaacctatgtggaagaggacatagaaagagtttaggagccagagatgatgagtgactcaaagaaaacagtgacatctagacatgataggactgatagacacatgagctcacagaaactgtgacagcacacacaagacctgcacaggttcaaaccagacaaaatcctagcatggagaagggaaactagacacaaaattcacatccttcatagttacagtttctattgctgtgacaaataccatgcacaaaaagcaagttggggagaaaaatgtttatttggcttacacttccaaagctgtgttcttcattgaagtaagccaggacatgaattcaagcagggcaggaatccggaggcaggagctgatgcagaggacatagaggagtactgcttgctggactgatttgcatggctttctcagcttgctttcttatagaacccaggaccactagctcagtgatggccccacccacatgggctggtccctctcttatagatcactaattgagaaaatgccttacagctggatctcatggaggcatttcctcaatggctccttcctttcttatgactctagcttgtgtcaagttgacacacaaaaccagccagcacactgttgttaaacaagaagctatttgcagctggtatctgctaggaaaggaacaatcaattttctccaatggcgtgacaggggatatcttcatcacactccaaggcaggtcccatacccagtgttggggtttgggaattgacacttaaactaaataaacattgatctcagttaagtaagaatagtttattgaacacacaccataaaactggactttcaggacctcagaaggactcaggggcctaattgtagtattagtctgctcttcagggtagactttttataggaaaaactaggttaaaagttcaaaaggcaaggaggggagcagttggcttcttagacaaaatatcatcagctaacctttaatctgattgctcctgagtaagggaagggtggtggtggatgggtggtgaacaagggaatcagagcattagtattgtaatcataactttttggcttatgagtaacattcttcagtgtcagccagaaaaaaaaccccacagtgatacataggtgtaggaagtgctgccggtggccagctctgacttaagatagtttagatatcgagttcatattgaccttcaatttgataggtcctatgtaaaactttgtggaatttcttaagattagcaaaccacatacagaacatacagaatagacagggtatgtgctcagcatgtccttgagccaagtcacttctgtgttactaacctgtaggcatgttaaagcaacaagatgaaatagctagcaggtatggagcaaatggctacagatattctggggggagggaggtcagaccataacaccaggacaacacaaaatggagttttgggggggtttagtacttattattttattgctttttaaaattttattttgatgttcttttttgtttatttttctttcttagagagacaacataaagttgggtgggtaatgaggaggtagagaggatctgggaggagttggtggacagcaaagaaaatgatcaaaatatactatattgaaaaaaatgcacctgaaaaactgcaagagccagaggaacagggagttagctctaagattctgttttctaggaatatcagaagctgcacttataaattcttaccaacatgtctgcttaaacatgacccaaacccggggaaagcctacaaggcctctaagtcacacaaagaactacaagaaactaaggaatgggaaaaacagaagatgtcttccctaaggaagagcaaaccagtaccaagtgctcagccctgaaaacactcatatacaccatagagactgagcaggttgaatttatagatttaagaatacatgtttgtgtgtgcttgtgtataatatgtatgtaagtaacaatgattaatgaaaaaagagaccatgaatttgaaagagatcaaggaggagtgtatggaagagtttggaacaggaaggggtatatttatattactatctaaagaaaagaaattattttaaaaataaagtaccaaaagatatttgtaaacattaattatcaaagtattaaaacacattattaaatcaaataaagagcagtctttacccaatttgggggaatgataaaatgaaatgaaaagatgtgtaactttacttttttcaaaccttacttttaatgatggttcctaaatgctttaacctcccttgtagcccaccatacaccagagggaatgggaaaaaaaggatacaggggaagtggaagggacctatcatgccccctgaaagacccagcaagcagctgaaagagtcagatgcagatatctgcacccaaccaatggacagaagcagctgacccctgttgttgaattagggaaggctgaaagaaactgaggagaagggcaatcctgtaggaggaccagcagtctcaattaatctggacccccgagatctctcaaacactagatcaccaaacagacagcatacaccagctgatatgaggcccccaaaacacatacagtagaggacttctgggtctctgttcattcagagatgatgcacctaaccctcaagagactggaggccccaggaagtttagatggcaggtggggtggagagtggggacatccacatagagacagggggtggggaggaggtatggggtgtggaacagtcagagggtagatgggtggcaataaaatgtgaagtgtaaaagataaattaatttaaaaaaaataagaaattaaaaaaaaagaaaggttctttgaagcaactccagtctgtgttgtctggaaatcagcagttcatttcacaggttagcgggcaacttgatctgcttgtaaacacttcatggctacaccagcagtccagttcactagagttgggttaacaaacaggaatcagcagtggtagcataacctagcagagatagccaggcctcagcctcagcacaagtcagcaggagggaccgggagggacagcaggagaagttctccttgtgcctctctcagaagagagatcagtgaagactcgaaacccagaagcattgtacagaaacactgctctataagcaagccaagctcagcctctattactctgtagagacccatttataccctccaaatagcacgtgccttcaatcagtgagtccacagaagtggcaagaaactgccccacaccaacagatgttttttggtgcatttctctctatggagttctgacagatgcagctcaactatgcagcagatggcagaccaatacatgcatgtctttaacaaagaattcttcatcacatgtcctttcatatacttgccttagcagaacatcctctctcctgtgtctgcttcagggaaatgtccttcaggagtctggcttagcctttcacaactgtgtcctctttagcaaagtgttccttcccgtgtttgcccatccaaccaactttccaaagaacccttctgtttccacttcatagattaattactgataagtatgagaagaaaagaaagtaagtagaagacagaaagaagtcattctggaatagagtggcccttctgacttacactgtgacttatacataacttagaattgctgcaaaaatgagacaaacttttaggaaagagaaaggaatttccaaacagctttagtagctttgccacaacaatcctctgccaaatcacagcccaaacaagaaattctatttccttttggtgctctctcctttaccagcaaatattgcattgtttatgtgaaaacaagcaggcacacccattcgatcagttataaacagtcaaatgtagaataaaattctttgtttttatcattaaatactaaacagaaaaaagggatagttaaagtcgaggagccacagaaaccaactggaaaggaaccctgatgcacagagtgaagacaattaaaaaaaaccacttataactcaagtcttgtaactcaaagaagaaatgaagttacctctgagtctatacagagaacaataaatatagttacaagagtgaaagttatagtgaagaaatctaggatctgccacattaaacaaatgattaggtttaatatcaccattaataggacaagtgccctgtcaaacatcaactagattcagctagacttgccaggaacccccaggaatcctcccattcctgtctctccagcattggaatgataagaactgccaccacacctggctttccacctgggtgctggagatctgaacttaggttcttacatttgcacagcaaacacattacccactgggacatctcttgagtcctgtagtgtggggctttaaattggatcctagaacagaataataaaggacagtggtgggaaacccagtgaaagctaaataggctttataatttaattaatattagtatattgtaactatacttttggctactttattgggttcttattcctattcctctttccatcccaatcccttccaaaccccaacactaggtaggtgagaaagaaggttagagggaaaggggctgtagatctctttagactacttcctgccggttaggagttcctaggggcaagtcaaatttcctttgtcaggatatccaactagcaatccagcaaaacagcaaaagaggcagaggcagatggagcagcaggagcagcagcctctgagggctctgccatttttaatactctcttaggagctgcattactatggagtagactgtgcagtaattagcttgttgcaggtttggcctgaggtggacagccatggaaaagatactgctggcaatgctgctttgaagaagaacctataacaacacatttcttgcttgaaagggtattgctggtgctgctgagctgtctttgaatactatgcatttgtgagatgttgatacataaagatgttcgagaatatttcttcttaattatagagtcacacagatgtacaagattcagggcctttttctctgtccccagggtcgttatggttgctgtcgttttctgcgagatggatataaaactcctaaagaggtatgtttcttttcaccacagggaaatagggtggaattgttcttactctttgtagctttattcagagataacagttacgtcattgatggaatttttgcagatcattaaaaaataataagtgatgtttgctgtatttgttgggctttgctgccaagttctaacattgatggtaaataaactaacagtaaaatgtcaaaaaaataaatataaaaaggaaaggcattcttttctttcagctggttagtgtaaacacaagttttaaacacaaacagtgtttacataatctccaacccccactccaatatttaatcaatacaaatggaaaggcatcttttcatcagtacatctttttaactacctgtcatagtccattttctgttatcagtgacaaagtaccaaaaactgagtatagctcagtgctttgagggtcgcaattctattggcacaaaatgaaggggtccacatctgatgattgccttcttactgacagagtcccaagtgtggttcaagtaccttatggcaaaagataggaatcactagtgcgcctcttctggtctctctcctgacaaaaccagggatttagtctccactctaatggcctcattgaatcctgaatgctgctttggggaagaacctataacacacttcttgcttgagtgaatattgctgctactgctgagctgtttttgagtactatgtctgtgttggtgagagattgatagatgtggatgtctgaggatttggttctgcttaattacagattagtttatcaatggacctcattatccccaaactagtagttagaagttgcttcatagagcacttgccaggggaggggagtatgagtatgtacttactgcctttcctgatgctgtctttgaaacaaataggctgctgtaaaactcctattataatacctctaaactaaggatatacgtctaatctctgagtgacaggacagcctttgtctattatatttttattcaggatcccaatcgcctatactatgaaccagctgagctgaagctatttgaaaacattgagtgcgaatggccattgttctggacatactttatccttgatgggatcttcagtggcaacgtagaacaggtaatgatctgggagaagagctcttagcaagctgctcttgtattgtcttttgactaatggctgtatgtttttactgactaagtgggagtcttcctatgagggaagagatggagttgtctcctagatacttatagctgatagtagtgaattaagagttgggagactcagattgttcttttcttcaatcctgaccattgagtaatccaagtatagtcattaagttcttcagtttcagtgtctctgtaggtgaggaaacattttatttttcattaaagattatcaagtaaggatgttaaaataggtacaccaatgtaactataagctgatgtcgtctggaaacttaactctttcttactgttttgtactaataagtgctggtttcttattttgtaatgcttactatttgtgctttaataagcactggcttcttactatttgtgttttaataagtgccggtttcttactctgtaacttactatttgtgctttcataagtgttggtttcttactctacctctgttgcttaaggacctctctctggccaggcaagaggcttcgattcatttaactcttcatgaaccaggaagaaaagaaagaaaatcttttacataggcaatatgcacagatacacatgcactcatacacacacaaattttggtcgggcccaaccacatgtcccatcagcttcataagtattcatacatacacacatacctacacatatatgtaaataaatatatataggcaaacagatatatgtacatttgaatggatggggcagagcccaccaagctaccaccttatttcttctctctggcctatttatatctttttagacaaaagttctttagaaaattacctcatagataaaatgttacaaaaaagaggagttacagaaggacattgaaagtcagtacaaaggagtgttttcaatctctatcgtttgtttgtttgtttgttttttggttttttgagacagggtttctctgtatagccctggctgtcctggaactcactctgtagaccaggctggcctcgaactcaaagatccacctgcctctgcctcccaagtgctgggattaaaggcatgcaccaccaccgccaggctttttttattttatttattttttatttttttaaatctctatcattataagttccaagcaacagtttcacatggtctcactttatcatagtatacacctgtggcttcatctttcaatctgacctagaatgaatgtttttctttggttacaaatttgtcccaagcccatttctctctttagtgtacttgtgaaagctcattgtattctttattatgtatcctttacttactattttatgaggagtgggtattttttattcttaattctaactttattatatctttttggcaaagcaattaaaataatctcttaaacctttcttcctaaaattattttaatcaaattagaaattctataaaagcattaattcgtctagaaagcattaattcatgaaactttatttttatgttgatatgcaggaaatctgctcaataggtggaattctaggaatccttaggctatgtaataatgacaggagaggcatatcagtagcaagaagcaatcctggaatgaagtctccaacgaccctgctcactcattcttaaagctcacccatcataggccatacagaaatgtgagccaccttcaggaaactcacctgctagccttaacctatcctcaatggatccggacaggagaaaaagaaggttggagaagaaagagaacatatatctctttagactacttcctgctgattagggatattaacttcattaggacaagtcaaatctttgtagtcaggatatctccaacttgttccggtctctctgctgtttttaattaggtattttcttcatttacatttccaatgctatcccaaaagtccccccataccttcccccccccactacccttccccctactcccacttcttgaccctggcgttcccctgtactgaggcatataaagtttgcaagaccaatgggcctctctttccaatgatggacgactaggccatcttctgatacatatgcagctagagatacaagctctgggggagtactgtttggttcatattgttgttccacctataaggttgcagacccctttagctccttgggtgctttctctagctcctccattgggggacctgtgttccatccaatagctgactgtgagcatccaattctgtatttgccaggcactggcatagcctcacaagaggcagctatatctgggtcctttcagcaaaatcttgctagtgtatacaatggtgtcagcgtttggaggctgattatggggtggatccctggatatggcagtctttacgtggtccatcctttcatctcagctccaaactttgtctttgtaactccttccatgggtgttttgttctcaattctaagaaggggcaaagtgtccacaatttggtcttcgttcttcttgagtttcatgtgttttgcagattgtatcttgtatcttgagtattccaagtttatgggctaatatccacttatcagtgagtacatatcatgtgagttcttttataattgggttacctcactcaggatgatgccctccaggtcgggtccaacagagtggttgtaaaagcttgcaatcccaccaacaatggaggagtgttcctctttctccacatccttgccagcatctgctgtcaccatttgcctaggaatttcataaattcattcattttaatagctgagtagtactccattgtgtaaatgtaccacatttctgtatccattcctctgttgaggggcatctgggttctttccagcttctggctattaaataaggctgctatgaacatagtggagcatgtggccttcttacaagttggaacatcttctggatatatgcccaggggaggtattgctggatcctctagtagtactatgtccaattttctgagaaactgccagactgatttccagagtggttgtaaaagcttgcaatcccaccaacaatggaggagtgttcctctttctccacatccttgccagcatctgctgtcacctgaattttttatcttagccattctgactggtgagaggtggaatctcggggttgctttgatttgcatttccctgatgattaaggatgttgaacattttttcaggtacttctcagccattcggtattcctcaggtgagaattctttgtttagctctgagctccatttttaatggggttatttgatttactggggtccagcttcttgagtgctttgtatatattggatattagtcccctatttgatttaggataggtaaagatcctttaccaatctgttggtggcctttttgtcttattgatagtgtcttttgccttacagaagctttgcaattttatgaggtcccatttgtcgattctcgatcttacatacagcacaagccattgctgttctattcaggaatttttcccctaagcccatatcttcgaggcttttccccactttctcctctataagtttcactgtctctggttttatgtggagttccttgatccacttagatttgaacttagtacaaggagataggaatggatcaattcgcatacttctacatgataactgccagtttggctgggtatagtagcctgggctggcatttgtgttgtcttagtgtctgtataacatctgtccaggatcttctggctttcatagtctctggtgaaaattctggtgtaattctgatagccctacctttatatgttacttgacccttttcccttactgcttttaatattcaatctttatttagtgtatttgttgttctgattattatgtgttgggaggaatttcttttctggtccagtctatttggagttctgtaggcttcttgtaagttcatgggcatctctttctttagttttcttctataattttgttgaagatatttattagccctttgttgaaatttttcattctcatctactcctattatccataggtttggtcttctcattgtatcctggatttcctggatgttttgagttaggatctttttgcattttgcattttctatgattgttgtgctgatgttctctatggaatcttctgcacctgagattctctcttttgtctcttgtattcttttgctgatgctcacatctatggttccagatctttcctagtttttctctctccagtgttgcctcactttgggttttctttattgtgtcttcttccctttttaggtctagtattgttttgttcatttccatcacctggttggatgtgttttcctgtttttctttacggacttctacctgtttggttgtgttttcctatttttctttaaggatttgtaactctttagcagtgttctcctgtatttctttaagtgagttattaaagttcttcttgatgtcctctatcatcatcatgagatatgcttttaaatccgggtctagcttttcgggtgtgttggggtgcccaggtctggctgaggtgggagtgctgcgttctgatgatggtgagtagtcttggtttctgttagtaagattcttacgtttgcctttcgccatctggtattcgctggagttagttgttatagttgtctctggttagatagagattgttcctctcatgattctgttagcctctatcagcagacctgggagactagctctatcctctgagtttcagtggtcagaggactctctgcaggcaagctctcctcttacagggaaggtgcacagatatctggcattcggacctccctcctggcagaagatgaaggccagaaacgggacctgtcccagaagctgtgttgctttggcctgtcacagaagctgttagcttctgtagtccacactctcacctgcacagactagtctcagagggatccgggaatcaagatggctcccccaggtgctctggcaaagccctcctaggcagggcggacacctctcctctggcagggaaggtgcctggatgtctagagcctgaaacggggtctgtctcagaagctgtcctctagggaccttggtgttgtccgccgactcagtgcccaaggtgaccaggtgctggcacctaccagaagggacttgtgaccctggtcaggttgggtttcctgctttcctaatgctgtctcaggtcccacgcgattggattggaacagaagttgtgttccactcactggtggtcctaagatcatgtggagagtcctctagggaaccttgggggtgtccacctactccgcgcccaaggtgacccggtgctggcgcctaccagaagggacttgtgaccctggtcaagccgggtttcctgctttcctaatgctgtctcaggtcccaggcgattggattggaacagaagttgtgttccattcaccggtggtcctaagattgcctggagagtcctctaggggaccttgggtgtctgccgactctgcgcccaaggtgacccagtgctggtgtcaactggaaggacttgtgaccctgcctgatctctctgtttacaaaactttgacaaactgcaacaacagcagtcaggagcagcagctgcctcagagtgtcccaggccatctcagaactctggcatttatatcctctgaagagtccccagaattccaaatgtaaactatctgcagctggcaaaaccatgtcactgctaatgcatgaggcaaatcataatcactcgtgaagcagccacttctcccacacctgggattaaaacaaaaacatattcatggaacataaataaccaggtttttgaagaaaccaaaactcccacttacatttcccccatttagtccaaaatggcttttttctaacatcaataaactatatgcaataagaacaattatgagaactatcaagtaagaattttgtttacaatgtccagtctatatgtatttggcagtcttgaagaaagcactgcactatctatcctatcctattgagtctaaagttttgaatctaaattactttcataaatttcttctatcaaactataaacatctttttaaaccttaaagcatttccttagattctaaacaacttaagcttttctgtgtttaatctttaataaggaagattgtaagactgttaactatatagtcttcaaccctgtcagcgacctgagtaagcaggaagttccaagcaagcagcttccaaaactgtagaggttcttcatgcccaacattttctttgaagaagattggggggtgcttccaggagcagatgtgttgctctgtgaaaaaaacccttttattattaaaaaatctttttattattaaaccaacttaaatgccatattctctagatctctgaagtgtttgcagaccacctatttatcccagtatatcttaatagccaaacattatttgcttctagctatttactctctgtttaactttgaaaacatatacaagactaaataaagcttatttctgtaattaactgaactagtacctaacaagacaacaaagtaagattatttataggtgactaactacttactaacttacatttctaattatcctaaacagtttgcaatagtagctgttataagactagaactttacattacatttttaagtgagttgtatatgtacaatacattaagcaagatttgaacaaaataagcttaaatttctaacaacaatacaataattcatatcaatgtaaaatacttgagagtagtagatttagtaatgtaccttttatcctgtcatactgtacttcttgctgctgagccttgagctggggccacaaagcaaaatattaatagcaaaatattatatagtatatccctcctggctgtaacaaaaggatggaccatctagagactgccatatccggggatccatctcataatcagcttccaaacactgacaccattgcatacactagcaagattttgctgaaaggacccagatagagctgtctcttgtgagactatgctggtgcctagcaaacacagaagtggatgctcagagtcagctattggatggatcacagggcccccaatggaggagctaaagggatctgcaaccctataggtggaacaacaatatgaactaaccagtaccccgaagctcttgactctagctacatatgtatcaaaagatggcctagtcggccatcactggaaagagaggcccattggacatacaaactttatctgcctcagtacaggggaacgacagggccaagaagtgggagtggggggggggcgtgtgggggacttttgggatagcattggaaatgtaaataaaataaatacccaattaaaaaaaaagtatatccctcctgtccctgcactcacttgttcagtgggaagcatctacaaactctgggaagcctcagctttcttactgaggacacattgctcccagaaagggctcattagtgtctgtggacaaagtactctgtttctcagagttaatacacaggctattttgatctctgagacttttagcggcttggttacagtttcttttcaaatgaccaaatttaccacagttgaagcactgggaagggtagtggtagtaatctcataaccccagactgccgctctggtgcagttggttagaaagataagcactggagaagccaggaaaagttaaacacacagctggagtctcctaagggagaagatatttggctgttctcccagaagtgctggggaaaaatgtagtttacagcctggtaatcctttggtacctgttgagccagtctcctcccatatcacccaggatattatgcttgtttatcccagactcctaaatccttgagcattacttcttggccataaaacttaccattgtgagagatgtcatttgtaatttataacaagctcagtaacttttgtgttgtattatgttcatttccattactctccttagacccttatcctgagcattgtttctgaagtcaagaagaagtcatcttacagataaagccctatgtatgccctttgtaaagaacttcagtgtgaacacgtcttaagcttttaaaccctgtattcacagggctgagttaattgttatttgattttttccaaaatagagctgtatttaaatatggctaaagtaaaatgaactgggtcagactcgagaagtcctgggccaggactggttaccaaaattgggctgatcctagtttcattcttactttaccctgatcatttttcactgcttgccttaaagcctctaggaacccctccacaatactcaaaccatgccccaatctattaaacacatttggacaaatttgtgactttgtcaatatcctatttataccatgaagcagcttggatgaagctattgtgttaaagaactatgtaatatgttttctgccataaattataggtgtgtgttgtgtgtgttcatttttgttttacttcttttgagcccaaggccttgtgtatgtatatactaggcccactgagctgtatcctgacccttcccttttatatagtttaatgtattattatgtttcagcaaatgctaagtaaataacataatcctaacataataaataacataacagcagccaaatctagagaggagagatgacaggggtaatgggaaggtatttataatcaaagtatagtgacatatacatatgaaatgtcataacaaattccattattttatatactaattaacaaaagtaattcataaaaatgtaggtttaaaatcctagtcaatggtctggagagatttctcagtggttataaacatttgctgctcttgcagatgaccaaagttcagatcccagcacccacatcagaaagctcagaaccagttccaggggatactaggccttcttctgacctcagcaggtgtgtgcacatgcacatgtgcatatacatgcaaacacaaacacacactcagatggatatacatgcataaataaaaataaaacttaaaaagaaatgaagtatgagccaagttaaggacttgtgagatagctccatgattaagaagagcacataatggttttccagaagacccaagtctaattctcagcaaactttgtcataaggttcacaacacttgtaggtggtacagtcacgcctccaagggtacatgttcatatactcacacaaaaacacatatgcatacatattatttttaaaaaaataatttttaccatggatagtggcacatatccttaatcctaatacatggaaggcagaagcagacagatctctgagtctaaggccagcctggtctacagcatgaattccagaacaggcagagctacatagtatgaccctgttttcaaaacaaaacaaaagcaaacaaaaagcatcatttacaagtatttttaattgaaatagaattgtaccacattccccacgtcctttccttcttcatacccctcccagcttctgtctttcaagcctcacccaacttctctcaagttgataccttctttaaaacaatacatgtttacagacaaaagtcagggggctggagagatggctgctcttccagaggacctgtgttcaatttccagcacccacatggcagctcacaactatctgtaactccagttccaggagatctgacatgccctacacagacatacatgcaagcaagacaccaatgcacataaaaaataaaatgtatcattaaaatttttaattcaaaaattcttagtaaattaagtgcttattagtaaactacaggtttggaacctctttaaacataatccttatgttgatggacttcaattgcaaatacctactacaatgaaatgcatattaaatgcattaaaatatgcacaatttccatgatacatttaatgagtacctaccttagttaggatgctactgctgtgaaaaaaccccatgcctaatgcagcttggggaggaaagggtttatttccatatcctgaattacagtgcatggagggaagccaaggcaggaactcaaacccattaggaacctggaggcaggcgctgatgcagaggccatagaggagtactgcttactggcttgctcctcatgccttgctcagcctgttttctcatagaaccagagtaagggatcttggaatcaggacagaacacacccagacaccaaatttttcgcacaaaggaacagtttgtgcaggagtggtttataaagagagaaaaggggaagccagtgttcggatgagttggtgtgccctgattggacatgttagccagtatagccaaataatagaatttgattgttggaccttgtcattttgactcttgaaccttggtgatcagtctcaggaatgagtcagtgactaaataagggaatgtacattgggagctagctttcggaaagtaatctaacagtttagcaagagagagggtaaggggaaggcgaggcctgccagtgtcatggttgcaatgcttgagcctgttaaaaagctatttacccaggaccactagcccagggatggcaccacttgcaatgggctgggctttcccccatcaatcgctgactaagaaagtgctttacaggcttgcctgcagcctaatcttatggaggcatttttattttccactgagggcccctcctctcagatgattctagtgtgtatcaagttgacacagtaccattctccctttcctttcctttttacttggttaaataagctctgttgtaattgtgctttttttttctttatccttctgctctgattcccatataaagtctctaaaattttggttttctacttttcttttctttttctgcaggttcaagaatatagagaggctcttgatgcagtcctcatcaagggcaaaaatggagtccctcttcttccagagctgtacagtgtccctcctgacagggtgagttggatagtgctggaccattgacgggaaaggaaccatgtttctatgatactgactcatctgagtcacggtgtttgtgactttgtatcttgggactttaatattctaaggttttggttttcacagtaggacaacagaaacaatttccttcagaaataaattgttaaaacagtctcaattatggtgctgttgtacaatgagatgtaaatgaaagcagatataaattctgagaatgatgtacagatcagtatgtggaaccagagtggtgttccgtgtcagcttgttatcttctgaagccagtaatcttaagatggctggtgtaaatcagacttagaaaaatcagacttcgccattgtgaaggagaattagacatggtagcaatacagccttacattctggtggggatttggagaacatttgctaacagcatccagtgtcacctgagaatttattacaaaaactttcatccacacctaccgtacctattcagtctgcattttcataagatttttgggtgatctgttcatatatcacatcttgaacactgtcctacttagcttttcaatccattgcctataaactataaatcaaactagacgccagtcttttatcgtctagtgtcttaagctttccagtattgcctctcatttgacctctttatctcgtcatttaggttgatgaagagtatcaaaatccccacactgtggatcgagtccctatgggaaaattgcctcacatgtggggtcagtctctatacattttaggaagcttgatggcagaggtaagggaagatttcaaagctatcccaccttttattggtttgtttaccatagtcactataataatcagatttgcaatgagctgaagtcaaaggatttcttcatccttttatactttgacttaattacagcctttcctctagcttgtctgcatgggctatggccattgcttgacaaaaagttcttgctccctgtctgttatgctgcccatagctccctacttgggcattgtacttggtgctgttcaggaatcaagttgtgcatctttccctttcaaaactcccctaggtgacttgcctggtgactaagcaattactggtgatagattaaatgccaaccttcctaagcatcataagattttattccctaattgaattaagtgatcattcggggcactttgacttgcttggtaataacaatgtggtctttctgttttgttagttaatgggtttttgttgttcttattgtgtttttgtttgtttgtttttgttttttactttttggaatggaacttccaatgtcaaactctgttaagacagctcttaatgaagcacaattttgtatccagtttctgggggttgcattttgagcctacacagaaggctatttcttctaaaaaagttttctagtcctttctgaaaactctattttcaacactgtaggttatgtttaagagccaaggtcttactatgtagcagtagtagctggtcttgaacttgccacatagaccaggctggccttgaacttgcagtgattcttctgtgtttgtttcctgagttctgggattacaagtgtgttctatcatgcctagcatggctgttttgatgtgagagacccaagttcttagagaatctagtttggaacttagctggcatttctgagtaagatattttcctgtttatatggccatttattttctacagctgtgtttttgttttgttttgttttgttttttccctgtggccatggctgtttgataatcttgaattgacatgactttggatttagcaataatgggcataatgcttcaaagtaatccgtgtccagtaactttcttgtctgacaataaatgaaatgggacaaaaaggaaggattcagtattatcaaggaaaaagatgagtgagctcattttatttaacaacatatggaaactaagtaaaaagatttccactaatcaaaatgtacagcgggcacatggacaaacaagcaaacagtgcttactatcaatttttaaaaatattttttattattacgtattttcctcaattacatttagaatgctatcccaaaagtcccccataccctcccccccactcccctacccacccattcccattttttggccctggtgtttccctgtactggggcatataaagtttgcatgtccaatgggcctctctttccagtgatggccaactaggccatcttttgatacatatgcagctagagtcaagagctccgggttactggttagttcataatgttgttgcacctacagggttgcagatctctttagctccttggatactttctctagctcctccattgggggccctgtgatccatccaatagctgactgtgagcatccacttctgtgtttgctaggccctggcctagtctcacaagagacagctatatcagggtcctttcagcaaaatcttgctagtgtatgcaatggtgtcagcgtttggaaactgattatgggatggatctctggatatggcagtctctagatggtccattcttttgtctcagctccaaactttgtctctgtaaccccttccgtgggtgattgtttctaattctaagaaggggcaaagtgtccacactttggtcttcattcttcttcagttacatgtgttttgcaaattgtatcttatatctcgggtatactaagtttctgggctaatatccacttatcagtgagtacatatcatttgaattcttttgtgattgtgttacctcactcaggatgatgccctccaggtccattcatttgcttaggaatttcataaattcattctttttaatagttgagtggtactccattgtgtaaatgtaccacatttttttgtatccattcctctgttgaggggcatctgggttctttccagcttctggctattataaataaggctgctatgaacatagtggagcatgcgtccttcttaccggttgggacatcttctggatatatgcccaggatttaacatattttgagaattccatgtatgtgtgctgcttttatattattttcacttcttgctccttttcacatacagagactgccaagtccatttagtggtacttatatgtgtatttaggattgaccacttgggactggataccctgtcagggggctcattcctggagaagactggttctccctgtctcagcagccattaattgcctatagatctttgtctagagtccctgagatttttctccattcatgttgccatgtctattggtggtgtcattgtggaggccttacttaggtgaccgtggtttttaaactttcatgcatgtatgcagcttccctgtcatatataggaagtacaatatattgcagcagaagtcctggtcccctagctctcaaaatccttccacttgctcttccattatgttccctgagccttaggtataggggtaatgtgcattttgtctataggggttgggtaccccaaagtcatttgttctctgcattttaaccacttgtggttttctgtaatggtctctgtctgctgcaaagaaaagcttctttgatgagtggtgagagctacatgtacctgtgcggataaggatgggtacttagaatccagttaggaattaatactggttcaggaaagtggcagtagtaggttctcctctaagttcgtgaccccaacagccaagggtaattggctaggtttccagtattagacatgggttccttcctattgagtagtccaattcgacaaccattggttgcctctatgagataagtacaaatattggacccttggggctatcttaccatactggtcgtaattgtggttcataggtttcaaaactggccaggactattgattgttttcctcccttggcagtttgtttagcacttttggtcgttagaaggctaattatgaggtaggaagctttctggtcagttccagcttaattccttccagtcctgtgtctaaggatatggtgtcttcagctattagatctcaccttaaagttctgtgaggcaaccaaggaaaatagcagtagcctacatttatactgtggagcctctatctctctctctgtctgtctctgtctgtatctgtctctgtctgtctgtctgtctgtctgtctgtctctctctctctctcattctctctctctctgcttaaagaaatataaaatgtttccctttggctcttccaaacatgtttagtattatttatccctttgccatccttctccctttccagttaaatctccaccccctatttttcccatttccctctttttaaaaaacattacattaggttgtttttccctcatttatctgttatgccatataaacatatccagaaaagatagtggaataaccagaaacttcctatttatttataatttataacctgcttttcttctaaaaaataaggatttgtggcacccactaaatataaaccagacaaaattaatttggagatgaattctgggttttcaagcatttttatacagagcaactgtttgtcttttgtcatttccccctaaaatactaactttactttttttttaactatttttaaattttattttattattatttttatttgcttactctatgtgtggatgctttttatactatgtaccatatgtgtatagtgcctgtggagggagaagaggcatcagcttacctaaaactggtattagacagttgtgagcttccaggtgggtgctgggaatggaactcaggtcttctggaatgccagtctacatacagggtgctatctgaggggatccaggaggctctggcccagccacagcagccagagggttacagctctctgacaggaagccagagtgtggtgggctgctgggcctcttctgtggccacagcttccctggagttggtgacagacagtggaatacagcagacatctaggggccaaggtcagggccaccaagcttgtggaagtggctgtggtcaggttcacacacctgtctggttgggctatgtcgaggtccagctttgggagggaaagcttttccctggagtgttatagcttgataaaagaggcactctcagatgatctttattccctgtagataggaacttataaacctttgggggtaggttgggatctagaggcagatgctttctagtggcttggtttgagatattaggaatgcctcatctgcttgtggaaggacttcaggtattgtcccttatgtgactgattgtgatggtcctctcaatggggtgtcatggttatgtatgccaggacaggaacccggtcaggaatatatttaaatgcctactaaacatgtactgttctcaatgatgagaattgcaggggtttctgaatatgctctgccttacttacatagtccactgccccacactggaagagcagccagtgttcttaactgcagggccatctctccagtgccccagctttatttttgaggcttattaattttgtttttatggatttccttcagggatttttagctcctggagaaattgatcccctgaatcgtaggttttctactgtgccaaagccagatgtggtggttcaaggtatgtattactcttagcaacagaaatattgtactaaaggtctgattaggcaaagagatttgggggctttgtgttgggcttcaagtctgtaacaaatttggtttagtttggtttcaaaattgctgttaataataaatcaatgaaagatgatctcagaggattgtaaaattctttttgacatacctcatttctgggaattattttctctaaaattccatgacattttattccactggttactgttacattcttttaaatcacattttctgagcttttgctgctagtatacctttcttttcataacctcctatgcattaacatcctgcctgcattaggctgttaaggcctgtttccctcatagtacatttgtttctaatcattacttactaggaagtatatctaaaagttttctgttaagaattaacttaaatgtgagagtatctacagtatgcaaacactgaactgagttctctaaatattaagaatccaagtagggctggagagatggcccagctgttaaaggctaggctcatcaccaaaaatataagaatccaagcctttggctgggtgtagtagtacatgtgtttaatcccagcagtgggaagccagaggcaggcagatcactgaattcaattttagcttcttttatatcaggagttcaaggctagggtttctattgctttcaagagacaccatgctatctactatttttatccttaatatttttaaatatccacgacgctagtaccctctaattagggctggcttacacttcagaggtttagtccattattgttatgatgggaagcatggcagcatgcaggcagacaggatgctagagaggtagctgagaattctacatccagatcagcagacaacaggaagacagagagactgggtctgacttaagcttctgaaacctccaagcctacctccagtgatacatttcttccaacaaggccacacatccaaatcctatcaaataatgccatgctttacaaacctatgggagccattttcacttaaactatcacagagatcctgtctgaaaaaattcctagtcagaatttcaatgaatgaactctgtgttaaacacaaaaaacacaaagctggtctctttcctatctatccttcttacttcccccaaagttgttgatatttttaccttccttgtttctttcaatatttccattatcctggtttttggttttagacatcttgatgtgaattttcattcaacatcactcttcaatatggtgtcaagttctactataaaaattctttaagatattcctagtcatttggatttttgattctgtatggaaaatcagcctattttctaaagctgcttatacttgattctctgtgtgataatataggtggtctttgcttcttgttgctactagcaatgagaaactattgttcttcatcccccataagaaggcatgttttcctctgaggtttaaacgttcttgctatgctgatcttctatttgttctaattcatatatttatgactttgaagctcaactcacagtcttctttctcctcccaaaattctgtcataaaactagatttcagcattggtgtaggtgatagctactatttttacccttaatatttttaaatattcatgacactagtaccctttttctgtatctctaggttacataccatgtcttggttacttttctattgctgtgacaaaacaccatgataatttggggcttgcagttccagaggttagagaccatggccaagatgacagggagcatggcaacaggcaagcatgatgctgaagcagtagctgagggcttacatccttatctgcagttaggagacagacagagagacagagagaggggagagagagagacagagacagagagggggagaggagagagagaatatgaactaactgggaacaatgtggacttttgctacctccactgacacgcttcctctgaggaggccacatctcttaatccttccctccagctgaggactaagcacttaaataaaggctataggggcccttgtcattcaaaactccacacaaaccatgggtcaaacttttggaccttataggtgtgtcattcttgtgttctgctaacaatggatcatggcttttccctccttcctatttgtttctgattcctcctagtctattcttttctacctcatgtttgatcatctgaatatcccattcaccattgcatcatattgtttctctatctaccagaactattatagttcaagcttaattgtataggctccactttctgatcctaaacctactaaaaagcatgatggggaaaaatacatgagaagcagagtggtggcagtgggtgtccatagtctccaactcagcttcccagtagattttgttcttattattagacagcattttcatatttttcagctatgccctttgttttcagcctattattcagactgctatttcatgccagatcattttcatattctgatgtcttttagtttaccaactctcccaccccaataatcttacccatacatacttgcttccttttctttctcctattcaagacgaattcccctattggtacttgatcctataatcttctttacaaataatctgttttgaaatattcagatttccccatttcagtttctttatctattgttatattaatctccatctggatttcagaggtggcttgttttcacattcatgtttctgcctctttataatccattaattctccagttcgttatagtgtggtttaatactcaaatactcttgcttagttttcagaggccttggcattgtcagtcttagatattttataatcagtatattagcagattttttagatcaacttgtcatatatctttctagaaacttaatttctacaatgttcatgatgatatatgtatttgtagatcttcttcaatctatttgaagtacttttctaccttattcttggctttctcttttatttcccttgagctgttggtattcctgagagttctgtccatagcctatcatttgtcttgttctgaataatgggtcacgttcccgaatctcatttcaaaccctttctcttttccctcacccccacatgatgaccccatgttctctgccatagaaaaaaataagacatgatacaagaacttcccccttgtcccaggcttatccttatcaatctattcctgagttttctcaaagtgatattccacatcctcttttcttgactttatattctcttcccatctcatctgtttctaatgacttctgacttgaatgtgtctatgcactgtagactcaactaaaacagatcagctggatcctcctaatataccagctaatcctgctatcccttctgtgtctgtatcattaaatactcccagcacagggaaatgaacacccaaagaacacctttcaattcctatttattcctctctgatttcctgtgtttatataacaagttctggctcctttacttcccaagtcactctaaaatccatcctgttttgacagtgtcagtagcgtgattgtaatgtaagctatcaacacgcacacccccccttacttcactgctttccttttgaactgatatttctgtctccagtctaggcccaatacagtcagggagtttcttattttgttttttaaaaatcactgttgcctacacaaagaaacgtccattcattctttaattattaacttgagtgtactctttttaagatgcaacatgggtatattattcctctgcaggaacttcctatttcagttcttttgacatggcttacaaagactctttgtagtttactctatttctctttactgctccttcacagtcattattcctactacaaagaacttggtttacaggctgagggtgtagcttagtggtacaagtgactggctgtttgtgaaggcctggctccattccccagcacaacaggaagcaaagcagtgaaagccaactttgtaactttgttcatgctgtgtctcttatctgaaacagattctcttttactcttaccatcacctctatcagattaacttctttctgccctccatcaggactcattttgtccattatgtaccccttgcatctgacatcaaactctcagtattttataaatataaacaaaaatttagttgcttgggttgaatgtactcccggaaactcaaagggctgtttaccttgattctcctttagtccattttactcctgtaaccaacttattgctccctgtagaacccttaagttttatagaatgcagcttgggaaacaatgcccaacaataatatacaaaaccttaaagtaacacctatccttccatgatgagctaataaccctgtctaccttttcactttcatttattttactgcttagtaaaatcatgccataacattgaagcttatatagtttgctgctgcctccccaacctttagactagaataactatcctcttgtgatttaatttttttaaaaaagcatatcagtaaggcccattggacacgcaaactttatatgccccagtacaggggaacgccagggccaaaaagggggagtgggtgggtaggggagtgggggtgggtgggtatgggggacttttggtatagcattggaaatgtaaatgaggtaaatacctaataaaaatggaaaaaaaaagtaaaaaaaaaaaagcatatcagcattttgcttgcatgtgtctttgtgtggcaagtgagtgtctggtgcctatggaggccagaagaaggcattggatcctctcttcattacggtttacattatgaccaaggcaactcataaacaacaacatttaactggggctgactaacagattcagaggttcagtccattatcatcaaagtgggagcatggcagtgcccaggcagacgtgggactgatggagctgagagttctatatcttcatcgaaagatagacaggagaagactagcttccaggcagctaggaggagtgtctcgaagcccacccacacaatgacacacttcttccaacaaggccacacctcttaatactctctgggccaagcatatttcaactaccacatttcctctggaactggatttaaagaattttgtgagccaccatgtaggtactggaaactgaacctgggtcctctggatgagaagctcctcttaactgatagtgagttgtctctccagcactccattcacctttccaatttactcatgatttcaagtgcagttagctaccagctctttcaggctactttattttacttgattttttaaaatttaataatatagttgttttatttgaatatacatctgagcaccaacatgtgtttctggtgccctcaaatggcattggatcccctggaaatggagttatagatggagttataagccatatgtacagaaagatattggtaactgaatctgggtcctctagaaaagcagccagtgctcttaactactgagccatctcttctgcccccaagtctacctttcttgaagccaaccttcctaactccagactaggtaaatgccacttctatgtggtctcatgatattctatacatatctccatttacctaggaggtcattttctattgaattcatatgcccctctaccataacactaagagattcttacaggagaaactactttattcatctctatatctctagtaccttaaccaccatccctgcaaacccacaactgtcaggcctgtatacagctgactcagaccttcctcctcagtttactctccttcttccattgtctagctataggacaactctggtgtttcagatgttctatactaccctcatactcctagcactgacattaagtgtacgtatattgaagagcctggacagtcagctttcaccagcactatcagaaaaagactcatgattaaaatttcccatttcaacatggaatctgataaatacccaaagagccatccagtaggcacatatagatacctaaccaaaaagctcagtctcatattctaatcatgttttttccttcctagttatgtaatttttaaaatctagaataatccctgattcattagaattcctcaataatactttcctctttccctctccaaagaaattatgcactttaaaatatttctaggggtctggagagatggctcagcaattaagagcacttgttcttgcagaagactcaggttcacttctcagaacccacatggtggcttataactgtatataaatccaattttaggggatctgatgcactcttcagacctccatgggcaccagacgtttatgtggtccatagacatgcttgtgatcaaaacactcatacacatcaaataaataaatctaaaagatatttttaaagtttctattgaactaaaaatcttctgttgacctcatcttctttctttcctatagtctccattctggctgaaacagaagaaatcaaggccattttgaaggacaaaggaattgatgtggagaccattgctgaagtgtaccccataagagtacagccagctcgtattctcagccatatttattctagtctaggtaaggagattgactagtgttatgtgatgctggctgattgctttccattccccatcctgactcccacttctttagcttgtaatgctttattacattggaatccaagtttctgaactaatgttttatgagcaggcttaataattttaggtgtgtgttttttttagatttatttattattatatgtaagtacactgtagctgtcttcagatacaccagaagagggagttagatcttgttacggatggttgtgagccaccatgtggttgctgggatttgaactctggaccttcggaagagcagtcgggtgctcttacccactgagccatctcaccagcccccatttaggtgtgttttatacatactttggtatgcaggacaagtttgattccagacaatattatatccttcttctaaatgtatagtcaactagcatgttttccactttctcggaaactatatttctgttatgaatacatgctaattttatatagagtagtaatcaaggaacttattttatgctttgttgtgtaatgaactaattattaaaaaattaatacccttttctaaatagttatatttattctttttattaaatttaatgatggaattttatattaaacaaattactgcactgttaactaacaaaaaaatatgggtgctggtagtctgtagctcagtgacagaccccttgtatatactgtgtatactgaccctgagttccaaccttattaccaaaaaataaagggatatgcaaatttctgaactacctttttttttctttttttttttttaattttttattaggtatttagctcatttacatttccaatgctataccaaaagtccgccatacccacccacccccactcccctacccacccactccccctttttggccctggcgttcccctgtactggggcatataaagtttgcgtgtccaatgggcctctctttccagtgatggccgactcggccatcttttgatacatatgcagctagagtcaagagctctggggtactggttagttcataatgttgttccacctatagggttgcagatccctttagctccttggctactttctctagctcctccattgggagccctgtgatccatccattagctgactgtgagcatccacttctgtgtttgctaggccccggcatagtctcacaagagacagctacatctgggtcctttcagcaaaatcttgctagtgtatacaatggtgtcagcgtttggatgctgattatggggtggatccctggatatggcagtctctacatggtccatcctttcatctcagctccaaactttgtctctgtaactccttccaagggtgttttgttcccacttctaaggaggggcatagtgtccacacttcagtcttcatttttcttgagtttcatgtgtttaggaaattgtatcttatatcttgggtatcctaggttttgggctaatatccacttatcagtgagtacatattgtttgagttcctttgtgaatgtgttacctcactcaggatgatgccctccaggtccatccatttggctaggaatttcataaattcattctttttaatagctgagtagtactccattgtgtagatgtaccacattttctgtatccgttcccctgttgaggggcatctgggttctttccagcttctggctattataaataaggctgctatgaacatagtggagcatgtgtccttcttaccagttggggcatcttctggatatatgcccaggagaggtattgctggatcctccggtagtactatgtccaattttctgaggaaccgccagactgatttccagagtggttgtacaagcctgcaatcccaccaacaatggaggagtgttcttctttctccacatccacgccagcatctgctgtcacctgaatttttgatcttagacattctgactggggtgaggtggaatctcagggttgttttgatttgcatttccctgatgattaaggatgttgaacattttttcaggtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatactttcccaatctgttggtggtctttttgtcttattgacagtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttaagtgaagttccttgatccacttagatttgaccttagtacaaggagataagtatggatcgattcgcattcttctacatgataacaaccagttgtgccagcaccaattgttgaaaatgctgtctttcttccactggatggttttagctcccttgtcgaagatcaagtgaccataggtgtgtgggttcatttctgggtcttcaattctattccattggtctacttgtctgtctctataccagtaccatgcagtttttatcacaattgctctgtagtaaagctttaggtcaggcatggtgattccaccagaggttcttttatccttgagaagagtttttgctatcctaggttttttgttattccagatgaatttgcaaattgctccttctaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagttcttatcatacagatctttcacttccttagttagagtcacgccgagatattttatattatttgtgactattgagaagggtgttgtttccctaatttctttctcagcctgtttattctttgtgtagagaaaggccattgacttgtttgagttaattttatatccagctacttcaccgaagctgtttatcaggtttaggagttctctggtggaatttttggggtcacttatatatacgatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccagaacttttatcatgaatgggtgttggatcttgtcaaatgctttttctgcatctaacgagatgtgaactacctttgcaagagactgaataaccatccttccctcaaaatatccgggttctgatctttagtacctatgaacattacattatatggcagaaataactttgcaaatgtggttaaattaaggaacttgagataagaacgattgaggtggacctcaaatacaatcatagggacaggacaggctacagaagcagctgtgatatatttggggtttattagaatgacttacagattgtggtccagtgactccaacaatgactacctataaaagtaaggtccatgcatccaggtagtgttttagttcacaaggctggatgtctcagctggtcttcagtgtacactgaaatcccaaaaaaagtaggctctaatgacagtgaaaaaagagaaagcaggcaaagagagcaagtttccttcttccatgtggatatctatccattgtacaactgcaaacacatcataaatttagaataagtggcaacgtcacttgagggccgtcctcttagtatctcaaacgtaagtatgctaacaattgatattctcttaattgatgttacatggcctgataaattgaggaaagacctgggtggtgatggtccatgcctttaatcccagcacttggaaggcaaaggcagcctggactacagagtgagttccaggatagccagtgctacacagagaaatactgtcaaaaacaaacaaccaaaaacacaaaataaagaagaaattgaagaaagaaaacacaaatgcattcttaacaaaatatgacagaaatactcatgtcaattataatcctcatttttgcaactggtcacatggccttagctggtatttaaattatcttctactatgcattctgtatatcctccactctcagcaagtccctgaggtcttgactctttttctggacgagtgaccaattccctcattcttgaagggtctgtgttctttgtcatcttgccagaattacgtgcttatagtttcccattggcaacatagaagatggtaggacctagagacaccctgaaggatctcctacattccagacataatctttcttagctctattttggagaagcgatccaatttccccctggtaatctggatcaatcacccatcctaagactggcattactttcttggcctgttggcttaaggtcaccaaaaacccaaagttgccagtacagggtctaagtttacagttcagttgaatatttgttatggttcctggcaggaatgctccctcaggctggaaccaaaacttctaggccagaagaattagaggtcacaggaacaggaagcaaaaattttcctactgggtcactagggggttaaagtaagtggaactaatcccttttctatcccttgattcctggacccatggatccttgctatggttgtaccatatactagatgctaattcaaagcatataccaccttttggagaatcctgtcccagcccttgaggctgctgccacttcattggcatgtaactttgtgttcaaaagactattccacctttcttcctttttcaaaatttttattagatattttctttatttacatttcaaatgttatccctttcctagtttactctctgaaaatcccctatcccctccccttgcttcccaacccactcactcccattcctggtcttggcattcccctagactggggcatagaaccttcacaggaccaagggcctctcctcccattgatgactgactagaccatcctctgctacatatacagctagagctacaagttccatcatgtgttttctttgataggtggtatagttccaaggacttctgggggtactggttagttcatattgatgttcctcctatggggcttcagaccccttcagctccctgggtatttctatagctccttcattggggatcttttgcttcatctaatggatggctgtgagcatccacttctgtatttgccaggcactggcagagcctcagaggagacagctatatcaggctcctgtcagcaggctcttgttggcatctgcttagtgtctgggtttggtggttgtttatgagatggatccccaagtggggcagtctctggatggtcgttcattcaggctctgctccaaactttatctctgtaactccttccatgggtgttttgttcccccttctaagaaggattctgagcttctgggctatcagtgagtgcatgttttgtgagttcttttgtggttgagttacctcactcaagatgatatcctccaaaatatcatgaatttcatgaattcattgtttttaatagctaagtagtactccattgtataaatgtaccacattttctgtatccattcctctgtatagggacatctgggttctttctagcttctgactattataaataaggctgctatgaacatagtggagcatgtggccttattacatgttggagcatctgctgggtatatgcccaggagtggtattgctggatcttctggtagtactatgtccagttttctgagaaactaccaaactgatttccagagtgattgtaccaccttgcagtcccaccagcaatggaggagtgctccgctttctccacatccttgccagcatctgctgtcacctgagtttttgatcttagccattctgactggtgtgaggtggaatctcagggttgttttgatttgcatttccctgatgattaaggatattgaacatttttaggtgcttctcagccattcaatattcctcagttgaggattctttgtttagctctgtaccccatttttaatagggttgtttagttatctagagtccaactccttgagttctttatatatatattggatattaaccccttattggatttaggattggtaaagatcttttcccaatctgttggttgtcttttggtcttattgacagtgtcctttgccttacagaagctttgcaattttatgaggtcccatttgttgattctcaatcttacagcacaagccattgctgttctgttcaggaatttttcccctgtgcccatatcttcaaggcttttccccactttctcctctataagtttcactgtctctggttttatgtggagttctttgatccagttagacttgagctttgtacaaggagataagaatggatcaattcttattcttctacatgataaccgccagtttagccagcaccatttgttgaagatgctgtcttttttccaatggatggttttagctcccttgtcaaagatcaagtgaccataggtgtgtgggttcatttctggctcttcacttctgttccactgatctgcctgtctgtcactgtaccagtaccatgcagtttttatcacaattgctctgtagtacagcttgagttcagggattgtgattctaccagaggttcttttattgttgagaagagtttttgctatcctaggatttttgttacttcagatgcatttgcaaattgccctttctaacttggtgaagaattgagttggaattttgatggagatttcattgaatctgtagattgctttcggcaagatagccattttgactatattaatcctgccaatctatgagcatgggagatctttccatcttctgagatcttctttgatttctttcttcagacacttgacgttcttatcatacagatctttcacttccttagagtcacaccaaggtattttatattatttgtgactattttgaatggtgttatttttctaatttctttctcagcctgtttattctttgtgtagagaaaggccactgacttgtttgagttaattttatatccagctacttcaccgaagctgtttatcaggtttaggagttctctggtgaaatttttggggtcactaatatatactatcatctgcaaatagtgatattttgacttcttcctttccaatttgtattcctttgatctccttttgttgtctaattgctctggcttggacttcaagtactatattgaataggtagggagagagtgggcagccttgtctagtccccgattttagtgggattgcttcaagtttctttccatttagtttgatgttgactactggtttgctgtattttgcttttgttatgtttaggtatgagccttaaattcctgatctttccaagacttttatcatgaatgggtgttggactttgtcgaatgctttctcagcatctaatgagatgattatgtggtttttgtctttgagtttgtttttatagtggattactttgatggatttcagtatattgaaccatccttgaatccctggaatgaaacctacttggtcaggatggatgattgttttgatgtgttcttgtattccgtttgcaagaattttattgagtatttttgcatcaatattcataagggaaatctacctgaagttctctttctttgttggatctttgtgtggtttaggtatcagagtaattgtggcatcatagaatgaattgggtagagtaccttctctttctattttgtggaatagtttgaggagagttggaattaggtcttctttgaaggtctgatagaactctgcactaaacccatctggtcctgggctatttttggttgggagactcttaatgactgcttctatttctttagggggctttttagatcattaatctgatcctgatttaactttggtacctggtatctgtctaggaagttgtccatttcatccaggttttccagttttgttgagtatagccttttgtagtaggatctgatgacgctttggatttcctcaggttctgttgttatgtctcccttttcatttctgattttgttaattgggatactgttcctgtgccctctagttagtctggctaagggtttatctatcttattgattttctcaaaacaaacaacaacaacaacaacaacaacaacaacaaaaaaaacagctcctggtttggttgattctttttttctttttcttttcgtttttcgatacagtgtttctctgtgtagccctggctgtcctggaactcactatgtagaccaggctggcctccaactcagaaatccacctgcctctgcctcccaagagctgggatcaaaagctacaggcaactaatggctgggaaatgagtgagaaccaggattctctggggacaaccccttgataggttttctgatcccatattgtcagccttgaacacatacatatagacaacattaaatggactcaataagatgtgcttttatgggccggtgagatggctcagccgttaagagcattgactgcttttccgatggtcctgagttcaaatcccagcaaccacatggtgcctcacaaccacctgtaatgagatccgacaccctcttctgttgtgtctgatgacagagacagtgtacttatgaataataataaataaatcttttaaaaagattgctttatatatgcatatgcatgtatatacacatatgtgtgcatgtataaaaataataataaagaggctatgagtttgaatgtgaggaacagaggagttcaaaggagtgaaaaatatgcaaatacagtatttgtgtgaaattctaaaaaaaaaaaaaaaaaccaaagttaaaaaaaaaaacagatcagtagggatactggactcacaatacatgcatatacatagaacaaaaagaagtctttttttcaagttaaacatagaactggtatatatttcaggaattctaagtatatgcacaaaagggaatggaatgagaacgatgaatagatattttctacattattcgccaatattgtttataatagccagaaaatgtgaacatctgcaatgttcatcaacaattgaatagaaaagcaaaggttgctggcaagatgactcagcagttaagagcactgactgctcttctgaaagtcctgagttcagaaatcccagcaaccacatggtggttcacaagcacccgtaatgagatctgacgccctcttctggcgtgtctgaagacagtgtacttatgtgtaataataaataaatctttaaaaaaaagaaaagaaaagaaaagaaaagaaaaggtggcatatacagggggtggaatatgtgacctgggagggaaactttaatatgtgctattataagtatgaactttgaagatactgtgctgattgaaataaaccaattagttataaaagaaaaggattctagtcaatatcagatattttgagtagtcaaattcatagatgcaaagtagaaatttgttgtcagagactgggaggagaaggaaccttagtgtttaatgggtgtggagtttcagtttggagacatgaaatagtctggagaggtgaatagcggtggcatttacacaatgatatattcaaaggaagttactaaactgtacacttaaaatattaaaatgataaattttatgttacacataaaataatactatcaaaggccctcatgatggtaaaagcacttgtcacttaagcctgataacttgagtttgatcctagaaactctaagtgagttcagtctcagacccaaaggattgagcaccaactcacaaaggttgccctgtggcctccatgtgtgtcatgtcatgagtgtgcatgcacacatacacaacatatacaataaataatcattaagatcttactaacaagaattcgtgaataaaactggttttgctattaatcctagagcaaatatgagagttattcagtggaacttggaatatggccaaggcattgagcattctctggtctgttcctttacaagttgaagcaactctgaaaatgtaatgtttgtgtgtgggggtgtgtggttaataggtaaaactcttcccttataatcatgaggacttggcgtctttgattccctgaatatatatgaaattgtcaggaatggtatgcatgcttacgatcccaacagtgaggtgcagctcactcactgttaagcaagtctagcctaattggtggattctccgtcagtgagagacccaagctggaaaggagatgaattacattgatgaggatgacacctgaagggttccacttgcctgcatatacttacacatgttcgtgagaaggttcatgtccgtgcagttaacaaatcaagtacttataaaaatatagtgtagccaaaatcatgtagtaggggttctctcagtagtgacaagaaagaatagtcaacatatcttggaggtaaacagttttagaacaatatgtgaagtatttttcccctctgatgaaggaaaaatttatgtcagtgaatgaacaattcccttattgtaccttaaacaatatttaatgtagttttctatttatatataatatatagttatatatgtatatagtttatttaacacagatatggattgcgaggtagattctgattttagaaagctaaactgtaaaaggaagacatctcaaactgaaggaaatgaggtggttgtgagtctatgcatatatgtacattgtattatctgtattaataaatactgctttaatttgtacactaagaatttcctgatcgtttctcaattctgtgtcaggatgcaacagtagaatgaaactcagtggacgaccctacaggctcatgggtgtgcttggaacatcaaaactttatgacattcgcaaaactatctttactttcactccacaggtgagtgggataagctgtaaaattcatagagatgaatggaaatgagagagagagggagggggaggggagagggagagggagagagaatgagaacacagatcacagaagcaaagcatttgctagaattggattagtcagagtcccacagggccttgcatatcttaaatggctcaataagtgtttgttgaattgaaccaaattgaacttgcagcatagaaaattgccaagtgactgttattaccaacagtagtcccgggtggtaaattgtgtttgggattttctaaatgttcaggtccttacacagtttttcttattttttggaagttaaatgaagactgtatttatcctttataagtgaaacacagtcgttttatttaagtgctaaattaagtttttcctgtggggaaggagccctttcatttgcatagaaaacttcagtgccctttaaagaaaaagatcaggactgttaagctgtaattatacatattggcggcctgacatttgttagctacataataatagatctaagttcaattgcacgtgggtatggtagtagaaatgattttctggtgccacatgcttgtaatcccagcacttaggagggtgaggcaagagacttgtgttcagagcctccaacctgagcaacatggttagcaaggtcattatgaactccacaggagtattctgtctcacccaagagctgaagctcgagctcagggctgagtattccctaagtatgtgctaggaccagggtttagctctagcaccacagtgaatattttctgaaaggaaaatttaagtaccttgtcatatctaaaacagtgcagctgagacaaacataaaaaatgatgaagtgactctagactcatatttctgatttttccatttgctaatgagatgtgtgtgctagttcatatactgtctctgagtctttttcttcatattaaaagaaaaacagcaagttgggaatagtggtgaatgcctgtaacccaggactcaggaattctcaagcagggggttatgagttcaaaccagcttaggctgcaaaatgagaaactagggagaaaaagaaaagggaaggaggagctgcctacactaggtggttataggattaaatgaaattacatatttgaacagatttctaggcactcacacacttcaaaattatcagaaactattgtgcctactattggccaacatgtactttagaaattattagccactaaatttgagagtactgggttttttttttctgtgatatgtatgccttataaataaatgaacattgaaaaatattatttgatatttgtgagagcaaaacttcctgaacgatggtttttttcttttctcagtttatagaccagcaacagttctacctggctctggacaaccagatgatagtagaaatgctcagaacagacctttcctacctctgtagccgctggaggatgacaggccagcccacgatcactttccctatctcgcacaccatgcttggtaagggctgaataaagcaggaaagtaagtcacatgtgtagttagttcttcagtgtcccactgtagagctacttcttacagtagtactcaccagttttctaaactctgcacagagtgggtgataggcaggtatggtttctgctctatttaagcttatgtttcaggaagtgaagacagtaagtatgaaacaaatggatacctaagaatatatagctttgagagaataaatagctttccagaatgatttttgaggcacttttccaaaaaaactgtattctacaattcttcttaaagacagtactagtacacctacatctattttatcccagtggatcatcaagatttctagggaagttcccaagttctctcgggaagcttgtcttagggaaacaggaaggtctagcatggggaaagtgcaaaggctttcggtttgtactaggggcaaggagaggtgcttcctcacaaggaaagactctagtgttctgagctcctgcaggattaaaagacagaggctgtttctttctttctgtgtctctgctgttgcttccaaaggactgcatgtactgccaaagtgcataaaattctgtttcattaaaaagaaccatttatcatgaatcatttaaaatccagacagactgggaagaattttggtcgcatctgaaaagggcttaaaaattagaagagaaaaagagctgagaaagtagggtagtctttgttctttttgtctttttcccttacttgagatgattaacaagtgtctgtttaataatgaatatattctcacaattgtcttcaaatagtacacagtctaatttagaaggcaaagttaatggatgatgatgatgatgatgatgatgatgatgatgataataataataataataataataatagaagacaaattcaagacagtagattaggaagtactgaagcactgaaggttaccacagtgccaaagaaaaaattcagctgatgtgagacttaagtttttggaattgcttttatttttttctttttaacaagattttaatatatgtgagggtacatatatgtccacagagatcaaaagagggcattgataataagccaactgaagccaaattaaagtataaaggcaggtttattgggggcagctgatctcacagggggaggtcagggaagtttgccccacagacaggaaaacagaaaaggggatggggtgcagagagagaaagtgcactagcactacaaaggaaaaatgcagatagaggccaaagtgtctgaagtatataatgaagacctgagcctctggcttggaaacttcagggtagaaggcaaagtatgtcagccaggccttgaacagggattctgggagaacatgaaggccaggtctgctttagtatgttaaatatgcacctccgcgccccttctcctgagtctgaaacccagcaggtatcagatcccctggttttgttaagcacctgatgtggtggtgggtggtggtggtggtttcgagacagggtttctctgtgtaaccctggctgtcctggaactcactctgtagaccaggctggcctcgaactcggaaattcgcctgcctctgcctcccaagtgctgggatcaaaggcgtgcgccaccaccactattaaattgttaatcttcacataggaggaggaaagaagaatgagatctcaactgggtttggggctgccttgagtgaggcctggagagaggaatgagcctgtgtgtgaggctggtgacaaggccaacttgaacatattagagtactatgatgaacaaaactggcaaagtaaggtaggctcaggttatgaagacatacttcgaaaatcagcagagagatttaaaacaagttatattagaagttacataagaggttgaagctttccaaagtttttgagtaaggagtgatgtggggagaccctgccaacttgttcagatgctcctctgagctctgcataaaaatggaggatttcctttaccagctggccttgccctgtctggggaacctgaccctccccccactgtctccctgcagaacgttgggtgtagccttgttgagattacatgtttaagcttcctttctcccaataagaacctgtccaacaactacctgaaattcttggaatgcctctccaggcaaacaaggcattcttcagtatgcaaactctagctaatgaaacttactcaccctgaaaaccctgcccccttcaaaagaaccaaaaaacctgatataccacttgatttagtccaaataaagttaggctttctctttgaagataattgtcctcatggctggtggccaacaacctctggggagaagggaggaccacagaatgacatgaaacaagttgtatttagtagattttagttgttgacaatagttctgttgtcacagtacactaacatcaagaaaacaagtgaccatgtgaggtgaggagataatattctgcattggtggtattgaaaattgaagaaagatgatacaaagccattttgctttgttctgtttgatgtttcctttcttttcttttgctctttaattcttttgacgcagaattctactctatggccctggctggctacaatctcactaagatgatttgaactcatagcagtcttcctgctgtagcctcccaaatgctaagatcacagccatttgccactatatcaagctattttattccatgtgtttattcttgttttgcttgatttacatatggatgtttgtaaatatttatatatttatttatttgttgtatgtgcacatacacaggcatgtagtggctcttgtgtggaagtcagagaacagtttgcagaaattgggcctctccctctatcatgtgggttccttggatcaaactcaggttatcagtgttggcagcaagtgcttttacccgttatgccatctcactttctcagtttgatttctgagactaggtcttatatagtataagctgtcatcaaacatgatatatagcaaaggttggctttgaactcctgatcttcctatatctacctctcaagtactgaaattacagatgtgcaccactatgcctggcttttattggtttttgttattttgttttgtgttttgaagcaaagtctcacaatatactcaggctattgtggagctcattatataaatcagcctggccttgaactcatggtcctcctgcctctgcatcctgagtgctgtcagaaagaacaaattggaaaaggcaaatcacaagattatcatcagtttcataaaaaggaggtaattagtacccttctaaaggattttaagtgtatatatacacattcacacatacatttgcacacaccaaggctcattgtgagtgataccatctatgagatacttatcataatgataatcccaatgatgcaaggcgaacagacactgacccatatcatcatggtcagattaatgaaagcaagcaattaattaaagcaagctctttttattcatgtgaataggctgcctccccctaaagtgtggtttaagaggtcagccttggacatgggcaaggtatggcttttatcagggataggaggtttccaaatgggggttttgacagactaataggcggggttacaggaacagcataacaaagtagtcataacagccttttgaaacaaaggtaaggttgcacgatggtcataacaactttttgaaacaaaaacatgattgcaatgtcctggaacaggcagtacaaacccatttgtagttaaggttataggtgggtgggcatagtccagtccttgagaaacaaagatttgattataaacaggaagtaacctagtttacctttaatataagataactttcaagcctaagatggaggtgggctggttcatcaatagtatgtgtcataaacatttggtaaatagtgctgggtacttgtgataaacaagataattcctttgaagaacgtaatctttaccacttgtccattctacagcgatgttgattctcacattaatagttgaagcacagagtacctgtacgatgttagtttgaaataattgaaatatttccccttagttctaagataaaatgacaaataattgttttttttttaaatctttccttttaaagatgaagatggaaccagcttgaattcaagtatcttggcagcactccgaaaaatgcaggatggctattttggtggggccaggtaattgacatatatatataccctgaaccaggagagatggagcacaagaaactgtcagtaatgcttagccctacttataatatgagaaagttaaatttagatccaaatagatgctgaaacaacacatacaaatataagaattcactgcagtctttcccaagacatcattcctgaaagcacttgaggtgggttagtcattatgaacgatatgctctcagttttagtgctgttcaccaagtgtcttcagatccttttggtgggtcaaaaatggggtcttacatctggcccagggcttgggccactggatgaggtggattcagggagtttgactgcggcacccccacaaaactgcaggtcaggtgtcgggctatgtgaagccacaggacccctttccagatatggggaaggcacagtctgaggtccccgtggacctgccggagtggagtagggagttgggctcagactctcaggtaacacagatgctgctgggtaccacaaaagagccggttcgggggtccctgggctgcaagaaggccagggacttcaggttctgggtctttgacaccacagacactgctggatgtctcagaagagctgagaacagagcgggggagggggcacaggcagactctggcccagagcctgaagggaaaaggggcagggaggagagctttggctgggttccttagggaggaaagtccttggcttgctcattggtggcttgggttgtgactggagtgcagggaggcctcccagtgggaggttagatacatggcttgttaggggaagacctgctccattgctcctgcatggtggatcccaatgaaaagaggcagtccatagttttaaggcatttattgtagaaaatcagagagggggagagagtagagaagcagaggtgagccatggccacatggagagaggggcaaagggaaggcagagacagggagagcaagggagcaagagtaagagcaagagaataagaggataagagagggaggagggggcaaacagctccttttatagtgggcctggcctacctggctgttgccaggtaactgtggggaggagcatacctggctgttgccaggtaactgtgggggtggagtccagacagaataccaggagcttggggcattgcctacatgactgatggccacacatgcctctctgcctggtgggggcaggagggtctttgggaggctgtagccggaacaggagccagggtcccaggaggtgtggctgaacacctgcagtcccttagcatcaccagggttcaaggtctgtgtttgaccaggaccaggctgtctgtgcacagctcactgccctataccttttctcaaaagtctttgagcaaatggtgctggcttccattgattcttgcatgcaagacttattactaagtcttgcgcgcgcccaactggccaggaagaacgacgctgcaacaggatccttctgcacacgtttattcagtcctgtttcttcttgtttatatctcccttgtttatatctcccttgtttatacctcccccgaaccctgggcctctcactcttttatactctcagttcccatccacgcacagcaggccacgccacttcaccaggcacgcagcttcagctaatcagggcagcaggggcatatctccatcaaaatggattcgccggtatcctggtacacctgcgcagctctcaagatgtttgtggcttatatgaggaagtcaggtgcaagtcatacgacttagctgcagtccctagcgcctttgggactgccgccacacccgttccccacatctccgttataaaatagtcttctagaaatttgtctgcatatatacatatatataaaccaaggttcatttgacagtgtttctatcactttgtgtacatctagaattagaattcttatataaaaaaacttattttgtggcttatgattaatatatattctttggattcttattttattcaacatgtcatggcccattcttttttttttttttttatattttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccgttgggagccctatgatccatccattagctgactgtgagcatccacttctgtgtttgctgggccccggaatagtctcacaagagacagctacatctgcgtcctttcaataaaatcttgctagtgtatgcaatggtgtcagcgtttggatgctgattatggggtggatccctggctatggcagtctctccatggtccatcctttcatctcagctccaaactccgtctctgtaactccttccatgggtgttttgttcccaaatctaaggaggggcatagtgtccacacttcagtcttcattctccttgagtttcatgtgtttagcaaattatatcttatatcttgggtatcctaggtttggggctaatatccacttatcagtgaatacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctaggttctttccagcttctggctattataaataaggctgctatgaacatagtggagcatgtgtccttcttacctgttggggcatcttctggatatatgcccaggagaggtattgctggatcctccggtagtactatgtccagttttctgaggaaccgccagactgatttccagagtggttgtacaagcctgcactcccaccaacaatggaggagtgttcctctttctccacatcctcgccagcatctgctgtcacctgaatttttgatcttagccattctgactggtgtgaggtggaatctcagggttgttttgatttgcatttccctgatgattaaggatgttgaacattttttcaagtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcgattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctggatcttcaattctattccattggtctacttgtctgtctctataccagtaccatgcagtttttatcacaattgttctgtagtaaagctttaggtctggcatggtgattccgccagaagttcttttatccttgagaagactttttgctatcctaggttttttgttattccagacaaatttgcaaattgctccttccaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagtttttatcatacagatctttcacctccttagttagagtcacgccaagatattttatattatttgtgactattgagaagggtgttgtttccctaatttctttctcagcctgtttattctttgtatagagaaaggccattgacttgtttgagtttattttatatccagctacttcaccgaagctgtttatcaggtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccaaaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattgaggatttttgcatcgatattcataagagaaattggtctgaagttctctatctttgttggatctttctgtggtttaggtatcagagtaatagtggcttcataaaatgagttgggtagagtaccttctacttctattttgtgaaatagtttgtgcagaattggaattagatcttctttgaaggtctgatagaactctgcactaaacccatctggtcctgggctttttttggttgggagactattaataactgcttctatttctttaggtgatatgggactgtttagatggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttgattctttgaatagttcttcttgtttccacttggttgatttcacccctgagtttgattatttcctgccgtctactcctcttgggtgaatttgcttcctttttttctagggcttttagatgtgttgtcgagctgctagtatgtgctgtctcccgtttcttcttggaggcactcagcgctatgagtttccctcttagaaatgctttcattgtgtcccataggtttgggtacgttgtggcttcattttcattaaactctaaaaagtctttaatttctttctttattccttccttgaccaaggtatcattgagaagagtgttattcagtttccacgtgaatgttggctttccattatttatgttgttattgaagatcagtcttaggccatggtggtctgataggatacatgggacaatttcaatatttttgtatctattgaggcctgttttgtgaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctgtttccacgatctgtcctttgaagaaagtggtgtgttgaagtctcccactattattgtgtgaggtgcaatgtatgctttgagctttactaaagtgtctctaatgaatgtggctgcccttgcatttggtgcgtagatattcagaattgagagttcctcttggaggattttacctttgatgagtatgaagtgtccctccttgtcttttttgataaatttgggttggaagtcgattttatccgatattaaaatggctactccagctcgtttcttcagtccatttgcttggaaaattgttttccagcctttcactctgaggtagtgtctgtctttttccctgagatgggtttcctgtaagcagcagaatgttgggtcctgtttgtgtagccagtctgttagtctatgtctttttattggggaattgagcccattgatattaagagatattaaggaaaagtaattgttgctcccttttatttttgttgttagagttggcattctgttcttgtggctgtcttctttttggtttgttgaatgattactttcttggttgttctagggcgtgatttccgtccttgtattgcttcttttctgttattatcctttgaagggctggattcgtggaaagatattgtgtgaacttggttttgtcgtggaatactttggtttctccatctatggtaattgagagtttggccgggtatagtagcctgggctggcatttgtgttctcttagtgtctgtataacatctgtccaggctcttctggctttcatagtctctggtgaaaagtctggtgtaattctgataggccttcctttatatgttacttgacctttctcccttactgcttttaatattctatctttatttagtgcatttgttgttctgattattatgtgtcgggaggaatttcttttctggtccagtctatttggagttctgtatgcttcttgtatgatcatgggcatctctttttttatgtttgggaagttttcttctattattttgttgaagatattagctggccctttaagttgaaaatcttcattctcatcaattcctattatccgtaggtttggtcttctcattgtgtcctggattacctggatgttttgagttaggatccttttgcattttgtattttctttgactgttgtgtcgatgttctctatggaatcttctgcacctgagattctctcttccatttcttgtattctgttgctgatgctcgcatctatggttccagatctctttcctagggtttctatctccagcgttgcctcgctttgggttttctttattgtgtctacttccccttttagttctagtatggttttgttcatttccatcacctgtttggctgtgttttcctgcttttctttaagagcctgtaactctttagcagtgctctcctgtaaatctttaagtgacttatgaaagtccttcttgatgtcctctatcatcatcatgagaaatgtttttaaatctgggtctagattttcggttgtgttggggtgcccaggactaggtggggtgggagtgctgcgttctgatgatggtgagtggtcttgatttctgttagtaggattcttacgtttgcctttcgccatctggtaatctctgaagctagctgttttagttgtcactgttaagagcttgttcttcaggtgactctgttagcctctatgagcagacctggagggtagcactctccttagtttcagtgggcagagtattctctgcaggcaagctctcttcttgcaaggcaggtacccagatatctggtgttcgaaccagactcctggcagaagttgtgttccactcactagaggtcttaggatcacgtgtggaatcctgtgtgggcccttgcgggtgtcaggcgactcagctggcaaggtagccggggctcgagtggagtggaaggggtttgtgccccagatcaagcccgggtagcctgcttccctatgtaccgcagtctcaagttccacgcgattggattggggcaggcactgtgatccactcaccagaggtcttagggtcccgtggggagtcctgtgtggacccttgcgggtgttgggcaagactctgctggcaaggtagcccggggctcgagtcccgagtcgagcggaagggacttgtgccccagatcaggcccgggtagcctgcttccctatgtaccgcagtctcaagttccgcgcaattggattggggcaggcactgtgatccactcaccagaggtcttagggtcccgtggggagtcccgtgtggacccttgcgggtgttgggcaagactctgctggcaaggtagcccggggctcgagtcccgagtcgagcggaagggacttgtgccccagatcaggcccgggtagcctgcttccctatgtaccgcagtctcgagttccgcgcgattggattggggcaggcactgtgatccactcaccagaggtcttagggtcccgtggggagtcctgtgtggacccttgcgggtgttgggcaagactctgctggcaaggtagcccggggctcgagtcccgagtcgagcggaagggacttgtcatggcccattcttgtcattatttcttttatttttcaaattatccaaggtctggccattggtagcccctttaagctggcttccttagaaaattaataccactaggcagatctctgagttcaaagccagtctggtctatcaagtaagttccaggagagccagggctacacagagaaaccctgtctcaaaaacagacaaaaaagaaaattagtagtactaacttcatttggagttttggaattggcttattaagtagaaactgatatggctcaacttaatttattacaatgtatataattttcagatactgtcttttatgtccaaaatggtcctttgatagtattttaaaaactttttgagatttctttttatttttcttctatgtgtatgggagttttgcctgcaagtatgtctgtgcattgtgtgtgtgtgcctggtacctacagaggccagcaaacggtatcagatcccttcaaattggagttagagacagttctaagccattatatggttactgggaattaaacccaggtcctttggaagagcagtcagtgctcttaaccacttagcagtctctccagcccgatagtatttttaaaatgatgttatagatttgtgtgatttatcctcattccccatctatgtctctaatagctaatacaggtttttagcagacattcaacatagtgtacagcaatggaagaacatagaaataatctgttggaggactgtaaactttaatttgtggcctttcttttaaaatctccccaacatgcttaaaatatgcttagcattcctttatttacaagtgtggcttatttgttcctctgtttaatttttggagttgagcaaagggttttgttcatgctaggcatgtactttaccaattgagctatactgctaaaattgtgttactttaaaaaagatattctctaagtttctttttttctctgtaccctgtaattgtaaggatccaaacaggtaaattgtcagagtttttgacaacatcttgctgcacacacttaagcttcatggaccctggacctgagggtaagctgtacagtgaagattatgatgaagactatgaagatgatttggactctggcaactggatggacagctatgattcaacaagtaatggtaaggaggctttaaacagcgctgcatggccagacagtaatacaaatgactgtttagcttcattgttaaaattcaggcttccagccatctcatgtgaatcatcctcactcctctttaatacatctagatttctactgttgtttggcttcatttttcttccctctacttctctttggtttctggtctaataactctgtggtgactgattatggagtgtggggttagaatatgccttactaagattggggggggggttctttctttgtagtagctgatgatttgatatgaaagaaacaatggtgagtaaagtttattaaatcagttgtgcagttgaaaatatcatacatacacgtatacaaacatacatgcatttgtatatattacttttggtattaagaataagtaaatatggccgggtgtggtggcacatgcctttaatcccagcactcgggaggcagaggcaggaggatttctgagtttgaggccagcctggtctacagagtgagttccaggacagccagggccgcacagagaaactctgtcttgaaaaaataaaaaataaaaaaataaaataaagaataagtaaatatgaaatttgattagagttattttaaagtttctcataattcaaggtattatattttatgtatcattagaggcatatattggtagttgtgaggtctgtatagtttgaaaaaatctagtcagaatgcctgttgctttatgtgacacactagacaaataatgtgtatttaataagtgctaaagatatgaacatagtgccatgagaaagcactctgatagcatgtatttaaaatgactgagaaacactgactggggtgtcaaagtactgacctatgcaagtcaagaattacattgtttgaatccccataagagaatggtcaataagagaatgattcttctaactatctaaattttggtggacctgtttttgttgtctgggtatttgactgttagcatctatcttaagatactaacaaacataatctcatatataataaaagccaacacattagaagtactaagtactacttttttttatttgcactcaacatttactatatatccctctttgtttgcttagtgtttctttttttttttaataaaccattttttaacttaaatggaactgatatctctttactcaagtatttggattatattgaagattaagatacctgtcactgggatgccattgaatatgagttctagttgtgcagctctgctagtttccactagtcacattggatcactgagggacttctggagaggtcactggagattgcccagaacctgatgatgcatgactttggtactgatcccagcaccatgtttctctaactataacattacagatgcttataagctatgacatttccattatctgaattcagagatgattctaggtgggtccagcctttggacagggtggcatgatgtcattatctacaaagttcatgctcaagaattataccatagagttacagaaaaaaaccctcatattttgagtaagttcataattttatatcaggccttattcatagctttccttggcttcatgaagccatggggctggagatccttgtaagatggatacctgtaagagagtgagtccaagagaatacagaggatatatactttctataacaattctcagtgccttggacactgcctgttctatagtaacaacacatatttggtgaataaataagtaaataaatattgactaaaaggcagtttgtggtcgatagtcctatttcaccaatagcatataaagacgctttttggctagtgattagaactattgtttgtacattctgtttacaactaactcagtatttggtggaagatttttgccctttcctggccttcaccaaaatgtcttctacttgtgggacttgaaggggcctgtcctgctccttctccactgttgtcccccttctgccaccactgttgtcacacagaaataatgaaatacttgctctgcttgttctgaaacaaactcatactgcttttagctttcagtaacttttcctgtgtcccagaacagtggaagagcaggtggttcccggaaaatggccataacctctaactctcaatctgtgaggttgtataatgatcggaagctcgttttcctccatgagctaagaacagagtgcttctgacagtgttttaggtacaagagccagtcgttctgactgctgggctagattttgaaataactaaaatgttccttttttgtctcttcccctttcccaactaaccttgcagctcgctgtggtgatgaagttgcccgttatttagaccgccttttggcacacactgttccccatcctaaactagctcctacctcacggaagggagggctagatcggttccgagctgctgtgcaaacaacttgcgacttaatgtccttggtggccaaggccaaggagctgcatatacagagtgagtaatgccattagtccctagtgtcagacacaaggtggcatgaagcccaagttgggggcaggacattgattacatcataagcaggaagttgggattattcactgctttgttcctggcctcttgggcagcacctagaattttgtaggcactcaaatgcttatgaagtcaaggaattagatagagtcatgatatggatattgtcacataatctggtgtaaccaggaaaacagcacgacacagaacaaaagagtatattcaattttaatataggagtaagatgtggaagaatctggaataattacttctttggcagtaattttatttaaagagaaagcatcattagactactacaaaacaggagggacagacacagagactttctttaagctataactggttctccttttatgcccactataattgtgcacccagttgttctaggcatgctgtctcagatagaaaactcattcttctcagtattgccacagtcctctccataaccagtaccctcctttagtagtgttttcagaggaggacaccttctgaatatttgaatagtagccatggttcctaaacttgttcagtatttctatggttgctacatgtggagggagagaagggctccttggccacacctacatgactttaatgttacattatataaggatgagaatgattgagatgcatgttcttgctacctaaatcttcattgaccgttactaaccagatactaaaagtgagcacaagggtattgtttaacattgagaatagggaaaagcttagtgtacccattggttatgttccgtatagaaagggtttatgcaaggacatgaactttaagttcattaagttgcatttatcatttgtgaattagaaaaccagaatttaatttccagaagtgttatttacttgtttggctagttatagctctgagtagtctctgtataaaatggtgaaaatgacatgcagctctctccttggaggttatggtaagtattttaactatgtaagtaaaacatctttggaacatctcaaagttcatcagccactacttgtttttgattccctagatagatttcatccagtcccaacctctacaagtcaaatattagcctaggaaagcccagaaaaagtaaaatgtaacagagttctttgtctatgtgttttattatatgaaaatatcattgatagcatctttttgatagtgatcatattactaaacataacatcccatgtctagttgatggtacaattaaagaaaatcctttcaaaatcatagaaatagtcactgattattttaaaaattatttaatatcttacatttctttttttgaagtcagtgaaggaagttcgcatcatttctcttctgtaaagaaatagcccgtgtgttaccttcttgctgctgtcagcgatggatgggttttaggactttcctacagatcttaacttttcccgtaaatgtcaacttcttgcagatgttcacatgtatcttcctacaaagttatttcagccttctcgtccttcactcaacttacttgactcccctgagtctccacaagatagccaggtaactgtgcacatatttctgtaagctttttgtaaaactctgtcatttttattggacataatacaactagccagtatgatttctggtgttaaacaaaacagtatcaaatgaaatgcatgccttttaaaggttactctttaagtaggcaaggttttcttcttggactttgagaaaactacttagctctatcatagggcttgttggttttgttggtttggccttgcttttcatcaacagttttggggagaaaaattgaggcagagtcataggtaacccagactggccttaaaagttactatgtagatgaggatgtcctggaattcctgatcctattgccttggtctcccaaatgctagggttacagttgtgtactagcacatctggggagcatttagaaaattcttatagaaaaggtttccaggtggaaagataactcattctagggcatcatctacttaagcactgttaacctagtttcttttcatcattgcttattccaaaggttccttccgttcatgtagaagtgcatcttcctagggaccagtctggggaagtggacttccagtcattggtttcacagttgaaggagacctcaagcttacaggagcaagctgatatactctacatgctgtattcaatgaagtaagtgatggatattattgatatactttaaggtacatattgtgaggacatataacatgttagtaagctttctatactataacaaatacctgggataatcagtttaacaaaagaaaatgtttatttaaagctcaattgcttattttagtacttatatttttaaaatattttattatgtatatacgtgttttgcttgcatgtatgtctacgcactccaaggccagaagcgagtgccaaatctcctggaactgaagttatagatggctgtgagccaccatgttggtgctgggatctgaaccctggtcccctggaagagcagccaaatgcttgtaactgctgaacaaactctaccctaacttgtcttcattttattgtttttttttctgtttcaaactcaagttttaacatagttcagaaaaatattttgttgattgtaaggagggtacaacaaagaatttaacagtttgtattttcttctacagaatgatcatgtttctactcatgtttaatatagttttgtactatggtagatacatagctctcctgaattatttattattcaagggttaagggtttaaaaatcctctaaataataacctgaattttattgttgattattttagctatataaaattgctctttttttcatatgaaaaaaaaaaaaaagaaacaggttttattttggtagtttcattccatgattagttgtccctattgctttggggtctgtaatgacataccagattatggcagcagcagaggctaaaccattcatctaataactggtttgcaagagggaaaaagtaatagaacagtgtcctagtatctgctgcctagtgggtcaagagtttaggcactgagtgagggtcagcagggtcagaggccgcatcgggaatggaaactgagtgaccctttccctctctagggtgatacaggaaaaagcctcatggggagccaccctctttcagcagtgataggacactcctgcatatcaagggcaagctgaatggggaagctacagttcatctccagaaagcaatagtaaggcagcatccctttccctagtagtacattatcagaaaaggcctgctgggatggggttagtaagttctacattattctaacatactatacagagtccagggtaccagggaaaattgattgtcaccaagaaccaggaattcctcatcttgaatgtgcaaaaggaattgatagaggcagcagagataaggcagatgctaggattaaacaagaaagcttgtagagggactattaaaatgcttcaacaaataattataaataccccagaaacaaatgaaaaacaaaatacagtgaagtctcagtaaagaagtagaaagcacaaaggaatcctaaatggaaattttaaaaattaaaaatacaaatctacacactggtctttttaatgtgctcattttaacaagttcattgcctgttgaaaattctcctatttgtttctcttaatcaaaagcaaaaaagcttaagagttagtatagcatacagaagcctctatgataaagttcctgcctgcttctggacccctcttccaccatcctgttgttctgcaattgggggtgtagcaataccatgccatttctcacatctctgctctcccttctttcccttctctcccttctcctcctcctcccccttctcctctcccctgtccctccatagatgtgatccccatttactcgcaaatattcattccggctctattttctaaaacctgtaaaccttttgcataagcagagtagaatgattaaaatttattctatctgtggggaccttcttgtcttccttcttcaggctgattgacaggttctgacatagccttaaagaagctagcttgaaacctgtcctcttctgaaccgctggttccttaggcagccatctaccatagtacacgtgactgttgctgtattgttttgctattttcatgcatttatctcacccctcaacatgaaacaccttgagttcagggacattcttttatttatttaagctgcagtgcctgctacgtgtaagtattttggacaaatgaatgaacacccttattcagtcctcatactttttaatgaggggggttacttagtagtaagtacaaagccctgggtttagctcctagcacagaaaaaaaaacaaaaaacaaaaaaagagggacttattaaaatgagaaattcagtacctacatttattataaatgtagaaatcagtttggaaaggtggatcaatttagtcaaggtcacacagctagggaaatagatcagatgagaagcattttttttacctaacattatttaatgagaaagtaaaaacacaaagatattcctattatctgaaacttcacatgctgtttttacagtgctcaggatcaaactgaggacttgttcatgcaaggcaaatcatctatgtggagctgccccctgaggccttggctcttacattttcccattgctaagcttcaacaactgttaagcaaatctgactgttataaagactgactttgacaagtcaagatatgatttaaaagccatgcatcctaaagtcatgaagttgtacttaagacagtaatagtcccatattaagctagttgcaaatcaaaagaattactaaccaggtactttggcatttacctctaatcgcagcacttaggaggttgaggcaggaatatttcaagttaaaagccagcctgagcaatatagccagaccccatgtcaaataaacagtaaaaaataaaataaaataaaaataacccccaaaagtcatattttcagtcatgttgggctgtcctggtctttatacacccccccaccttacttgttagcaataactaaggtgtgagccatgaattttttctctcagaaatagccagtcagatctcctccaaggctgctgagggatatcatcctatgtccccaactccctgctccctttgagagttcccttgccttatgctcttctgggggacagaacttgagccaaaattctttgcatacccagtcactacttgctagaattctctccaccattaaaacctacttcatcagtcactcccatggtgccatgtctggtttctaataataagcagataatagattatgagatatcaccaaacctttttcacatcttaaacttattttgacaatttcagagttagaggaaagttgtaaatatagatagaacaagatatttggatatcctttattcggatcccgcaaatgtttccacccagcttgtctctgtatctctgtccatctctggttcttcttcctcctctctcttctcttcacttgtcactctgctctattctctctctcttcctctccccatccttctctcccttctcctcctctcccctgccccttcatagatgtgatccccattaactcctaaatattcattcaggctctattttctaaaacctgtaatcctcaaatcagaaaatttaagcaatgctatcatcaatttgtatgaattgtaaaaacaaaatcttaaattgcgtgttttatttagttctcatgtgtcctgtgtcttcactgatctggaacagttccaaaattaagataactaggaccatttgtttctaaatgaccctaccttttgggtttgggacattcctccctaagtagaatcgagtgatgcatttttattttctgcaggcctgctacttaagttcctttctgtgaaagcactgccagtggcactgctgatgctgttgcttttcatcacttgacttgatcctttattaaggaagtaccttccagtttacttcctttgcaattaagaacattctctgaagatagatacacttttgagcctatataagtagcctttactttttaaaacttgcaattgctcattttgtacccatttgactttttaggcacttcttatttcatgttttttaaagttgatatttgaatagataataattcttacaggtcaacttttttggatttacgttattttatgtgaatgattatatgagtttttgcctgaatgcatgcatgtatgcatgtgcatacctggtgcttgcagaagtcagaagaaggcatcatgtctcctggaactggaattctggatggttgtaagccattatgtgggtgtgaaaaactgaacccctattctctgtgagggcaatacatgctcttaactactgagccttgtctccagagcctaattttcaaaatatatagtgaaaaggtcaaatattttccctacctgtttctgaatacccaaatttttcatgggcaacgttatttttgtttgtgtattctcctaggtacgctctatacatgtatatgtaaatatagacatatatgtggatatttgtagccctatgtgcccaaagttagcataataatagattgttctatactctttatcactaatactgtatatcttaaagatcactgcatatatattccagttacctattgattcatttttaaaaaattcaccttaacacccagtggcttgagcaggaggatagcatgataagaatgtacaactttaacagttcttggattgagtggtcttgacgaggcagttcttgcccaaggtctctcatttggtttttgtcagacactgattcatgaatgaagatagccaaggtttgctcactcacgtactcaagagtagatacaggctgttaactccagtcccattacctacatctctaataccttcaaatcctcacagcatgatgacaaggggctcttagagtgtcacaagagaagacaaggtgaaaactgtatttaaaactaacttagcagcagaaattacttagtccctcttttaccctagtcacaagcatacatggtgtctgctgtttttgtttggttggtttggtgtttgtgttaggcccagttttccagaaacacaggagacctccagagatcaggacactgaggcaaacactcaaaagtctttattccaagtccgaacttgggacacaaccttccctgctctgcaggttaggaatgcaacacccaggtctaggggctcagggtttatatataggagatgcatacgctggggctttcaagccttggcgttacatgattgtgtgaggggtaaagcaatgatacccttgaaaatcaatcacatctcttcagacaaggagggaccgtacatctgcaaaaggacctttttgacctgggatgaaatgactcattttgttatcagtgaccagtgcatttttacaagccggccacagctgtctgggactgtttggttgtctctttcccatagcttaagagtgggaccttatcacttcaagggcattaattttctgcctccttcaaaggcaggagacatgtgcacagggtggggatggggagtcctggctgtttaactagcactaggactaacacagaagggagtgctaaactcggtgccaagggctaacacagagatgagggcaggctgcaagaacaggctgtcttttgtctctttatttgtgtcaacttaacctgagctagagttacctgagaagggaaaggaacctcagctgagaaaacactttcatcagatttgcctgtaggcacgtctgtaggatattttattgatttataattggtgtggaaggacccagctcagtgtgagcagtgtcactcctgggcacatagtccctagctatataagaaagtaagcagagcaagctatgaagagcaagccagtaaatggcactcctccatgatctctgcttcagttcctgtcttgacttccctcaatgatgaattgttacctatacatctaaaatgaactaaaccctttcccccacaagctgcttttggtcatggtttttatcacagcaacagaaagctaattaaggcaactggatttaaagggagggctgagggaagaagtgtaagaattacattgtaagaagagcatattgaatgaaaaattgttgatggacatttcagaaatatgatctgatagtacataaatctaccttacatttctccttttctctttgaatttttattagtgtatgttaattatatactgtagattttatatgtcgttttcacacatgcatataatgtattttgactatacacaccccaacctcttaccttcctttgccccttgcctgctaatcctatcctttttcccaactagtccccttactcttccatgttttatgtttttgtttttttttttttgagacagggtctcagtatgtagccctggctagtcaggagctttctatgtagattagtctggtcttgaactcagagatatctccctacttctgcttcttgaatgctggggttaaagggggaggtgtgcactgtgctcagctcttccatgtctttttgttgatgacccagtaaattatattaggactgcttgtaggagcatcggtacctgccttgccttacctcgcctcgcccgcctctccttttcttccttccttccttccttccttccttccttccttccttcctttctctatctctatctctctctctctctctctcttttctttttttctttcttccttccttcctttctttctttcttttttggggttgtttgttttcaagacctttcttagccctggctctcttagaactagttctgtagaccaggctggccttgaactcacagagatctgtctgcctctgcctcccagtgctgggattaaaaacatgtgttacagcttgtacaaccactctggaaagtagtctggcggttccttagaaaattggacatagtactaccggaggatccagcaatacctctcctgggcatatatccagaagatgtcccaaccggtaagaaggacacatgctccactatgttcatagcagccttatttataatagccagaagctggaaagagcccagatgcccctcaacagaggaatggatacagaaaatgtggtacatttacacaatggaatactactcagctattaaaaagaatgaatttatgaaattcctagccaaatggatggacctggagggcatcatcctgagtgaggtaacacaatcacaaaagaactcacataatatgtactcactgctaagtggatattagcccaaaacttaggatacccaagatataagatacaatttgctaaacgcatgaaactcaagaagaatgaagaccaaagtgtggacactgtgccccttcttagaattgagaacaaaacacccatggaaggagttacaaagtttggagctgtgacgaaaggatggaccatctagagactgccatatccagggatccaccccataatcagtttccaaacgctgacaccattgcatacactagcaagattttgctgaaaggacccagatatagctgtctcttgtgagactatgccagggcctagcaaacacagaagtggatgctcacagtcagctattggatggatcacagggctcccaatggaggagctagagaaagtacccaaggagctaaagggatctgcaaccctataggtggaacaacattatgaactaaccagtacccccggagctctggactctagctgcatatgtatcaaaagatggcctagtcggccatcgctggaaagagaggcccattggactcgcaaactttatatgccccagtacaggggaatgccagggccaaaaagtgggaatgggtgggtaggggagtggggggagggtatgggggacttttgggatagcattggaaatgtaatggaggaaaatacgtaataaaaaaaaagatcaggagttcaagaaagaaaaacaaaacaaaacaaaaaaaaccccatgtgttaccatgcccagccttttattttcttaatagatatgttaaaatgtattatttaagtatatcataatttatttggccattttcctaatgatggacatttgggcattttgtagtcactataacaaactgtttatagtaaataacctcttaaccaacattctttcacacacatggaaggaattcatcttacagttaaaccacaacttgaattgattggcagagcaaaatatataggtattttacacaggcttagtggtacatgtctgtaattttggcacttgagagttggaaggcaggagagtccttcggaggtcatccttgactagtatttgcaaggtttgtctccatgctgtagcatatgtcaaaacttcagttcgttgctgtcagatactacttgtatggccggagcacagttcctttattcatcacctgatgggcacttgggtggtttttacttttcagcttttgtgactaatagtggtgtaaatatctgtgtacaagttaacacaaccgtgttttcattttttcttggatacataaccaagagtagaactactgaactgaatggttaactgggaactggtaggaactgctggttgattcctacatccgtgtgtgctgatgtttattctgctcaattttcttttgtctttatctgttagagttctttatctttttagcagaattgatggaggaatttaaaatatttattattttataatttgtcctacactttgcttagttcttttcagtaatacctctttattgttttatttaagtaaatgtattacactactctttatggcttctggtgacgtttcatgcttagaaaatccccttccttccttccttccaacattatgagctaattttcccatgtgtttttttagcactttaatatttatatgtcattacagttagactgtcaggcataggcatatttttttctgatagctacttgatgcttttaacatcatttaataaattatctacatttgtcatataataaattccagatttcagataagtttcttcatctctaggttgatttgtgtaacagtaattcataacagtcatgcatctggatcctttcaacacaaattctaataccatttagttcttaaaatacagtatgctttcacaatttggagtagttaaacctgtttataatttcaaccgtgttgaagcttgggatataggtaaaagaacacattgtttaaaagctaaattacaaaatttgtgtctggacatttagatttcaagattgtcttttttttttttttttttttttggtttttcgagacagggtttctgtgttagtcctagtgctttctttctttctcccccccccccccgagacagggtttctctgtatagccctggctgtcctgggactcactttgtagaccaggctggcctcgaactcagaaatctgcctgcctctgcctcctgagtgctgggattaaaggcatgcaccaccacgcccggctcaagattgactcttaattacagcttttaagagtttttactaaatagttttctactaaaggaggttacaacaagcatatccattataatactaagataaaatatttttctcataattaatatacttccatctttaaaatcccagaggacctgactggaacactgaattgtatgaagaagggggggctactgtcagagagcttcttagtgaactgtatgtcaaagttggtgaaattcggcactggggtctgatccgatatatctctgggatcttacggaagaaagtggaggcacttgatgaggtactaataagttcttggatgtatacataatctaaatggggggtgcacttttaaagttactacgtgctgggagtatagctcagtggtagggtactgtctagcattcctgggatcctgggttcaattctttgcactacatgaggagaaaagcttgattttcctatgttgttgttgtttaaagcaatcacaacttctagggttttttttttttagcacatctataaagtttctggtattcagttagccttttattcgtgagtggcaattatatgttactgaaccacaagaactgcagactataaaggtgttgtaagccagaagagtttgagatcttagtgagtttacactgagctgaaagtctctgccttctagaaggtggaagtgcctcctgatttcttcctggaaatctgtcttctgatcatgtttcatgagaaggagagcttggtgtacggctgtaaattaagggggattaagttttgttggctgacaggaaaaatgtttagaaatatgaaggtttctttttgaaaagggtaagctttgctacctctgcctaggcctgcacagaccttctgtcctaccagaaacacctgacagtaggacttcctccagaacctcgagagaagaccatctctgcgtgagtgggtcatgtggttgggtttgatagagtttctctgcacctttaagaaattgtgtgggcttggcacagttttctcaccctactttgtagaatatcttatatgcaaggctgcagcacaggagaatgacagggtacaggtaagttaaagagagtgtttataggaagtaataatcaaagttttcttactgacttttcctcaatcccccctattattcatttaatgtatgtgagtacactgtagctctcttcagacacaccagaagagggcatcggatcccattacagatggttgtgagccaccatgtggttactgggaattgaactcaggacctctggaatagcagtcagtgcttttaaccgctgagccatctctccagtctcaaattccttaattctacttttttaaacacacacacacatatcccacaccacaccacaccaggagatcaggaattagcaacataaaagacaaccttagtctaaaagagaaatagaagaaagtatgtagttagagcattgggttgctattgatatagctccatgctgctgaagaacaaatcaaaggtgtgcgttttatgtttggtggaggtgtgggggaagggggtgcctctgcaggcccatgctgaggcatgccttccctgtaagggaccagccacatgatggtatagcatagaatagagtttattcagtgcatgggtagggaagttgaaggagtagaggaagagaaaggcagagaggggagagagggagagagaatagaggagtgaaggcctgccatgagcatgtggagagagaagagggaggggaatgggaaggggaaggaacaaaaggactgaacaagagcaagaagacaagagagtgaggagggggcaagcagccccttttatagtgagtcagacatacctggcttgttgccaggtaactgtggggcggagcctagactaaaggtgtgaaggtcaaagctgaaagggaaaatgagcagcagcctgaggtggcatgtctgcaagaacactgtcatcagattgccactggcccagtttactgtagcttctgaatagcagtagtcccctgggatagactgagacaagagggtgaggagtggaagtttaatccctacccatagtagtcacttaccactagccacaccagtaaagtttatctgcactaagtctatctaagttcatgcgatgatagtgccgatatttaaatctacaagcagatggtatttaaaagaaatatttttagaattattctaacttcataagtgatcaaaagtaaatctggttttctatgaaagaattacctaaaaaaaaaaaaaaacagcatgtctccccaactgccagttctactacaataaccagtgtagtaaaaatgtttttttaattgacttatttttttgagacagtattaccatatgttccagtcttgtctgtaacatgcaatccttttacacctcagtccccttattatacgattataggtatgcaccaccatgcctagctagtgagcttaaccagggattgacaagagagaacacttagcagggatgcttcggtggtatctgcagactaccctgtttccagttcatatatataagatttcagctgcctgtaaggtccagtactggatggaggcttagagagacatttgccacagattctatatgtaacgtcttagttatactttaggaaaatagtttggctaactttcttctactgccatgacaaatatcatagactggatgtttaaatgacagcaattgattctggcagttttacagtgtcaacaggattggtttcttctgaaggctgtcaaggacttcattctaggcatcttcttggcttgtatatggctgttttcccctatgtctcctgatattttcccatcctatacatgtctctgtgtccaaaatgtcccatttttataaggacactagtcatattagatcaggaactatcttaataacttcactttaatcacttcttaagagcccacttttcattaaaatccattaaaatctgaggtactaaagatgttgactgaatttcaacatctgagtgatgaaggacacagtttaacctgtaaggccttgcttttagtaaacacaaccttgtatcacaaataagatcacttttgtgtcactagaagcatttcaaaagaatatgccctgacacatgcttgctaagcacaccatgtcaagactggagagatggctcaacagataagattgaattctgctcctacaggacctgtttgtttcctagcacccaagtcagacagctcacaacccattgtaacttcagctccagaggttggggaatgatgtaacacctttgacctctgagggcacctgctacacatccccccccccacatacacacacacaaacttaattaaaataaaatcttatgtcatgtcaatgggagagagtcatagggtttgaccagttgtggtgatatgtggctctaattccaatgctcagaggcctgaggcaagcagataaaaaatgtaatgccagcctgagctacataataaaatcctatttaaaaaaaaaacaaatgactctccccacaaaaatacacaataaaaaggctactcccacaaaagtttgagagtcacaaatatgaatgtgtatatatacctgtgtgtatgtgtgtttgcaactatagctgaactgatggaactatttaaaatatcaatataccggggctggagtgatgcctcagtgattaagagcactgactgttcttccagaggtcctgagttcaaatcccagcaaccacatggtggttcacaaccatctgtaatggaatctgatgccctctcctggtgtgtctgaagacagctacagtgtatgcactttaaataaataaataaatctttaaaaaaataaataaaatatcaatataaccctataagatgtgactataaagtaataaaatggtttccaaaggacacagctgaaagtaaatttctttgtagctattatgcttacttgttccatgttgaagacaaattataaaacactagtctggaaagacattgaagggtgaggtttaatggagtcagagtgggccacagatgtagtgaatgagctttttgttctgatgatgatgggctaaggcagtggcttggacttgtggtgagtttttactctctaaagtctatttaggttacgttattgtagaagttgatctttagtcactgttttcttctctaggcctctaccgtacgaggcactcactaagctgatagatgaagccagtgaaggcgacatgagcatctcaacccttacacaggtgggcagtgattaaagcctagcctggcagttgataagtcactatttgtaactgacctgacgatttacaaaggcaacaaacacactgtgaaacctgtgctaacacttgtttatctccattctttacacaggaaataatggtctatcttgccatgtatatgagaactcagcctggcctctttgcagaaatgttcagacttcgaatcggtttgatcatacaagttatggcaacagaactagcacactctcttcgatgttcaggtatttctttaattcacagtaactagttttaggtggaattcacttctcgtgcagatccttggagtttggaagagacatggaaaggaagatacagagctgtgtgaggcttttttttttctgaatttattggtcactaacaaagggagcaaaaaaaaatggtatattgtgtactggctcagcagcttcaaagatccctcggagactctgcatttcacagtcttcttaactaagtcctttcaactaacttcttcctaacaccttaagggctttggagattgacatactgtgttggattctgactcaaagaaggaagctcctggacaccaagtgtgagtcactcactaaagtgcatcatagtggtagtggtctctcaatatcatgatcaaacaaggaaggaaggattttatcaacgtttttctaacaagactctaaagtatttataggtttatttgtcagcataacaatttcagttgagaaaataattttggcccgaggaagctatacagcagaattgtctcacaggtttatctaccttttgatggtgctttctaaccttgccacctatgactttcacacttgagaaccatgtacttgaatttaaaaaaaaagccaggccacctatgactttcacacttgagaaccatgtacttgaatttaaaaaaaaagccaggcactggtggtgcacacctttaatcccagcattcaggaggcagaggcagacagagctctgagtttaaggccagtctgatccacacagggctatatgctgagcccatgtctccaaaaatatttcaaaaatgtttaaataggtttacaaatttgtatcaggacacatttatagctatatgtgactatgtgtggtctgcacaaggctgtgcctaaagtgtaaagtataaaagagctagagatggcatagaaaatataatcactgtggcaaaactcaaactaaaactcatttcatgtatatttcctaaaatggcattttaacaattatttaattttaattatgtgtatatttgcatgtctgtttatgtgtgcgtatgtgagtacttgttcctatatagttccaaggatatcagatcccctagagctggagttacagatggttgtgttataagccacctgacatggatgctaggaatgaactcgcttataaccacttagccatctctccacttccccacatggctttcaactttcttcttagaggggctggagagatggcttagcaattaagagcactagcttctgttccagaacacatgggtttgaatcctagcacccacatagcaattaacagctctctgaattccagtcccaggggattcattgccctcttctagcttctttaaacactgcatacacacgatacatagacatacatgcagggaaaacaccagtactcataaaataggtagatatgctctacattttttgagatgttccaagtagcccaggtgagcctataaattgtgatccttctgccttcacctctagagtacctggattataggtagtcatcataatgtctggtgcacaaaggcttttaattgatatagatcattcaaaatatatattcacatatatcttcaaggatatatatatccttcaagaagagaaacaataattattttatgactattatttatcagatactgttatttggttttatatttttatgtattatcttatttaatctttataaccacccactagagaatacaatgtaattctgtttctgcaaataaagaaactgaaaatttaaaaaaatgaaagaaagaaagaaagaaagaaagaaagaaagaaagaaagaaagaaagaaaagtattgggtaggacacagaggcagatggagggaaaccttgtctcaaacttttcccccaataaaaatattaaataacctgcccaatgtaacatcaccagtatatagtatatagtagaatttgatgccatgtctgtttgatttcaaatgatttccaatcagtacatttttagaaataaatgttttgcataggattttgcaagtgtggtatcaaggaatgtattttttagagggtttgtgtcctagttaggtctctatcgtggcaataatgtaccatggccaaaagcaacttctggggaggaaaagggtgatttcagcttacaacttgaacatgatgacatgaaggtatgggggaggcagggcaggaactgaagcaggaacctggaggcatgtactaaagcagagtctatagaggagcgctgcttactggcttgctccccatgccttgctcagtttgctttcttacagaattcagaaacacctgcccagggatgacaccacccacagtgacctaggccctcccattatcaatcattaatcaaaaagtgcccccacaggacttgccagagccactccctccattgagggtcccttttcccagatgcttctagctcttactgggttgaccaaaaaactaagcaacacaatataattattcagtaataaacctcagcaatgataaaactctcagtcattctttactgttccttgcctgtaatagtcttcctgttggcatcatcaaaatcgtttgcaggaggtgcttctgagtagctactaactcagtagtgccgcctgcaaactagtttatcaatctctactcttgaagactgatgtcccctctgatttccaaacagtcactgattatattgctcacttaagcagtgctatacaccatattttgttgtttttattttttaattttattttatttctcctgtttacatgttctatctctctaaaattaatggtaaacctttcaatgtcaggtgctgtgtgtcatacttgcttgtactaatatggcttaaaatgatgacctatatgcagttcccttcaaaaaatgactactgttgatgaacacattcaagttctccttagtattcttaataaattcacagactcatctctgtgaataccatatacactgaaagcttttgagtttaactgtgagcatgtacattcattgctattttctgaatgccttccatttctcttgttaactttcattcttttcaccttcaaataaagactgtagggagttatgcaacagtgtggaaacagaatgaagaagaaagtaacgagacagctaatctacaatctaggtagtctgttgtagccgtccagcagccatggacgaaatgggtacctgaaaggggagctggaaataaaaaggacaggatgcgagagaaggatgaagccgagacaaaggttctgatcaaggctccaagtttaatattcatcactgtgtttatatagggagatctcacagacccattctttgtttcagctggtttatgttgcgaagcaaggtcattgggcagtctattcttctaagttcctataggagttgcatgtgcaatcacgtagatcattaagcccattgtggcaagcactcaaggtctgttcagcctgcttccctgccaaggctggggaaggccacagtctgttcttaaatagtaaaaacctagtgttgtatgaacaggcaattatctagtgttagaaatttgttatgtaacccacatcttctaaagtgacttagaaatctgatgaaaggaagtagagggtacaacttccatcatagaggaaaggagagggcacatcggcatgagcagaccaagtgtggtcaccaagttcctgcaattgtgtcacttaacaggctgaggcaggaggatgataggtttaaggctagcctagactgtgtagtgagagcttgtttcaaggagaaaatggaaaacgaggatgtgggaagcaaagttgatttccttctgcctcaatttctgtccattagctgaggaagccacagagggcctgatgaatctcagtccttcagccatgaagaacctcctgcatcacattctcagtggcaaagagtttggagtggaacgaagcggtaagacccacgcactggacttgtacttccgggaactgaattttagtcctcagttttaaaatgttgctctttatcataggagctcttagtccccaaataaatagaactccaataaataaaacatgtaaaagcaaaactatctttggaacaatacttgaaatctaaaagaaaaattcaatttaacagaaggttttggactagggagagggctgatggtttaagtgtttgctgcccatacttgatgagctgagtcagcatctctagtacccacataaatgctgagctcagtaccttatgtctgcaatcccacctcagccatggcctagtttgcttttcttgctgtgataaataccatgaccaaaagcaacatgggactgaatgggtttatttggcttataagtcctggtcacgggccatcactgagggaagctaatgcaggaacgcaagcaggccaggaactgctgtggaggccatgaaggaatgctgcttactagtttgctcctcggggcttccttgtggctccctcagtttcttctttctacaacctagaatcactggttcccattggctggaccttcccacatccaccattaaccatgaaaaggccctgacagacttgcctacaggccagtctgttggaggcattgactcagttgagctttcctcttctcacatgactccagtttgtgttaaattgacaaacaaacaaacaaaaaaaaaccaataaaaacaaacaaaaaactaatcgacacactcccatattgagatgagaggcagagacagggggctctcaggaagcctgtgggccagctagtcaatatatgcagcattgtgctagaaagaccctgtctcaaacaagggagaagtcaaggacctacacggaaggttgttctctcacctccacatgcataccatggcagacatgtttgctcattcgcacacgcactctgcctacctccctctgtctctctgcccccccccacacacacacatagcacacgttttttaaaagatttggaaacatacacattcagttcctatggaggccagccagcgacttgcaagactgggttctctccttccaacatatgtgtctcaggaactgaactcaggtcattagactaggtagcaagggcttatacctgctgggccatcttgctggccctcatgtttcctttttaactatatagtaaattacctttcattttcctaattcaggaggacaactaaaaacccacagtatgaatctctattgtattcaaattgtcagtaattcagcagacctgataatgttatgggtgtgtgtatattggtagttgcaacatatctactatgtcccttcaaccttaaattatacctctaaagtatcacaacctaatcttcatgtacacttttagattttaattaacaggtgttaattttatatatcactgaaattacaagtattattttattttaatacatgtgtacagcatgtgtcgatcaaaaccatcatgcactctgagtttttacagtattatttatgctgtatacctaaagaagtagaacaaaaacctaaagaagtgagaaaaaaggattatctcatatgttcaattattaactttaagttatactttttcaggtggagggatggccagactttagcatatttggttttatttttgttttgtattatttaagtcttgctgtgtccttccatggcctcctgggagagagctgactcaggtagtgaggaaaagaagaaaagacaagcatgtacagacagacagacacacagaaaatctgaagtctgtggattgggctctgatgaagaaactgcagcatccccaaagtttatcatgttttcttttgtttgtttgtttttgtggatattttatttatttatatttcaaatgttatcctcattccctaacccccccccaggagccccctatcccattcccccctcctcctgcttatatgagggtattcccccacccactcacccattcctgcctccccgccctcgcattcccctacactggggcattaaaccttcacaggaccaagggcctctcctctcattgatgcctaacaaggccatcctctgctatatatgcagctggagccatggatcctaccatgtatactccttggttggtggtttagtcccagggagctctgggggtactggttggttcatattgttgttcctcctatggggctgcaaaccccttcagctccttgggtactttctctagttcctccaatggggaccctgtgctcagtccaatggtttgctgttagcatctgcctctgtatttgtcaggctctggtagagcctcccagaagacagctatatcaggctcctgtcagcaagcactttttggcatccacgataatgtctgcatttggtgactgtatatgtgatggtccccaggtggggcagtctctggatggcctttcctttagtctctgctccacactttgtctctataaccccttccatgggtattttgatcccccatctaaggaggactgtggtcttccttcttcttgagcttcatgtggtttgtgaattgtatattaggtattctgagcttttggactaatattcactcgtcagtgagtacataccatgtgtgttgttttgtgtctgggttacctcactcaggatgatattttctagttccatccatttgcctaagaatttcatgaagtcattctttttaatagctgagtagtactccattgtgtaaatgtaccacattttctgtctccattcctcaattgagagacatctgggttcttttcagcttctggctattataaataaggctgctatgaacatagtggagcatgtgttcttgttatatattagaacatcttttgggtatatgcccaggagtgttatagctgtgtcctcagataatactaagtccagttttctgaggaactgtgatttccagattggttgtaccagcttgcaatcctaccaacaatggaggagtgttcctctttcttcacttcctctccagcatctgctgtcacctgaatttttgatcttagccattctgactggtgtgaggtggaatctcaggttgattttcatttccctgatgactaaggatgttgaacatttctctttttctttttattggatattttctttatttacatttcaaatgttaaaccctttcctagtttcccccctcctggaactcccctatcccatcctccttccccctgcttctatgagggtgttcctccacccacccacccactcccacctccctgccctcaatttcctacactggggcatctatggagccttcataggaccaaggacctctccttccattgatgcatgacaaggccatcctctgctacatatgcagctagagccatgtgttgatggcttagtcccagggagctctgcggagtctggttgatattgttgttcttcctatggggttgcaaaccccttcagatgttgaacatttctttaggtgcttttcaaaccattcgagtttcctcagttgagaattctttgtttagctctgtaccccatttttaataaggttatttgattgctggagtctattttcttaagttctttgtatatattggatattagccctctatcatatgtaggattggtaaagatcttttcccaatctgttggttgccgttttgtcctattgacagtgtttatcatatacagttgaacaggaggtgaggctattgcatatgtctgaacaagggggctgggttagcgagtctccataggagcaaccttaaggctgtaaacattggggaaaggcaactaaggtagatattttctgcacacactatcaatattcatactcagattcccaaggaaggctttgctagcccctgaacctcacctggggaaggttctgctacatggggcagaggcattggagtccttggcatggccatgccagtgtcaacagcacatactcactcaggacttcattcccttagcacccctccactccctgcacaagttagaaaacaggagctggagagactgcatggcagttaaaagtacttactgttcttccagaggctccaagttcagttcctatcacctatgtagatcagctcacagctgcctggaactccagctccatggaacacagctccttcttctgcacatgtggcatacatttgttcctgcacatgtgtacatgcacatacatacacacaacaaacaaataaaaatcataaaagtagccaggtgatgggggtacagacctttactctcagcactcaggaggcagaggcaggcagatctctgagttggagtccagcctgtctggagagggaaaacaagtttcgggatacacagtgaaatcctgtctcaaaaacatcatcatcatcaccatcaccatcaccatcatcatcatcgtctattttaaagttagaaaatagtactcaggctggaggtatttctaaagtgaagattctgaagtagtctgagattctgctatcagtatcttctgtggtactgatgctgctggtccaagaaccacacttaaaacagcaaggttatactaggtttttcttatgttaaaaacaaaagaaggatgcacatttaagtctttttaaaatgattgagaaaatgagactgatttttcttttttctttgattctatacagttcgtcccactgattcaaatgtgagtcctgctatttccatccatgagattggtgctgttggagcaacaaaaactgaacgaactggaatcatgcagttaaaaagtgagataaagcaggtaagatataacctgaaaaagtatggatgtggtcataattaataacattcttagctggacatgatggtgcatgcctataaccccacacacaggggatacaagttggaggatcaagaggtgaaagccagtctcggcaacagaggaagatggaagctggtcaggaatactggagacactcactgtccaaaaacaaaatcaaaaccaaaacatcattttaaatgagactttgctgtgctcatttccttagtttcttatcctgagtataacttgaaccatttgttttccaggtggaatttcgtaggctgtctgtctcgatggagagtcaggtgaaccaagacatctttcaatgttgactggctttcctaacccttttcgaagcagactttgttgtgctcacatcctttgtttcccatcctgagtataacttgaaccattttttcaggtggaatttcataggttgtctgtctcaactgagagtcaggtgaaacaaggaagactttttaaacagactttaactagccatagcatgcattacctcacaaactttccacaagcaatgacacaccatggaatctctcccatagcaaccatttgtagacagcactcccttttgtagatcaaatgacttaattttaggaagaaagtacctggcaacaggtagcaagaaagtgatgtcctgagtttccttattacagttaatgtgcaatttataatggattttctttataaaagtagacacacttattgcttttaagaatagctagctggagaggtagctcagcaattaagagcagtggctgctcttgcaaacaaagaacctagttttgttttccagcatcaacatggtggctcacaacagtgtgactccttttcctggagatttgatgctttcttttggcctccatgggtactgcatgcacatggtacacagaagtacattcaggcaaaatattcatacacatacatgaaaaataaatacatctaaaaaagcaaaacaaacaaacaaacaaaacaaaccatggggcccagagagatgttttagtagttaagagcattccctgcctttatggaggaacaaggtttagttctcagcacatacatgacagctcacaagtgtccttaactgtagttccaaaggatcagatatcttcttctggctccacaggcaccaaccacacacatggtgtacatacatacatgcaggcaaaaaatgtatacacgtaaaatttcaaattatattcttcaaaaattagaaaaaaaaagaataggtacaagagtgtaggtgaaggttttatttttaaatctttttggagattttaacatgtacaagcaccataaacataaaggacaatgatgttttattagattttattccaaaattcgactttatcaatgctgagagaggtacatgagtgctactgtgtaggtgaagaagagccatgtctaaacagactaggaatcaacaatatattagagcctcctttcactgctgctaacaatgactggcgtgttgcattatacaacggaatgtatactctcttttaaagctgtgggaaactgtttgattttaggatatctccattgagaaggtgctaatgtaagtccttctagtaccacttcgtttttgtttgagaatcccacatatgcatataatacacttggatgaaatctaatcctcagtcattgccctccaccgtctccatatccacccccttccactttcctcacacaacttcatggagtccacttaatgctactagtgtgtgctaattccatgaagaatgatagtattaagctctcacctagggtctatgacctaaagactatacttgtagagatcacttatatagttattaatagcacttcataagaaaggcttatagaattataatagcttagagcattaaagcctcatggagagaagaagcaaatgaagattttgtttctttaaaggggagctctgaaaccatttaggagagttcttgaagattaattttgaaggaagtttgggtaccttccttaaatatcctttagtgtttgtattttatgcaaggggaagactgatataagaagatgggctggagagatggctcggtggttaagagcactggctgctcatccagaggtcctgagttcagtccctagcacccacatgatggctcatagcatctgttactccagactcagggaatctggcaccctttctggcctccacaaacactacatgcatgtggtccacagatatacatataagcaacacacacatatacacatgacatacaaataaaataccaaatatattttaaaagaaaaaaaaatcgcatgctacagttcttgctaggtaactttttttttatctgaacattttcctatttgaaagtggaaaggacaacttcagtgctaaataattgttcattggtgtgattgggtaataatccttgttttggttgagggtgataggctaagtgcattatagttttgggatttgttttgttttgttgcaacaaggtctctataggtaacctgactatcctggaactcaatatgtagctcaggcaagcctttaaactcacagaaacctgcctgcctctgcctgtagacttctgggattaaatgtgtgtaccatcacacccagctcacattataggtttgtttggtttttttttatagacatctggtattacttacgatttttttttcatttttttattaggtatttagctcatttacatttccaatgctataccaaaagtcccccatagccacctacccccactcccctacccacccagtctccttttttggccctggcgttcccctgtactggggcatataaagtttgcatgtccaatgggcctctctttccagtgatggccgcctaggccatcttttgatacatatgcagctagagtcaagagctccggggtactggttagctcataatgttgttccacctatagggttgcagatccctttagcttcttgggtactttctctagctccttcattgggggccatgtgatccatccaatagccgactgtgagcatccacttctatgtttgctaggcccaggcatactctgacaagagacagctatatcagggtcctttcagcataatcttgctagtgtatgcaatggtgtcagcatttggaagctgattatgggatggatccccggatatggcagtctctacatggtccatctttttatctcagctccaaactttgtctctgtacctccttccaagggtgttttgttcccacttctaaggaggggcatagtgtccacacttcagtcttcatttttcttgagtttcatgtgtttaggaaattgtatcttatatcttggatatcctaggttttgggctaatatccacttatcagtgagtacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctgggttccttccagcttctggctattataaataaggctgctatgaacatagtggagcatgtgtccttcttaccagttggggcatcttctggatatatgcccaggagaggtattgctggatcctccggtagtactatgtccagttttctgaggaaccgccagactgatttccagagtggttgtacaagcctgcaatcccaccaacaatggaggagtgttcctctttctccacatccacgccagcatctgctgtcacctgaatttttgatcttagccacgatttttttatattattggaactcaaagtccttgttgccatctagattaaagtccacctttccagctactcaaggtttttctcctacacattcagtacctacaggtcttcaatggagcccaaatgcttaagactataatttagaggatagggaagactccgttatcattacttttttatttatagcatcgctttccatccttacatgcctatgtggtattttgcattcttttctgctatttaccagaactttaatttctagacgaagttatttcagggtagtttttcatttattttaccctttaccatggcatttagaggaaacttatttcttgggcttttaatgataacatgtagtatactactactaatagcttttttagacacaaataatgcttgccttatctcacctctttaaaaaaaattactttctcaatttcttttatagactagtggtggtcatccctcgggtgtagatttgatgtcgccatcctttctggtaactccttttatgttatctcatgtttcattcacaagtgttttgatataatggtatgtagatcataacatagtatttgactattataaaaccaaattgggggctagagagatggctcagtggttaagaacatttgttgctcttgcagaagacctgcattccattcccaccatccatgttcacagccatctgtaactttcaagtactcctgtggtagctatttatacacacaaaataaatctaaagctaaaaacctaaataaataaatggatccagaagtaacatgactatgaaagaagttcctacaaaagggagaggtctgtttctttcctggtaagttaggaaagggggttcaatcactttcttttaggaagaaaataaaacaatgtaataagtagttgttctgtgtatattcattctttgagctgttgcaagtgtgcatccctgtgcatctaacagtggactagacaacatgaacattagtttggaatttatttgaaaatccgaattttggtctgtatcctagtgatgctaaggcccagcagtctgttctaatgcgctctttaggaaattctgaggcacttaaatttcaaaggtactctgttgtagctggtcccctgagatgtaatccagttagtgaatgaactaaatgccaactttatgtcatgtatgggagatatggtgttgaacaaaatgaaaatgatacaatgatgctcacaattgaggaagattcttttctaattaaattcctttcatctttgttttatccacttcatcagaacatactaagctatgaagtaatgagtttggttatgacattttcttatacataagatatactttaatcatatatattttggtttaaatcatagcaagttatgatttcatttctcacaaattgaagaagagagctattagaaataatattttggctaactttaagtgttagattaagaagaattggccagctttgtgatttccatgttaatagtaagatcattagtgatttaggaaattaaaatgacagaaattgttttcctagaaaatatttctttcacccttcattttttctttatttctgaatctaatctgtcaaataatcattttaaccaatgaattttctcctttatttagcttaatttttcagagtttttatatcatcacacacattgctatttgattcctttttattgcacattctctctatctgttgataatgtcgatataaacctttatgtatagatttctacatagatatgtgtctgtaattacacagatatgtgctgtaattaaaacaccaaaagcaactttaagaggattattttatcttacatcacagtccaattgcagtccatccttgagggaagtcagggcaagatttcaaaatcaaacgaggcaggaatctggagacagaagctgatgtagagaccagggaagagttctgcttactggctttgctcaacctggtttttatatagtccaggaccacctccccagggatggcaccacacacaaaggtctatgcctttctctagcaatcactaattaagaaaatgcactacagactttgctacagcccaatgttatggaaacagttttgtgtttgagagttcctcttccaaaatgacatgtgtatttctcatttctctcacatctatttctatggggctgtattagttacttttctgtgtgctatgacaaaaatacctaaaaagtaacttataaaaagttaaaaggtgtattttggctcacagtttgagggcatagtccaccatgtgaggggaaacatggcaacaggatcatgaagcatccggtcacattgaacccacagttaggagacaggcgaatgctggttctcagctcctttgctcctttttaaaacctagaattttacaattttctttttttttataactgcatacatataaccaatgtatcttgattatggctatccccaacactcccttccactcttcccagccactgccaacacatgcgcctctccacttcacatcctctccatttttgccctaaccaatggaatgcttttctttactactactactactactactactactactactattattattatattttctttatttcaaatgttatcccctttcctcatttcccctccgaaaaccccctatcccgtcccccctccccctgctcaccaacccatccactcttgcttcctgcccctggcattcccctacactgtggcattgagccttcacaggaccaagggcctctcctcccacttatgactaactaggccatcctctgctacatatgcagctggagccatgggtcactccatctgtactctttggttggtgatttactccctgggagctctgggggtactggttagttcatattgttgttcctcctagggggctggaaactccttcagttccttgggtcctttctctagctcctccagtggggaccctgttctcagtccaatggttggctatgagcatccacttctgtatttgtcaggcactggcagagcctctcaggagacagctatatgaggctcctgtcagcaagcactttttggcatccaccatagtgtctggatttgggaacggtatatgggatggatctccaggtgggacagttactggatggcttttccttcagtttctgctccaaacattgtctctgtatctcctcccatgggtattttgaccccctatctaagaaggaccgaagtatccacactttagtcttccttcttcttgaacttcatgtggtctgtgaattgtaacttgggtattctgaacttttaggctaatatccacttatcagtgagtgcatagcatgcatgtccttttgggtctgagttacctcactcaggatgatattttccagttctatccatttgcctaagaatttcatgaagtcattgtttttaatagctgagtagtactccattgtgtaaatataccacatttcctgtatccattcttctgttgagggacatctgggttctttccagcttctggctattataaataaggctgctatggacatagtggagcatgtgtccttattacatgttggagcatcctttgggtatattcccaagagtggtatatctgggtcctcagatagatctatttccaattttctgaggaacctccagactgatttccagagtggttgtaccatcttgcaatcccaccatcaatggaggagtgtttctctttctccacatcctctccagcatccgctgtcacctgagtttttgatcttagccattctgactggcatgaggtagaatctaaggatcgttttgattttcatttccctggtgactaaagatgttgaacatttctttaggtgcttctcagccattccagtttcctcagttgagaattctctgttctccattcttttaaagattcatttatttattgtatacatatgagtaccccaccattgttctcttcagacacaccagaagaaggcaccagaccccattacagatggttgtgagccaccatgtggttgctgggaattgaactgaggacctatggaagagcagtcggtgctcttaaccactgagccatctctccagccctgttctccatttttaaatagggttatttggttctttgtagtctaacttcttgagttctttgtatatattggatattagccctctatcgtatgtagggttactaaagatcttttcccagtctgtaggttgctggtttgttctgttgacagtgccctttgccttacagaagctttgtaattttatgaaatcccaatcagtcttaaccaatgcagagggttaggataattgtttagcatttttaggaactattagacttctgcagagctgaacttcttcacatcccattgtgtaagcattttaatttcctcaccccctccccagtgcttattcttgtctttcttttgttgttggccatcctagtggggtcttgttttatcatagctctgtgcacaatgatattgatatggccatttgcttatgtttgaagaaatattttatttctatcatctgcccattattttaattagcatacaaagattatgtttcattgtgacatttttcaaacatcctttgcttttgttcctcgttctcttcgcctcccttgcccatctcccttcccctttgtacccttctatctcctgtagtctcttttccactttcatgtcacctgttgtctcccttcctctcctccctcagcacccccttttcctctcattgtctcctttatagtttcatgaccaagacccacatttacacttacatgtatacagccaattaactgataaggtagaatttcagagtagctttaatttgcatttccctgattctttacccatttttaattgtgtgttttatatttgggagttacaaggattctttatatattctaaatataacatccttacagaatatttttattcttactgatgttctttgaagaggtctgttttatcagaggtcagtttttctattttttcttttattgttcctatcaaagaaggctttacctaaatcaacactacaaaaatttagtgctatttttttcttctaagggctttgttaaaattgttttagctcgtacatttgagactatgattatattgggaggtgaaattccctaaaactatccacagcttcagcaatttagtaggagtcacaggattaatcacacattaaaagacttaacaacaaaatcagcaaaagaaaagggtgtactgggtgaaacccatagaaaagcacacaagattctaggagtactccccagcagagccatctataggatgtactaaaattcctcctgtaaatgactagttacagcaggtgaagtgctgataaccgaaatagctaattaaagacccagcacagtacctagggtctttggagctagtcataaagagagcctctgtctggcattccccaaactctagactcccaggaggaaagaaggtgttctaaataaactagtgtcgatacaagcaatttatgagtggtgattagtttgaggaatggtgatatccatctgaacgcccacatttccagactccagatgaagtaccaagcctgtaacaaatgacttttcaaaaacagcacacttgtcttctggtctggtctgctgtgctgactgttttttaacactctccagggcaggccccatgcaaatacaaaatcaactccatgggctttttggaggattttttttattttatttgggaggagggctgttttcttcagtttgagtatgagctttttgttttattttgttttggttttatcttattggtcttttgcttgtttgttttgatttccctttttgtgttttttatttggtttgaggctctttgtcttccctttctttctttttgccaaaattccaatgggattcccacttttttgcatagtgttaaatagtgtgctacttcattctctgccatgtggatatccagttgttcagcgccatttgtttaaaagattatttttgctcccatttaattcttctgaaacttttattgaagattaattaaacaaaatgtgattgatttatttctgaattttgtgctattgatctgcaattgatttgtgcaattgatctgtgggtcgatcctatgtcagtaattactacagctttgtacagtgcattatgaaattgaactctatgagtcttcatacttttttcttcctttttaaagattgtattggatagcataggttccttaaattttcacaggaattttagaattcacttgttcatttctgccaagaattcaactgggactttgataaaggctgtgttcaatctgtggatcaaaattactctcttactaacgtcctctgatccatgggtttccttccatttgtttaagtagtttatttcagtatattttagagttctcagacatgctttgttatatttattcatacagtttggcctcatgtttctttaaaaaaaaaataaaggcaggatctctgtatgtagccctgcctgtcctgaaagtcactatgtagaccaagttggcctcaaactcacaaagatccacctgtctctgcctcccaagtactgtgattaaaggtgtgcaccagcaagcctggacctatttttttcaatactgttttaaaaaggaattgatcattttcttagtatttttttttcatcagactgttgtcttctactgtttaaacagatctcatcttttaaaaatatgtgtaacctgctctatcattaatgatagtcctgagggtgtatttataagcccaattaaatggtttcttttagaagttggtgtagtcatggtgttttatctcagcagtagaaaagtaacatacagaggcttgtgttaatagtcataaaagtgacaaacaaaaccagagagcagctagacgttaaacagataaagccagataagcagacagttgggaatgtgttgctggcatttttatggttgttattctgaatcaccagagtgctgtatataatgatttccccagggaacatcacaccagttagttacccaataccaaatggtcagccttgagtacactcatagaagtatcattgtacagactgagcaaattattcttgtgtatatgtatgggataagaattaatggaaaaaggccatgaatttgaaaaagagcaaggaaggatatatgggagggtttggggggaggaagggggaaatgaaagaattatgttataatctcaaaaataaaagaaataaattatttattttttcattaacttacttatttattcactttacattccaatgattatctcctggttccctcctcacacagcccctcccccagcccctctttccttttctgagagggtggaggtccccttggttaccgcccccccccaggcacttcagagactatacagagttacagcactgcaagctgtacagaggttgactagctttacagtcatgtcatcccattggctctgtcatttagtgtgtgcttcgtccttctatggagtatttacaattcactgggttacacactgtttacaacgtttaggttttgaaattaaaatatagcagtattatcctcaatcacagggtaagaggtcacttttgatttacatttgttcttctcccaagtcccctgcagcctgtattgctgcaagtagtggatcctttcctacggtgtgtgatcatcagacatctaaagatagtcgtcaaggccagtggcaacgcaggagaaggctagatggagcactaaatagagtaccaattggattttatcaaaaagtatggaaaattttgcagaaagtgagtataacacagtgttattctttattcccctcttgaacgtctgaatctgtctagctaacgtgacataatcatagcatggttgtaattatatagagatgaaatgctcagataaagtatagacaaaaacacaaagcaattgatttattgtgacattaataattttagtctaatttccttattgttacaatgtgttgtttcaaataagattttaaaaatcataacctctctgctttgtgctatagttgaacattgtaggatattgcaacacatttgctgccagtcaataatgtgctgctaagtagctcgctttctttgttggtattatgaaagtggagatgttatttgtatctctcagctattcatctttatatgtcactacaagaaaacaaatgacctatgtggggagtttgtacaggcagctcttacttctatgctttcttagatgaataccactgaacaaatggaaagccacaatgatgctcttgttgttgatgaagatggcttgttgtttgattttgtttttgctttttgtttttatgggtatatgtgcttattttatatgtatatgtgcctgtgtatacatatgttcatgaagttccagcagaagtcagaagttggcatcaactctcttggaattggagttacaggcagttagttgtgaaccatcatgtgggcggggtcttctgcaagactagtgtcttagttagggttttactactgtcaacagacgtgatggcctaagaaactcttaaaagaacaatatatagttggggctgacctacagtttagaaattcaatccattatcatcaaggcaggaacatggcagcatccaggatagcatggtgcagatggagctgagaattgtacatcttcatctgaaggctgctagcagaatactggatgccaggcagctaagatgagggttttatagcccacagtgacacacctactccaaaaaggccacacctactccaacagggtcacaccttctaatagtgctactccctggcctgagcttatagaaaccatcacaactagtaactgcttttaacctttgagccatctctccagctctgaataatttgttttgagacagggtttgttattgtccaggctggcctccaattcaagatcctcccacctcagtttcttggagtgctaagattgctgagatgtaccaccacaccaggcctagataaaactcttggtgtagctactatttcttcttattattttctaatagacatgtaagggcatatcacaccattatggtgatgctaatttttacagggccaggaagaccatagtgctcattgactggtctcatttatacaaatacaatcttttttcttgaaatatttcaccaatggcatcataatcttgaggtaggttttgaccctgccaggacagtgatcttccagggacatattagaaacagcaaaagttgattcctcagaggctttgctctagggaccttcattttatcaattacttggagtctgctctgttacagctattataacatgatagagaccacatagagatagtatatattttctctctccagttattcatggattaccacaattcaacatagtaatagacatgtattaggtgctctgtccacataagaacatgtattctttatcatcaaggagttgaatagtcttccttcaaagcaactgttctacaaggccatacacagccgaaatgatttgtaataaagatccctaaccacaaggcaggcaaaacgattcttgccacccaccatgactaaccatctgagttccatccagggacccacatgatggaaaacaagaactaactcctgcaagtacccctctgacttccacacatttgtttacttgtgcctgccctgaccaccaccacacacaaatacatgtttgaaaaggatgttgtaggaataacaaaggactgggtaagtctgccaaggaagaatgggtattttttggcagagtcaaaacctagacttggtgtcttaaagaagttaaacccatgcttttccagacatgaaagtaacaataatttttacatgtttcaaagctggcaattgaatgtacggagattacttagaatccggaatataacacgtaatggtccaacagagtcggtaaacctgttggtcatgtgtggttgttttctatagtgttttgacttctataaaatctaaaataactgattaatttccactgctttttaatagttgagttcatatgctagagaaaggcagagagttgcttgtgttatctattgatccaggtatggtgcttcacacctgtacttgaaagcactgagaaggtgaaggcagaacttccagtgtccaagagcagcctcagccacatagtgaattttacataagattacgttacatgtaaccatgtgtcaaataatgacaatgataatatttattgagtatctgctatgcaccagagtgtcttctggtcattcccattacaaaagacaaaatagccaacaattctgtccttgtggagcttatattactcacaataagtaataaacagcaaataatatatctaaaatgttaaaaaaaaaaggtgggaaaataggacaggataagcatattgataggtgtggcatacgtttttcctcttcttccctatggtgttgaggtgccattgcacagcagagggggaggatgggacagaaccctgttctgcagtccacagcttttcttggtaacgttcaaaacgggtgggtcccaggactccccacacagtgtcagagaaggagaagccctgctggtaaagggagtcctccagttttgccaagctcagaaggctatcagaacaattagactttgaccttaatcagcagtgcccaacaatgagggactcaactagaacgagtaggaatgggtcattgtacataaatgtataatgtgagtcatttttacagcctaagtctcctgaagatccatttaatttcttaaaataaattttgtgtgtgtgtatgtgtgtgtgtatacgtatacatgatggtgtggagctcatgccatagcatacatgtagaggttagagaacaactttgtggattgtgttctcctttcctcctttacttgggattatgggagtaaagtcatgtcattggacttgcatgggggtgtgagccatcttgccagcctttgaagtacacttagaaatatgaggtctctcctcctggcctcccagttgttagctcatctctggtaataactggtttttctatttcgcagtgtcatgggctttctgtggaaggttttgttcttccctcttcaaccactagggaggtaaggttctgtcttttctatttacatgagagaaagcttgccatctgaaatttttcagttattagttattgaattaacactgatttataaatcagctgagtgcactgcatggaggaggtaaagctggaatggggacagtagacagtaataatacggtgctggcgagccagctcacttggcaaactgctgtgccatgcaagcatgagccttttttcctctggattattttctttgagcagagtcccagaaataatattttaggttataggacagttatacttttatgactcttattatgcattaccaaattgccttccaaattgattaagccaatttataccatttcattaaaggggctgaagccatattgtacttacagggctttttacggcttttcaaaggaaaggattcatgttcttgggtgatgggatcttagaaagtgatttgtttctttttctgtcacagatgaccccaggtgagattaaattctctgtccatgtggagtctgtcctgaatcgtgtccctcagccagaataccgccaacttctggttgaagccatccttgttctcaccatgctggcagatattgaaattcatagcattgggagcatcattgctgtggagaaaatagttcatattgccaacgacttgttccttcaagaacaggtaggttgtccaatgtggaatacacctgcaatcactgcatctaggagtttggaggccagaggattgggagaccaaagccaggctcagctatttagtaagttcaagaccggctttagctacaggagacccaaaacctataacaggtatttccttctcttaaccactgtgagagaagacagaagtatccaaacaaaatatgaaagacccaaggtgggggatcccaatatagtctcactagggttctctccaagtgctaataacagaggatgttattagcaaatgtgactcacttaatcaaattttaattgatattttattttgaaaatgctttataatagaaaattctaaatagtaattaaaataatttcgggagtctagtgacaagtgctatgtatagaagttcatatccatcctgcacaacccttcatgtccccttctggttaaacagccagagaaatggtgctggggaggaagctcagaggcacactaattagagtttgactcagtaggatcagtaattttccctttcactctgttttcccacccttttaaaccaaatagaaaaccctcggcgcagatgataccatgttggcaaaggatcctgcatctggcatctgtactctcctgtatgacagtgcacccagtggcagatttggcaccatgacctacctctccaaggcagctgccacctacgtgcaggagtttctgccacacagcctctgtgccatgcagtgagggctgtgggttctgcctgttagaacacttcagtagctagcccgtctggttgattgtgcatggaactgacatgttaacacctgatcactcccccaggcccttttcctgccccatccctcctaggaagagagaactttgctgacgatctcactacttttgaagaaaagaagccctatctggagacttgactccagagcgaagccctatctggagacttgactccagagcgaaggttcaactgcgcctgcagtcactatccctacttttgtggttcatagaagtctgcatgtgcgttgattctgtagagctgttagtggcttagtttttaaactcctattggggagtaggtattaataacttattcctgtaagttggttttcttatttgttggtttttacgtgtgtatatgagtggtgggtattgattaggccatcatttcaagagagtagatgctaagttggatttcgtgctgctgtaaattggaactgtcgactctaagtgcctttacttaggaaaagccagtaccacatcatggcttccttcttcactcaaaggctgctttgctctgagtggggaaagagtgggtgttttgtagaagcattgcctttcattgttctttctatatctgtccacaatgcctactgtctctgtggtgaaatattaaaatatgtaagctcacatggaagtttaagaatttctgtgttaatacttggaataacccagagaaaagaagccagaagcctaattccagagaggaagggaaagaagttctgtaggtagtgctttacacatagggggccgagagaacatcagaggcaggtaggttgcttgtggacagccttagacaccaaatccttgcctctggagtgtagccacacacaacacagagagtaactgaagcctatcttaagcaaagagaaaccacccgtccactctggggctgccctactgaatgcccctttccaggaccttggtattccttctcattcagtccccagcacatccggctacccctagctctctccacattcattcctcaagtctctcatttacatggtttgactttttaattctagtacttacaacctttaatcttggtaactgtggccaaatatctattgttatacatatctctgaatgtgcttgtaagtggttaaataatttgtaagcatttttgatctgtctgtctgtctctacatggatggactgaataagaatgtaaataatatttattgcaaagcaagcctggtcatacttgctgcttgagaagctgaggcaggaggatcatgaattcaaagccagcctgggatacatagcaagtttcagggcagtgtgggtatgaggttgtgtctcaaaaacatttgaaagcatgttgtgcatgtgtgagagagtggcgtggctggtctcaggctgacactcgaagggtagtagaaatatcccttctggcctattgtctgcttcgctgtgtaggtagcctgacttgacagaggtttctcctggttttccttgtttctacccagagaatttcctactcccctttccctccaaatgttaagggttttctcccagaacagtaatggggctaaaggggcagtgagctccaaacagtcacagagtgaggagtcttctgagctccctggctaagtgcagcgtgctagcagacaggcaggggatgcaaacggctgccgggccacctctcccctctcacaaaccatataaacacagggaggggctttctcaccacttctgaggagactgtacagcccgttttgtgcctgtgtgtgtgttcatggcctgtaagtgtaccccaagcactgtgggcgggagctaccacttctttgagaacctctgctttacggttgacactgatgcttatctttctctggagttacggatttgcctgtggatttaatgctcacaccatgctatttaatttttaaagtaacttttcagaaaatattactggcgttttgttcattttaagactgttaacatgaagaaaagtgtgctagaactttttaaaaacacataatgtcttgaagttagaataaacactaagaaatgact

SEQ ID NO: 726 - DNA, 117 bp, mus musculus
gttaaaagctcatattgctcttacagaggaggacccaagcttgatccccagcacctgtgtcaagctgctcacaatcacctataatttcatctccaggagacccaattcctatcaccc

SEQ ID NO: 727 - DNA, 12001 bp, mus musculus; identical to SEQ ID NO: 91

SEQ ID NO: 728 - DNA, 12001 bp, mus musculus; identical to SEQ ID NO: 91

SEQ ID NO: 729 - DNA, 2406 bp, mus musculus; identical to SEQ ID NO: 93

SEQ ID NO: 730 - DNA, 420 bp, mus musculus
tggggtgcggccgctccatcctcccagccctaccctgccttgccctgctgggccgccctgccttagcccgggtatcaggcgagaggcggagccacccggcgtgccccgcccccgcggtagaaagggttgggcgagtgttactcgcggtcagggctgggaccttttatctgtgctgctggaggaggtaggaggaggagacatcaggggtggtcctgggcgcctgggacacctttcccggactataaattgagcacctggaatgggcagggggccggagcaaccacagtcgcccttactcacagtccgatcagtgaccgcagcagcgcccttgggcagccaccgtccgcaacgcaagcactgagaaccaggggatttcgcagtgcaagaggtgggtgtccccgccctttggcagcccgggct

SEQ ID NO: 731 - DNA, 457583 bp, mus musculus
ggtggtggatgagctggagccggagccagcgcgcttcagacttgagaacagttcagagagtcagaacgtgcctgaaagagagagagagagagtcagcgagtgagcgcaaggggacctaaaggagtcagggagagaaagctagggctctaagagctaggctcaagacagagtgaccatggctgtctctgcacctccggtgatctctgcaacttccagcagcgccggcgtcccggggggtttattccgggctgaacccctgtattcgtctccaggagagccccctcgcctaacccctaacatgatcaacagtttcatggccaataaccataacggcagtgtcttgggtggcgggattggtggtggcagcggtggcagcagcaacaccaacacaaacgagtgccggatggtcgacatgcacggggtgaaggtagcttcattcctgatggatggccaggaactgatctgcctgccgcaagtctttgaccttttcctcaagcacctggtgggagggttgcacacagtgtacactaagctgaagagactcgacatatctccggtggtgtgcactgtagagcaagttcgaatcctccgtgggctgggggccatccagccaggggtgaatcgttgcaagctcatcaccaggaaagactttgaaactttgttcaccgattgcaccaacgccaggtgagacactcattgcttgcttgcctttctctctttaccccttagccctcttctgcatgtctcatccaacttggtctgtagaggttgagttctgcttctttgcattgtaatcggcggggttgagagaactaggagggctcataaattaattgccagtcctttctaggctgctttcagtggtagggcttcaatttgaaaaagtcccgcacaaacttcagtagcaatcatccactgaaactttacagccgttcgcctacattttgcatggctttttggctgttgtggtagttattttctttatttgcttttctttcctgctcttttgtggccatacgggtcggatagtttttcttctgaacacgggcatcaagggctttcttgggtatgggggctggctgagctgtaacctgggctcctaagctggcaaccgagaaaaaggcatttagggggtgcaagggaacggaagtctagaatccatcccagagggtgattcgatccccatcctgtatgtttgttgtgagagtgtttgggatgtgtgtgctgtggtggtgaaggtggtgtgtgtgtgtgtgtgtgtgtgtgtgtgtgtgtgtgtgtgtgtgtatgcttgtacaagtgcctacaaggacatatgctcatgcctgctgcgcaaagctccctggtgcatggtaaagtagatgatgagtcctatttaaaaacaaaaaccaaaaaacaaaacaaacgatgaggacagatgccactttcctggaatcctacctcctgggccacctgccgaggttaatgtggggcacgaaatgctgaggctcaggctaggctgaggcttggtgtaaaagttagtaggctttgttgttgtagtagttgttttttgtttttgtttttttgttttttgttttttctttttagaggatgagccagctcctccacctcagacaaaccagttagttgaaaggatcccatttcccccaagagaggattgtttaaataataatagccaccttcccaagtcataagtgtacctccttgatatcacagtttaaacgcgcatcagactctgttcatgtgcacttagaagcaacttgagtttgatgttttgaataaaattttaggaaaggaaaccgttgagaattatttgacattcaaaaatacgaattagtaatcttagtgtttcatctccagtctggtaatatctcagaaaaggaatcatttacagacaagattagtgtacaaatcaggaaattgcaatgaaaaaggagcaaagagctttgctgtaaagcagcagcatggttgatcattttataaagaacttctgaggtctagtctcataatacaactttaaatgatggcgtttctgggtctgaggaatgaacctgcaactacagggtcatgtctgttgtaaaatctaaattgctgtctttagcggagatgtattgacgataactaataggcaaactgttgcttactagtgcaataagcaaaatattgctatagagcttacaagagaaccttttcttgttccttctgagcaacttttgtgttcaagcaactaaacagaaccagttcagagggaaactcctaccggattcccatgtaaagcttaaaaccctggcttataaagtggaatttcttaaggtagatgcagtaaaacacaaagggtaagagcctctctcaatgcaagacaaaattatgggtttaaaaaaatagaaatattttatagaaaatagaaaattttcactttgattacaaagaatattactaatacatggactcagtgagttaccagaacttctaatggaagccatgtgattcatttattgatatcagatacactgacttaaaaatgattgcagagagaaaaagccatattcatcttttctctctctttctccctctccctctctttgtttttttttccttcccttttcttcttcatcattctcctcccccaaactgttattcctagtgtgaaaattttatacagggacccttccccccttttttcaataattaatattctcattcttgagaaatatttataagtttcactcttagaataaacagattgttattttattatgagtttgatatttagtctagaaataagaactttaaaaattttttaatgagacatgccaaagagataaataataaattatttagttatattgagataggttgttctatactattttggaatcctgttttaatgtgtttaggttcttgttttagtctgattaagctttatttattccttttcatttgtatagctaacatttctatttgatttttttgtaaaattgtgatagaaaagtattaaatataaaaatatatttgtggtacaatttataatgtatgttttgaataattgccttgtgaatattgaaatatataattataaaaattatgaaacctattttatgattataacacataaagaagtgaggaaagccactagacagaaataaacatagtacatatatagtaaaatttaaatggaggaaaagtacaattacttgaaaaatataatttgtgataatataacattagtaaattctcttgctgcaaacactctcatgaatatgttaataaaattgcaaaatatcattcttataaaaatgcttcattactctaggtaacattgtttataaaatctgtggttttaaatgcaatctgaagttagtgtttaggtcaacactagttctgtcactctttagttcagtaataagagaagtgagaggtatacaaaggcactaggttcaggatgaaagcataaagtaggtgagacaaacggtaagaaaagtgaaatgcagtaaagagcagaattttgtcataggagaagaagatggaggggaagatcctataaacatacccaagaagatagtgatgttctcaatgtagactttcttaaagaggtttgttcataaagattcatgacttacctctttgagctaaaggtgggggaggagaaaagtacaagataaagagtgcacattcagttgagtggaaactcattttgatggataaaattttgtaagatactgttgaagtcctatttttgtaatggtactattggctattatctttttctgattttcaaatatatttctccttctttgtcaaatgcatggtgaaaagtatgtgtcctgactagagtgtttttaatttttaatgttttctatgttatctcatataaaatggatcattttcaaatttcttattttcacaaaccctaatatattgcttgagatagctttttgatatagtttagtgcaattcacactgaagaaatgtgatatacatatatgtatacatatatacatatctatacattcatacacacacatatatgtataatcatttccttcatagtactgagtcatgataagaacgataagaactctattagtgtcatatgctttaattactgaagcattcaaagttgtcttctcagaaaagaagttgtgaaataatgtacacttcaactactagagagtagtacaacaaaacttctgatctattgattgttctattaggtaagttaatctttcattattgtaaagccattgcaaagggctgtacaacacttctcttcatgctgttttacttgagactgaatagtgaagatattattttgatgattattaagaaaatggtgattttaaagattctcaaactaaatggaaaataccttcttttagatttaaaaaaacattttttgtttcatcattttacaggaaatcttggaaattttaatgccaaagaaaggcaaattcagatagcatatgtctaaagtcttcattctgtgtactggatcttccttactaaattgcctcaagtataccagcagtcatacactaagtgaaaaatcattcttagtaaatatgcaaatcaaccaatatattttagtgatatctctttttaatctacttgcctacataaaagttacattgtcaggtttcaggatcagcagtttgtttcatttcggaagcatttaattacatgctattcagtctcaagtatagtcaaatagatgattgtagaaataagagtgtatgattaagacaacattgtaataattatttggagacatgatttaacattattcaaatataagtttgcttttgcaattaaaattcacaaagttcacttatattttatttgacagtatataaagtgaacatataggtgttttgatgtttgaatagttttatgtgaatttattgacacttataatatttaaattattcttaaacatgagaaagatgtttattataagcactcaatgaatttagctttgcactcaagcttgatgtatcctttagagttcatgatctgtatagtaacatagtttacttgaaactgttgctttgcatttataataaaattaagcatcaccaagtttttaaagagcttgtataactttactatactggtactctatattaaagacactttcacaaataataaaatgttatagaaataaatctggacaatgaatacatatcttttatttcatagagtggcgatgaggcagttatattgtctcttaaaagcatccagataaccaaaaattctcagtgttgtattagaagaatggtgctaatataaaaattatagcaatacagtcatatatcagtgtgcaaaactttaatgattaccttcactttaatcatacacttctgcttatattttttatttagctagatactccagtaactgattgactgctcatgtttaccttaaaaacctttctttatcttagatgatgctcatgatagactagtacatatttggagttttatgcatgatattctcagtacacacatggtacatgattgataatagattactagaatgttattgtcttctgacattaatattttatatgcttttatggaagaaattcttaatacttgaagtagaagttatcaaatttgagttatttggttatttggttctatttcaagtactcttattttgtgtagatgcttaaaaacaaaacttcttgcagatgagtataattgtgagaatccctaatcacaatacatttcagttggcaatatacatctccatttgcactttatcttgtttgcaaagatacatatgatttggatttattcactctacattatttcaaatatctttaaaaataactcagttgatataaaactgactatattgtgtttatggctaaaagtagtccccaaaggaaaacaattaggtattaatgatattcttgttgcatattcaaaaggtctctagtagcatttttccttccttttttctttttttcattttaccagctcaacctgcaaaactcttcactgtcacttcagatcacacaattctacaaagataaaacaacatttaaacacatttgctttggaaaggaaattgaacatttgcacccaataagcctgattgtggaactgaatgcaaattgtgttttgatttatctcttttacacttttttccatttgaattgatcttgcattaatttcaccaagcggctctgtgaggctgcagatgttgccccgtgtttaataaatcaatgagacagatctgaatgaatcacttcagatggattctctgctcggtttgatgtctagatgttattcttagcttgttatcatgacagatgcattaatgttcccatacactgccagcaatgtcaaagagattgaagcttttaaagtggcggcatcccttttcccattttctgctagaacaactacatttatattattttacttagaaatcagagtaaaacatcaaagcagccataagatttctgtgaaaagatttttaatttttatattatattttaataattctgaaatggtgaaacccaatatattataaacccaagtgaagggaagctgcttaataatgccagtctattaatatttaatcatgaaacaaaaaaaggagaattagcaatatatgattggaacacattgaaaatgccattataaatagaataatactgtatccaaattgattatagaagggtgtcagtttttaagaccttactaataagctttttgttggcttaatgcagctgcaatatagctttaccaagggatttggaacctttcagcatttaatatttttttaagtaggaaggagaaagtctgtctattgtatattaatcatgtcattagcttgtaatactgaaaaatattagaaaaatgttttatcttagcatttataatttatttatattcaaattatgtgcaaaccataaaatattttataaccataagtgtcatctctataacataatttttaaactggagaagaacatatatgtaaacctataggaccttcatataaatatagtgacattacttgccttcattaagtagtatacatcccatactttttttacgttttatgtcttgccttcttatgttggttttcagagaaaagcaacaatgtcaattgacatgaaatatgtatggtctaatattttaatagctagagttttaagttaatattaaacatatgaaaatgaaaacaatcaaagaagattcaatctttaatttgtttattttatttttttgaagaacatatgttttaagacaacagcatttatggcttgatatagcttgatgacataccacttccctagcatgtgaaagggcctatgtttcatcaaaagcatataaaatgaatagagatttagaagtagtgtgtctttatagaaatttacaacattctttaagcacaattctattgttacttagattaggacatcaagaaatactcttaaatgacaaggttcagattgtcaatatttcagaaaaaaattatcttcaggtagtcattttagaagctcaagatatggcttatcatgtgcagtcaagtatgaacagaaagttatgcatttgactgaattcagtatagttaactagatttttatataattttgtttaaaacctctgcaggtcttcacagtgaagtctcatctcttttgtaatgctaaatttatatatataatataataagtaaaatattataacaagatagagaatataagattcaatacaaattatttcatataaaattggatatgacatatctacaaagtaactgaatttattacacacaataaaaacttagatatatgtaaaatatgtgtatttttattatattgtcttagaaaccaattttaacatcagtaatattaattataaaacatcataaacctactatttttatatgttaggtatcaaattgaaattggctgagtgaatacaatcatacacacatttattgtttttacataattacatcgacttctgctccttacataactgctacataatagttacatgaagtgtgcagttgttagacttaatcctgaaattttaactctagtgttaaatcgtttgtaatcatgccataagcctttcagaaatacatatacaaaggtatcaaaacctaatatgctgaattagattctttgacatgaattatgttccgatataaattatgacttcttagtgtttacttttactaaaagcccgggggagatgttgtaatgttctaaataggcaagaattaataagtgaaagaagactaatggcacaaaattattcttagttatttagactggtacatctgcataatgcaagtggtatatgacttgagatcttttttgctgaacagaaaaaatcttttctaaaaggacttgataagaagacaagattccttcattttttctagaatggaagtagaaatacactaagaaacacgattcattatttttctgagcaatctgaagtttcaaagaaatattcaaactcaaatttacatgatgtatcttccacactacctaattaaaagaagaatgtattttatcaggtataattaattttgaaaagtaaaaattacttttatctaggaactttgaggttgaaattatttctatctatgcactgttttgagccattgtgtttatttagtatagtagtgaaaactgcagtgaaaactttttaattgcactacaagaaaaatagcattggaaagttcaaaaaataacgacatacagtgttttaattgctgtatgacctttttgttttttcacacatttgttgcttagtatataatgtactttgtatgctaaggtattaaacattcaattgcaattgtgtccaatgatcttatcaggttgctggcaactgttagctgataacagtatttaggctacatttagtctatgctagttatgtgatgggttaaaaagaaaaaaataatattgatctgtctttggattaaagtttgaaacgggcaacagcccgaacacaaagggcactttttttttttatgatttctcagcttgccattgatcttctagttttattgcattcattatttattaaaagaatttgcaagctaaacataacgttaagctagtttgcacacagggaccgcacttaggaaattgaatggaaattgcattagagatgaacatctgtgctatttttccactcatgtgtttatgggtttgtataaaaggtgtattggattaacagttatacgcattatagcttacagcaatatgctagagtttgaactttcagttattttggaagaattctgttttccacatttgtctaaataacatcgtactgtcatagcgaactgtggataaatttaggttactatagcactagtgcatcatttatattccccttttgtgtgatcctctgttgtactaaaatataaacattaaacgtaccccacaattattgagtaaaactgtatcatcatcatctcttcctggtcttcagtagtacagtaataaatgcaattgacataattcttagctaagaatcttgagtcagtttatttccttttttttttttctccccagtagtagtgtggattgacctaagagtctcatacttgtgaggcaagtgctctacctctgagctctaccctcactggaagaaactggagtttaatgccatattaggtcattcataagaaagctaaactaaacacccataagatgttattttgcatgtatgctatatcatgatctatctgaaagtatatacatacatacattgaatactactatcaatattaaggaaatctggcttctatacaattcctctgaatgttcagtgccaagaagtttagttccacttagttgttatcccctgaaagttcttttaaggacatatgtcagacctcagggactctcgctttcaaattattgcctttaacttgaaggcatttgtaaaattaatcccttatttaagttttgtgttttcaataaacaaaaaaatgctttctcaatcactttgatccatcatcattgatcaaatttattatgttgtgtgttcagcacttattatgtatcatgtgattttaaagcatataccatgtgatatataagcaagagccaccattcttgtagatgtattttgtactcatcatatctttatctcaggtatatcagatgtaatcacattatgcctcattgtatccactaatttagtatttgtgataagtgttttgcaataccagttgtcaaatagtcccacatttccatagacatatctgagtcatatgtatatgagcaaacactggaatgctttgcaatctttagaattatattaaagaggtcaagctaaaatagtgggagttactaaacatataattatagatgaaaattttgcttttatgtggagaaaattcattttcagatctagttcagacctttattgctggcacattgtcttgtataagattagatttcaaaaattaaaatgaaataaaagcataaatatacatgcagcatatatatcacagctaacaaaaggggactggttcaaattggttagtgaaccactaacagtgtatttttcttgaatctactcttatgttgtctgtggaaagatctatgatcttaaatgatattgtactcatcatagactgttagcatgccatgaatttgccaaattcaatgatgcccattgttaattttaacatgtgtcctgagcttagaaactctaaatggcaatcttctatatgttaaacatttgagattattatgacttacaggtcaaaacacaatagatgaatatagcttgaaatcagagttttaaggagtattttcactctatggaaagaataattaattctcaatttgtagttcttgaaagaaacaatacgatcccaatgttgcttatggccagaaatatcagttattttaacatgagcttaagtagaatgttatgacctatgaagagtatagtaactgttgcagagcttaattttttaaagtacttttgatatagatttattctcatatttgtagttgttttggaatggcccttgtcacaagagaggactcatgggatttttttttgtttgtttgttttaggagcattcccttttccatgagtttgtatatttctgtaatagcagaagggttactctcccagagcctatggctctatgtcttttgcagttattttaaatcaaatgatgtctttgctgtgtactcagtttggtatttttgttttatattgttctttggatttttgtttatttctaagtgcactgttagtttctaaatacacattaaaaataaatttctctgtttaggtctcttttatgttagtgagacaaatgtaaacgtgtttgacataaacagattcaagaataagcagtagaattcaacatttttattccaattagcctcatgatgtcaaagaaggctggactgtatttggctcatgctattattgtcataggtttatttgaacacaggcaaaggaattgagctattaataaataagagcatagagaacctgatacaacaattctcatgcaaaaatagtataaaataaggtatagacagacagaatagaatgcattgatggaggctttttcatagagtttctgaatgaatctctcatgcccatggattattcccagtgtcttatgcatgctgagtaaatgctttaacactgaactttatattgcccctgaatatctttttaggtttttgtcattttttgtagtgatgagcttaaacagattcatgtactagaagtataggcataaaaataccaactgtgaatgaatctagaaattctaatggcaaagtattcaaatatttttatacctgaagccaaatggtggtgaaggagtgacaatagaacatttgtatgactgttgttataaaaatctactattctaagtgaatattagcccagaaacttagaatatccaagatacaatttgcaaaacacatgaaactcaagaaggaggaagaccaaagtgtggatacttcgttccttcttagaatgggaagcaaaatacccatggaaggagttacagagacaaagttcggagctgagacggaaggaaggaccatccagagactgccccacccagggatccatcccatatacaaccacaaaacccagacactattgcatatgccagaaagagtttgctgacaggaccctgatatagctctctcttgtgaggctaagacagtgcctggcaaatacagaagtggatgctcacagccatctatttgattaaacacaaggtccccaatgaaggaactagagaaagtacccaaggagctaaaagaatatgcaaccctataggagggacagcccagagctgtgtctctagttgcatatgtagcagaggatggcctagtcggccatcaatgggaggagaggcccttggtcttgtgaaaatcatatgccccagtacagtggaatgccagggccaggaagtgggagtgggtaggttggggagcagggtgcagggagggtataggggacttttgggatagcatttgaaatgtaaatgaagaaaaatatctaataaaatagtactattcttgtcatgtatggtgactgtcttacacctttaatcccactttagggaggcagaggcaggcaggtctgtataaagaatttcaggcatacatagtaagaccttgtctcaaagaaataaacacccaaaaccaaaagacaacaacaaaaacagcttaacattcttgaaaatgtcactttaaaaaaatgctacagtattgatttgtgtatcatttttttaattattaggtatttatttcatttacatttccaatgctatcccaaaagtcccccacaccctcccatacccactccccccacacaaccactcctacctcttggccctggtgttcccctgtactgaggcatataaggtctgcacgaccaatgggcctctctttccagtgatggccaaccaggccatcttctgatacatatacagctagagacacgggctctggggagggtactggttagttcatattgtcgttccacctatagggttgcaaatgcaaccctatagatgttatgggctgtgtagtagtaacaaatggagataaacaaactagaagcagaaacactacccaaaagctttacgataatatccttaaggtttttgcacttatagaaatactgacatttaattatgttgttttcagaaatacagtaacaaaattcctttggatggatcttctttccatctttccctccctccctccctccctccctccctccctccctccctccctccctcccttctttctttccttcctcccatccttccttagttctctcattctttcattctttcttttaacaggattgcattatgtagcctggataggcatgggaatttgctatataaatcagggaagctttgaaatcatagagatcagcctggctctgtttcctcagtactggaattaaaagaatgagccacatgcctggaaagacttatttatttatgcattcatgaaaaggctggagaatcaccaaaatattaaattctgacttgaaaatagaaaggagcaataacctaagaaattaatgtaataattcatccaataataatattgaatttctgaaatacaataattatcttttctgtttacatgccattatgtgatgtatgagtgtcttcagagagctttgaattctactatggatagaatgtatgaaaatatagagaaattatttctgttctagttacctttcactgtctacttgatacagtctagagtcaaataagaggggagcctagtgttgcctagataagagtagctgtagccatgtctttggggagttattttgactgaaggttgatgtaggagggtatagcctttgtaggctgtactatctctaggcaggtgggtctgggccatacaagaaagttatgagccagatagtgaaccagagagacagtgttcctctatggttttgaatttaattttctgcttgagttcttgagttgacttgcctcaatgatagactaaaacctggatatgtaaacttaagttgcttttggtcagagtgttttgcacagcgatagagattaaaacagactcccacccttccctcgtttccttctttcctccccttcttcactcccttccttttttctttccattcttctttaccaaatagacatgaggtattctcttctgttcagttttcttccttgtgtacatttaaaaaataaacaagtggagtgtaccgcatcaaagcagattatattgcacgttagaaggtagtaagcactgtggataaaaacagatcagggaaaggagagttaacacaaaagaattcagggaaagaatgccaaaggttgaggagatattcttgacccaaagtcttaaaacagcagcatttccagcacatttgaagaacattaaaaatactagtatggctatagtggagtaagggaagagaactggaaagagaacatactggtaatgaagaagtttgtttatacatatccttagagtcatctttaagattttgccatgaacttatataatggagagagattcacatgtagggttttaagaaggggtataaaatgagatagatcatcacttgaaagtaagggttagaaaaagaggtctggaaaggtggcaacaggaggaaggatttatagggaaaatttgagatagccattggagtaactaggagaatctactactgaaagaaggcagttgtcattacaagcccattgatacttatgctcataaatttaaaaagatcaatgagattttgtgtttctattttaccaggtagaactgcctgaatactgatgcaaagtcgttagacaatctaattttacaagagctgtggttttgtcatcgaggtgctttcataacaaagtaaaaggcaagacagttgagtataattatctttgtaatagataattataacacaggaaaatgtactgtaagttgttggatagcatgatgagagacagtgaaagattagaaattgcaggaaaggttcaaagtgttttcagctttggagtactagaatgagcgaaatgtgatggtcatggaactagagatagtaaatgcagttatgtttgtcacaatgttgaaggtcatgacgcatggctgaatgtggcaaggttgctggagaagatgctgagaggcacaaatactggcatgatgctttgtaacatgtccatatgcatttttactaaagttggtaagtattaagaaaggagtcaatatatactacttatagttttctattatatatagttgtgctatctgggttagttttgttaaaagaaatcactcttatttcctaaaatcttaaacttcttgaaatttaaaagtatttgaactcaacctgctcaaaaattgttttaaaagcaaaccatatgcactatatcatgagaatttggatactgaaacaagtaacccatgatttctcatgcatgtgtcatattaaaacaatattgtgaaatgtgacattttctaagtcattgatatagtgtttggtttctattgtatagtgttaatgttatctgacaacgaaagctaagattaattttattacaaactgtttctctaacagaaattctatgttccacggtgtgtatttattgaaggtattagtgtaccgtctattcatgaagattaaattaatactttcaatcaacacattactttttttttgaaaaatactatacatagcccatcacagtgcataactacaaagtagccaccattatttacctatggttaggtcataatgtattcaaagtggcataagccagatagatatctacttaacacctgctgttttggactcatgcattagaaaccttgcaaggaagctacttaagaagcccctgctctagttaccatttttaaaaactccacatagtctcctttcaggggctctttgaccttgaatgtttgatgatgagcaaatagttaagctttcaatcaggttctcatgtaaaatcattgctgaggaaagctaagaagttggtgacctctatcttaattctttgctaattacctaggaaacaaatttgctctggtggggcttgtccagccgttcacctggcatcctaacagagtagttgggaagaaggatttggtcagcatttgcaaactcccattaggtcctgtcatggattctgagtgagttttaatttctgcagatggagaataacaagggaagccagatgtagtaacatctgctattaagactcttgtttaagggtgaaaaggcaattccattgttagaattttattttagctctgttggattggattcaaaaaaaatcttgtttcccccttttatttagcattggaaaaagatgtatgaatatactaaaactgggctatctcaattaggaaaaacaattcaaaacatcatagtgagaatatttttaggtaaatggaccttaatatctaatgcaagaaagaaaaggagagaaacatgccaacacacatctaatgtttcaagtctgaagaaatgaaaccttcaaatgaagattttattcaacatgaatcattggtaagatgacaccaatagatatgcaaaagtgggtagggaaaacatccaaaaggccttaactctatacaaagaactatgggcatctaaggaatgctaagagttagagaaacagtctttttctaggggagagaacccaaattggttgtccagttaaaaaaggccagtccttaaattgtacgagtaacctacagaatactgaacatgttatatttagaaatatatacgcacatatatatgcaatagcaataaaagaagccatgaatttgagaaagagcaaggggaggatgtgagagtgtttgaggggaggaaaggtaagggagaaatgatatatccatatcataatttccaaaaataaaaatgaaataaaaagctgaatgaaagtacaatgatataatataaacacttcaaggaaactgatatcagaaaacaacaacgttgagattccttcctaagaataattgctctattcaagatcttgttgaaagcagtggtattttaaacatatacttgaagagttacctctggagagagaattctctcactcacgttcagtgatctttctaaatttatatttgcaggacatctgtcttctcacaagaatgcatgtgtgcatacgtgtgtgcatacgtgtgtgcatgcatgcgtgtgtgtgtgtgtgtgtgtgtgtgtgtgtgtgtgtgtgtgtgtgttggtgggtgtgtatacaaatgctcaagttttaaggtgttcatgctttctttttccccaaagtagcagtagcttgtgaggtactcaactttaaaaacattctgatgtgtcgttttatgactcagagtaccaaacactttatgtggttgtttaagtactcaaaatgttttcagtttgttgtttccttggtgcaactatgagttattataatgaaatgtatttacttttggaaacgtttgattttagggagatttattgttttactttttgagtatattattatgactttgattgacagctactcttgaaaaatggacgctcagggaattttcattgtcttggacacttcatcctcttttgagtactttatctagatgtacgaccttccaagcctcaggttttcatatgagaatatgctaaatgttagtgacagaactcccaggatttctaacattaattgacatagtgtataccaagttcttagcacattaaatagctttgtagatgttagctcttgacagtactaaagtggtgttcatagtaataaatgtatgtatactaacatatgtatataatactttctgagtagaagcaaaagataaaaattcatagtaagatgaagcagtttccagtaacttttgtaatgaggtctcaattaactggttgactgtgactgacatagtatgcaattcagtttctaagaaattcctgtgtgctgacttcttaggctgatatggcagctggtaggtcatttattactagttctattttggtggaaaattcagccttgtgtgtcatttagagtttgtgacacatgtaccctcccaaggcttaatgagttgtctgcagatgggctgttatttattacagtcatgtagaataaaattgattgtcttctaaaattaatttttcatttgcctccagccttgctttaatagaggacacacagttgcctgtttgcagaaatactgtttaatcacattaatatctcagccccccaggctgaagaagataattgtacaaacgaacagcaaaatctgtatctttaacttctttttatgattaaattatgcaaatgacttatctcctgcccttccaagcactaatcatctaattaggaatgatgtgttaaagggacggttttgaatcaagagagggacaaatgcaggaaacagaatgggagctgacagtgaaaccactgaatatacaggaatatgtagtggaggaaatctgtgtggttcacatgaaaagaaacaggaagacattacataccttctatatacttgacatgtttgctctgttggcaggaaaaaaaataattctcaagttttggtgcgatattctctaagattaagtcaccagtaagggttttccatcatacccagtaaagagctatcttgtgatatgaatccttgttagataacctatatcaaagtagtttaaaacaccatgatgtaaactaagatttttagatttctcctttcaaaaaaacaataattttctcctgaaaacttgaagaaagtctagacatacaagcccataataaacatacttttcccaattctcagatgataattcaatattaaatcataaaccatattaaaaaaatcttaccatgattctgtacttcaaccttcagaaataattgtaaaaccttttaagtatctaggcatggtgaaacctgcttggacgcactggaaaggccaagaaaggaggactgcagtggattcgaaggcaatctgggcaataaactatgtcctaggccaatctggcaacatggaaagatactggtgtcaataaatgaaatccaagcgaaccaaatgaaaccaaagaactttcagcaacggagtcatatgtttttgttatcactctagtccatgtaatatagacgttattattaaataacaacaatgaatgagtgtagcaagttcaataaatagcattattatttcttagaacctttgtcatttgtgaatgaacatggttattataatagtataaaacaaataatgaaagtcattgaatgaagtttattatggatactatagaatatcctagtcatacttctttgaggtataactttataagacagagaccatgatgtttgtatttcattgattgcagtgctatgctttagctttttaacagtcagcttcaggatatttgctctacataatgcaaataatttcctcaagcatttgacaacaaatgctcaagaaatctatcctaaatgtagtacaaacaaaattagacttctcttgctattttaagtttaggttattttccttcatttatagttcaagtcactggtcatgtctagcctctattttctgttgaaatatatcagatcctactggatctgcatgtttattcatcatctttgcttgttaagagaagatatcaagctatggtttctctgcttttgatggaaaaaatgatgaagttctttattcagacaattgaagccagttattttaacttattaaagcttttttgttaactgttttgaacattgttctgaattttgtattcctgaagattatttatttatttataaatttagagaacacaaccttaatattatacaaaattcataatttccaagttaatttgtggatgtaaagcttgggttctgagaatctattctattgctttctccttttcttttggagagttaatttttttccaaacaaaagcataatattactgaattatatgattaagaacatgcttaaaataactgactgaacccctgttaatacatttaattttagaggattgaatatattctcagagaaatttctgtggttttgtagtctaaataagttaaagatacattcctttggtattaaaggagtcaacgaagaatgatttcaatatttgcaaataacagtatgtgatttttaatccccaggttctaataagttttccacataacatttgtagatggagtggaacaaattcctattatcttcttatagtaaaattaatgtttttattagttatataaataacttaagcatatctgctttccttggccgtgagagctcccagatctcttaagatggagacacactatcaagtgctttccacatcttttgtgttcttaaaaaaattttatagaatgctaggattatgagaaacagattttaaatcacagtatggagcaattaagtactttatgcctgtcatcaggaacactgaaaaaaaaaaaaacactgaacctaaagttccagtatttttcttcattcaaatgctaaaatgagaattttagaaaccaagatgattatctatcaggagggatagaggcatcctctacacagcaagcctatattctctgagaaaagaagacacctcaaaaaagtttagtatttgttttttcttcataaccagaattatgatcttgttttcttccaattctaagttgaaatgctgtggttttaatcacattgaagaaaagaaaatatacaagattaaagttccactatcttatttttctctccatatccaccaattgggataagttagtgatcttcagaaaaacttcaaattgatgtacatatatggcaaattgatacatataaaagctggataaaagatttagagtcaatggcctatttgcctctcgtaaacactacctgtataggcaatcccagtttcttcaaactgtagggaagcaaagtcaatacctttctttagtatccctgtcagctctgtgattttcatttccttttctccatttatttattcagtgtggtgagagagaatcttaatgagacaggacagggtctgacctggggccataatttctaggtaattagttcaagaggcagaggcagcagaagaacatggtttttagtttgctaaagggcctcattctttccctaatacacgctttgccttctggcatgctcagttctcaagcatctttcccttagttgataccagttcactggaagtaattaatttctgtcttctcagtaagggtctttgaagtttattcacccaactccattagagtatctagagtgacatttattaactatagattatctaggcttctttcatacatgttccatgtattatgatcactaaataaattttcaataaccttctaactataccagtatttactgtcaaaacatgatgcgttaagtcattccttactgtgcaactacacacacacacacacacacacacacacacacacactactactagtataataatgcaattaaaatctataaagtcatggtattagtttctgtgttttggtcatcatatatgatccagatactatgatcatgatttttgtacattatttattttgattcctataactacattagaagttagtcattgttagtctatttttatagtggatagaatcaatgatcaaagcaattagttaaattgtcaataataaaaaaatgtcaataataatagctcatcaatggagacacaggagttctttgacaacaaacttataattctactgtacaattctgaactatccaacacaatgtattaactaaaaatctgcaaattaaggcatcatggatttaggctttaggtaagggtgttcgaatcgggaacagaaaatttcaattagctcatatttttcttagtaagatagaaaacacattttgaacattttatatataaacatattttcagagaggtggcaaataaatgttaatgaaaaatatgaaaggacccagatatagctgtctcttgtgagactataccggggcctagcaaacacagaagtgtatgctcacagtcagctactggatggaacacagggctcccaatggaggagctagagaaagtacccaagaagctaaagggaactgcaaccctataggtggaacaacaatatgaactaaccagtaccccggagctcttgtctctagctgcatatgtatcaaaagatggcctagttggccatcactggaaagagaggcccattggacttgcaaactttatatgccccagtacaggggaacgccagggccaaaaagggggagtgggtgggtaggggagtaggggtgggtgggtatgggggacttttagtatagcattggaaatgtaaatgagctaaatacctaataaaaatggaaaagaaaaaaatttttgaaaagaaaaatatgattataagatgggacaacaattttcaccttgaataatgaatataagtttattttaacaagcaatttatccactgaaataataaaataattataataaaaagaatatatttcaggttataccaaaattattgaagctaccattgttctctttcttttgtatattgccttttaaatgataaaattgtattttgaagataggtaataacaatcccttaaaaataatttttgctgttgaatgttaactatgatgtttatggagagttataaagtaaaaaaagtcttacatctctgaagcatagtatttaattatgcaatttgctgtgactctaaggacaatgagatcatgtttcatataatatcacaagggaagtatattgaggaaagttgtaatcagaatcagcacaaattctggttcatacacctggcaaaggttcaaaggcatagaatattttagtcatttaatatttcttctaatgatgcataaggattcttttttctctctcttttacacacacacacacacacacacacacacacacacacacacacacacacacacacgcacacacacgcgcacacacacacaattaccgccacctctaccaccacaaccaaacaacaatgacaaaaaacagaacctaatttaagaagaattatgacttatctaagataaactataatggtggaaaagaagagaggtttacttatttcaattttactttgagtctgctattcattggatactgttttttttatatcattttattatcatctggattcatttggggaccctgaatttgcttattaacagtagttaatgaagtgttatagttattcaggataacaataaaatttcatgagctgagtgagatatttaactgtatgttgtataacatggtcagaagtcccagctgcctgtgtcagaagtcccagctccctctatcttataatgtaccgaactaaaaggaaattcttctgcaatatttggtatgacatgtactattagaatgcacagaaatcattcatatatgacacatatttctagatgctatcatgtacagaaaaaagtaaaatatttagttgacatcaaaccccttttattaataaccaataatatgtcttcttatctaatttggatcgaatatgagaaacacattcataaagccatctttttaattcaagactacaaaagttttgggatgtatctgagtttgaaattctcatacgagaaagaggaagttttacgacatataatatcaagtctcatggtaagtgttagacaaagatagattaagtacagaaggtagagagccagcagaaccttgtatttgagtaattatcacctattactatcacactttacacagaactactgccatacaatccagggataaataactaaggcatggtgcccatgtaatgaagtgagctagtctacttattaggtaacctacctaacacaaagaacacaagcttgcaaaattttatgttggctggcatattttatacttttatctctatagttagtaaaagaaacggacctcttgagtcctttccctttctattaatgaaatgttgacaagccccatcttatgagggtcttgggtgcaaaatcacagcttcagtgagtttatgagggtaacagccatgccatatccagaagacatctgttttgcagcataccttcatatcctttcagtcttgcactctatatatcccatcatctgaagtatttactgaatctttgagggacacatagacctatttggtgccaaggagtccactaccctttattcacagcactttgaccagtgactcacttttatgttacccactactcactttaggaggaagcttctctgatgctgctgagagtagcactgatctcttcccctgtttcttttggaagacagtcaatttagtaaaacaaaagcagtaaactgagggaccatcaacatcccaactgggatttttttaaacagaattttcatgaccatgcatgcgttctcacctgttgaaataagtctcaaatccagtcattggttaccccataaaatatgtgatactattgctctaatgggcccatcttgctgtgctcataatcattgtattctattgttttaaaattgtgtgtgtgtgtgtatgtttgtatgtatatgtgtgcgtgtctgtatgtgtgttttaacaaccacaggaagactcagtaattaaatccactgcctgttcttctataggacccaggtttgattcctagcacctaaaagggggggctcatgtccatctgtgactctattcacggggtatctgataatctcttctggcctctgtgagcagcaggtatgaatgtggtagataagcatacatacatgcatgcaaaagtcttgttcacataaaataaataaaataaaaaaccatatgtattaagtatttgattttttcacaaaataatgacttactaataaatactaggtatgaaataagtattcaacttaattaaaacatcaaaattacaactttattattaaaccacacacataagtggttttaattcttactatttaatctgtttcttacaagcttagcattaacagtggaaaatactttcctgacacatgtcatagtaaaattttgatatgtttgcaaagtgtgtgtgtgtgtgtgtgtgtgtgtacactatcataggtcttattgcatattgaatattcactgaacggtacctaacattaacagtatttgcaaatgatctagcctttcattatgggtaatagaatagaaatttagtgcactattattactttgttaattatgcaatcttctaatacaacattccactactaagactatatttagtattaggacaggtataggactcccaagaaaaaaatggattttcctgtttgctacctttaaggaagcctaacaaaatgtacacgtggtagaaaacagaagtgtgcacttctaaaagaatagaaaagttaaagatatactgtagagttttcagttctataaaagtttagagaggggagctatcttaatattttatggaacttggtaccatatggagaattgcagcttcctttgtcacagcatatataccattcataacaattttgatattatttttcttttttgaggggtgtgtcttaggattttttaaaagccagtagagcacagatattatttttctatgcattatggtgccctctggtaaatgtacattctagtaaaagaattttgttctattggctttaaaaaaagtgtttattttgtgaagtattgcaacaaaataaattctatttacccataaattttgtaaaattatggcatattcaataaaataaaaaaacaatattcttgtttttaattaaaatttttaaatgattgtaacttaagtctgtgtagatttcttttaatcactacatacataaaaattcatctgtcctcttcaattatcctcataggtgagaattaagttaatctgtttgtatattggaaagtttatatggtgctgtttgcctttttaaagatccagaagttgtttgatgacacatcagtgaaatagaaacaagcaaaggacagtattattctacatgagaaaacatttgatttatagtctcaaacaccatgtgtcaaactacgttgtacaatttacctcctttaaaaccaccttttacgttaaaccatttaaaaacatgcttgcaatggaacatttatttcattattttctggacatgactggcaactagtttgtgtttaaaatggtcctgtaatagtatagcaagtcagggttaaatatatgttagatagatatattttaacaagcctggatatagaccattacctttcagtttaattcttgacctttctctaggagtgaaaccacagttagttcaaataataatgcagctaactttattgagcagtcattctcacaattttgagatggcaggtttcactgtattgttcagacgtgcctggatctcctagactcagtgaatactcctgcctcaacctcctcagtatcttacatacaggcactgggaatttcaatggcttcttaccattattcccttcaaattctaaggacaaatatatctttcagataatttaaaaaatatgatgacatatgttcagataactgtgggcttcattcacttatggtatgatactttgttattaaagagacttcattttgtcactgaaaagatatttgtatcttttttttctaagtaaaaattgagtttaagaaaaatatattgagcattttgctgtgtttttgtaagcaagctttcttgtgcacgtcattgtgatgtcatctttctgccctactggtgccttctttgcatatctcttgaaacattttctgaattgtcattttgaaaaaatatgttgaaaattctgtatgatgtagaaataaagaaggctactccaatgaagataattttattgaaggacaataagtatcatcaagatatcctttgcctaggtatcaacatatagaatttgatccacagtaatactcatatgtaggcatgtgctacattttgcaaaatcacttgcaaaattttcatgagaaaattcacaggattaactaagtagaaaagagtcacaaatgtcattttattgattcagccaaaatcaatcatttgtttaactgtggtgttcattcttttaaaagatttatctatctatctatctatctatctatctatctatctatctatctatctatctatctatctatctatatgagtatactgtagctgtcttcagtcactccagaggagggcatcagatcccattacagatggttgtgagccaccatgtagttgctgggaattgaactcaggacctctggaagggccttcattgctcttatcatcagtgctcttaaccactgagccatctcgccagcctcctggtattcactcttatatactttgttatttaatctattatgctacttttcaacagaaagtagttatagactgataatgagaaattatatggtaccaaattatatatacatatatatgtacatatatataaaacagtaaaattttgctttactagattatctttaattttatttgagtatggtttatatatcattgttcatgatccctataaaatgcagtgtaacctcaaattattacttgtttctttttttctaatattttgtgtgacataagacaagtcattattattttctcagctctttttatctatactttgcatatcttcctgattagttgatgatttgaattaaaacgtgacaatatgttttttgtgatttatcagttagatttatatcagaaaattctcaaccaacaaaatgccaacacaataaactcagagcccataggtactgatataaatggttcaccttgatgagtcaaattgtcctgtcattatccatcccttatatgacatagctacctgtggctatttaaagccactaggatctccccccccccattttattaggtatttacttcatttacatttcaaatgctatcccaaaagtcccctataccctccccatgccctgcttccctacccacccactcccacttcttggccctggtgttcccctgtactggggcatatgaagtttgcaaaaccaaggggtctctcttcccaatgatggctgactaggccatcttctgatacatatgcagctagagacacgagctctgggggtactggttagttcatattgttgttccacctatagggttgcagaccccttcagctcttgggtactttctctagctcctccattgggggccctgtgttccatccaatagctgactgtgagcatccacttctgtatttggcaggcactggcatagcctcacatgagacagctatatcaaggtcctttcagcaaaatcttgctggtgtatgcaatagtgtctgcgtttggaggctgattatgggatggatcccccggtggggcagtttgtggatggtccaccctttcatctcagctccaaactttgtgtctgtaacttctaccatgggtgttttgttcccaattctaagaggaggcaaagtgtacacactttggtctttgttctccttgagtttcatgtgctttgcaaattgtatcttgggtattctaagtttctgagctaatagccacttatcagtaagtgcatataatgtgagttcttttgtgattgggttaccccactcaggatgataccctacagatctatccatttgcctaggaatttcataaattcattctttttaatagctgagtagtactccattgtgtaactgtaccacattttctctatccattcctctgttgagggacatttgggttctttccagcttctggctattataaataaggctgctatgaacatagtggagcatgtgttcttattaccagttggaacatcttctggatatatgcccaggagaggtattgctggatcctccagtagtactatgtccaattttctgaggaactgccagactgatttacagagtggttgtacaagcttgcaatcccaccaacaatggaggagcattcctctttctccacatcctcgccagcatctgctgtcacatgaatttttgatcttagccattctgactggtgtgaggtgaaatctcagggctgttttgatttgcatttccctgatgattaagtatgtttaacattttttcagatgcttttcagccattcgatattcctcagttgaaaattctttgtttagctctgtgccccatttttaaatggggttatttgattttctggagtccatctgcttgagttctttatatatattggattttagtcccctatctgatttaggattggtaaagatcctttcccaatctgttggtggcctttatgccttattgacagtgtcctttgccttacagaagctttgcaattttatgaggtcccaatgtgacaatattttcaaaacatcaatatgatatttttacccctccttccactaggctataggctgcttatggttagaaaccacatcttattctattatccaaattttaatgtatgaaatatgatgagatggtagaccctgatgcagctacatgaaatcaaaatgattaggaccaattatttgggatagaggcagtaacatgccaaaagttcacaactagctggtttatttagtcaatttcaggttagtcaggattatatagctaaatcctgtatcagaaaacagtctcaaaatttgcaagaatgtatactttctgatataggagtagggaattgaaagagcagaagttgttgattaattgtgattgtcaacttgataggctctataaacaagtaggagacaagcttccaggcatgtccatgcttgtaagaaattatttagattaagttaatctttgggcaagtgtatgagaatgataatttctattacattaaatgagataggaacatgtggtgtaagagtcggggccaacattctcttgccttggatactggactgcatttaaagaaaactagtttagcaccagcatttaccattctctgcttcctgactttggatactaactatgtagtcaagtgcctcaggctgctactgctgcaaagactttactactatgtactatacagttaaacagggatcttaaatttatcttttttttcctcttgttgcttttctcagggtgtcttgtcacaaaatgagacaagtagttaatacacgagtatttattcaagagccagaggcataggaacaatagagaaagtgccacgggagtggagagggtgtagttaatgaacttccacaatttcccagaggtgatcattttagaatgtgattttgaaccaaagttagggtgacagggaatcctgaataggaattaagaacccaaagaaaatgcacacacatagatatattttttgtgttctgaagagactgtgcaagttgccattattaggatataattttaggtacagggtgaactgcctataaaaaaacttagagaaaatatctgaagaaatattggaagaaaaaggagactagattatctaaaagactaatgtgatgctctgaggaaaaaaatgcttggaacttgacaatgccaatagaatgaagaaaggtttgttttaaagtggtattgaaatgatttaatgattgagtgtaaaatgtaagaggcctcctctgggtaaagaagatgaacatttttagtgattctagtgccttgtgcctattaggaagtcatttaaattttgtctaattgtattattggattgattaaagcttttcactagtgaaagatattcatattattattataaaaatcagtttttttcttttttctagtttgtcacttcagtacactttaagagtgctaaattcactgcaaaatgaagatgggagtgggttggtaggtgggggagctcctcatagaggcaggggagggggatggcatggggtttttttgggggaaggaaactgggaaggaagatatcatgtgaaatgtaaattaataaaaaattctctaagggcaagcaaacaattctatttttcttttctttactttttatttttattttttggaggttgagcagtttatcaagatatggtttatctgtgtaaccctggctattctggaacttggtttatagactagactggattcagacacagagatttgcctgccgctgcctccaaagtgctggcattgaaagtgtgcaccaccattgtgcccagtaacaattctatttttcaagcaaaagcatagcaattttttggactggcttttttgtcactgaggacagaagaaaataggttttgctatttaaaaatactgctaccattatttaaataaagtcaaccttttaatatagcccactagagagacaggcaaacatttataatttttaattggatattttatttgtttatatttcaaatgttatcccctttccctgtttcccctcccctctgcaaattgcctatcccattccccaataacactgcttctatgagggtgctccaccacccacccatccactcctgcctaactgatctagcattcctctacactggagcatcaagccttcacaggaccaagggcctctcctcccactgaagccagataaggccccttcagctccttcagaccttcccctaactcctccattggggtccctgtgctctgtctgatagttggttgcaagcatccacatttgtattggtcaggatctggctgagcctctcatgagacagttggtatcaggctcctgtcaacaagaacttcttggcatcagtaatagtgggtttggtgtctgcatgtggaatggatccccaggtggggcagtctctggatggcctttccttcagtctttgcttcactctttgtccctgtatttcctttagacaagggaaattctgggttaaaattttggagatgggtggatggccccttccctcatggtggggggggcatgcctaacctctggatattatcttgacaggttctccctctgctttgtggtatattttagctaatgtcgtccccatggtgtcctgggaggctcttgctttcctggcatctgggactttctagtggctacccccagttacccatcccccattgaacacatttctgttcaatttcctgaccctttgtaaatctcctccatctgatcccatacctgattctgcccctcttttccccctcttcctcctttcttcctccaaagtccctcccaccctctacttcccttgattatattttttccccttctaagtaggactgaagcatccactctttggtcttccttcctcttgagcttcatgtggtctgtgagttgtatcatgggtattccatgctctttgcctaatatccacttgtgggtgcccttgcatttggagcatagatgttcagaattgacagttcatattgtcagatatttcctttgatagttatgaagtggccttccttatcttttgtgataacttttagttgaaagttgattttatttgatattagaatggctactccaacttgtttcttggaaccatttgcttggaaaattgttttccagctttttactctgaggtagtgtctgtctttgttactgagatgtatttcccatatgcagcaaaatgctcagtcctgcttattcatccagtctatgtctttttattgggggaattgagtccatcgatgttaagagatattaaggaatagtgattgttgcttcctgttatttttgttgttagaggtgtgctaggctgtcggtgtaggggaagagggggaagggagagagcccacatccggccagaattcctgtgctctggacaggtggatgcgggaggactgccggactctttccatgagtgtgaagccactgaccccacatggcggggggaggacaaggggcaacccattctggatacggcagaggagctaagaacagaataggggccccagggcagcaccaggccccagagatacaggaagagggcagaggttcccatgcaggagagagtccttagtccgggccttgattaacagagacagtctatggttttagagctttattatagaaaggcaggaggaaagagaaaaggtaaaagagaaaagagagagagactggccatggccatgtggagagagggagaaatggaaagagagagagttagagagtaagaaaggtaaaggctgagagagagagagagagagagagagagagagagagagagagagaggtaaaagcttagagagtaagagagagagagagagcaagagggagagtaaggaaagtaaaagcttaagagagtgaggaggggccaagcagcccctcttatagtgggcttgttatgttgctgttgctaggtaactggaagaagtctagcctgaaggtcagaagcttgggacattgagtatgtaactgaaagccattagcctctcctgtgggggctgtggggcctgtgggggtggtaacttcaagaggagccaggggtccaggagacatgagggaatgtctacggtccaatgtaggtgggaattaccacccatccaggttcagacctcaactcgactgaagaccagcctgtctgtacatagcccattgccccacagagatggaaatatgtttgtgtttctatcttcttttgggtttgttgaaagaagattactttcttgctttttctagggtgtagtttcctccttgtgttagagttttctatctattatcttttgtagggctggatttatggaaagacattgtgtaaatttgtttttgtcatggaatatcttggtttctcctatgataattgagagttttgctgggtatattagcatgggctggcatttgtgttctcttagggtctgcatgatgtctggccaagatcttctggctcttagagtctctgctgagaagtctggtataattctgataggtctgcctttatatgttacttgaccttaaacacagtggctagatgccatgaagaagttggcaatgcctaaacagtatgtgtgttgttaggcccaagggcctcttccatccctgtcaaggggagtgcttaccttttatcctttcatacaacaccagatttacattcttaatgaatagattctgtttacacaacagtttgtgtaataattgtgtaattattttttttaaagacgttctctgaaattgccagaaaataatatatccatattgtagtggaagtcttaaagtcaagtgcataatgtttaaagtcaagtgcacacatttcagcaaaggaaagatcacttgatatgttcactgttttatttttaagaacctagaaacatgtcttgaacagatattgcaaaagtctctgttaaatttattcttctacagttgacctattctaaatctaaaccttggttgcagcttttctaaaattggaaatatattaccattatctatgtttgatcctattgtgcaatagtgtagtaaaacttgtttctagaacctcataaaaactgagtgctgggcgtcagtccacaagcttttctcttcatctctttccctcttctgtcctcagtatctgagaaatactatttaagtattgatttgtatgaaatgattttttcatatttcacataagtaaaatcaagtattcaattcttttgttgttctacctatttcatttagaatgatgttttgttttgttttttgttttgttttgttttgttttgttttcttgttttttgagacagggtttctctgtgtagtcctggctgtcctggaactcactttgtagaccaggctggcctcgaactcagaaatccacctgcctctgcctcccgagtgctgggattaaaatcgtgcgccaccacgcccggcagaatgatgtatttttttaaatcaagtaattgaattatatttcatatgaaatatacttttttagagtggcacaagactaatgatttagaatgagttgtttcaataggcttaaagtattgaaaaacagcaaaatgacacccaaaggataattatactatcttaaatatgatttcatcttgacaatgtttaatttatggaaaatttcatatgattgttgttaggatcaattcaagagccttgcaaatcctaagtatttatcttctgagcaataatttatccctatgtagtaaaattttaaagcaaaataaatccagaaacatttctcacattaaatcaagacagaatactattaatgggggtggtggcaatcttcctaatatcctcactctaataatagataacagcaaaattattaaatatacttagaaaatatatccccatgctttattttactgtttttttaaaaatgatacatccatttatgtgtaagaaagttgaagctgaagaaaataagttgagttatccagggctacatagtaggtaagagttgtgttctatttctctaaagtataatgtcttcaggcacacaccatagaaaacaagttttgagagttttacaagatttctttccttctttaaaatgagacactttccactttcagtctgtatatactcaattcaatatctttcccccacttaatctggccaatgggaatttccctttcagttcatacttctttctgtactgggcttttctttgtttctcaggttggtatcctgtcctcttagactctatcagttaggcctctgtgtagctgagactgagggccagtagctgggagttgaggtatgcacccagatgctcaattctacattaattcttatctatacttctgcttttgttaccaagaaggagcattcagcctttgtgtaatactttgtatcatattatttagtactggtggcagaattttttagtagatgtattacatctataagttgccagtttaatagtaacaaatctgttttggctgcttcattgaacaggtatattctaaaacatttgaatactgaaatattgattcttagagttttattgcccacaccatcatgacatgggacactaaggaatctggaatgttaaagtcaatatcaaaccagtatttgcaaataaagctactgttcattgtgtgcttctgtaaatataatgataaagcatatggtttggttttgctaatgttaaacaagggggcatattgaaggtagatatgtgacctaaaagagctagatttttcctttaattgttttcttacaaacttagaaaagaaacaaaaatttttatttcacaaaacatatagtttttagataaaatgatctatttaagattttattttgttttcacataaaacacttttgattattttgtagaagtcttataacttactgtgtttgcttcaggctaaagaaacacagacacctcaggcctgtctacagggcacttctctagggccattttcccaattgaggttcccactattaaaaaatcctccagtgtcaagtttacataaaggtagccaggacaatttctttgtggtaaaagtatttatgataaaaaggtcatcaccctttatactagatctgaatatgtatgtcatactgtttcttgcttggaaataggactttttttttaacttcgagtacttttttggggttttgatagtatggtttcttatctctatctatttgtgggttggtattcctggccaagcagtgtatttgtatagaattttgaactgctatcagagaatatattttgttatcgtggcatgatcaataaaactggtgaaatggcttgtgttaggaatggaggatcagggttcatgaattatattattagtttcatcataaacttcctatttgacttttaacatccaacttcatacctattgttcttgaatttaccttctgtaaagtgttataatatttaactacctcatagagaatgttatggagcttagctttccatttttgagagtctcaaatacaaaggaccataacagttattagcattactttattctgactggcatatttgtgggcagttttagcatagcatgtataaataactgagggcagctccgtttcttctctgtagtgtgtagttacatcattttgtctgccttttcctcctatttcgcagggaagactcttgaggtgcttgcttttataaatgtgagactgtcatataggatgtggagatttgtttattttgactgtattctttagacagctaagattgagaagacatgttttagaggaaagatttcctaatatcctttaataaacgacaacttttataacatgtacaaatagagatagtaaacttggtgatctcatctagcctactggaaaaaaaaaaacttttataccaagtgtgttttcttcttggcttattcttttcttttttttttccattttttattaggtatttagctcatttacatttccaatgctataccaaaagtcccccatacccacccactcccactcccctactcacccactccccctttttggccctggcgttcccctgtactggggcatataaagtttgcaagtccaatgggcctctctttccagtgatggccaactaggccatcttttgatacatatgcagctagagtcaagagctccggggtactggttagttcataatgttgttccacctatagggttgcagatccctttagctccttgggtactttctctagctcctccattgggagccctgtgatccatccattagctgactgtgagcatccacttctgtgttttctaggccccagcatagtctcacaagagacagctacatctgggtcctttcgataaaatcttgctagtgtatgcaatggtgtcagcgtttggatgctgattatggggtggatccctggatatggcagtctctacatggtccatcctttcatctcagctccaaactttgtctctgtaactccttccatgggtgttttgttcccacttctaaggagggaacaaaaaaaaaaataaaagctgtcgaccaaagcggtttttagtatgtgataatctagagtgttaagtgaaggcgaaagtaaaacttttattttcaaatatctggcttcttgcgatctaccacatctttcataggcaaatttatgtttctcagaatattcctattgttggtactctaccacagagtcctcagaaaatacttgcataatttccatacaaggcagattacacaggcatccttaaagtctgaactttgaatgtggtttttctttctcctttccacctgaatgtgtggcaagaggcttgtggacaaggcaggcattctaccctctgggcatcatggaccaacaactgaatactttaggctaatattctaaaatccaatttactcaaacgttggcctctgagagcaggcgaatcagtatacaataatgacagagggatagataaagaattttcattgaagcaaaaactattgcaattttgaatgaatgctcagaagatgatgtcagcattcataatccattgcatgctttttagttttgtggttattaaaaaaacaaaacaaaagaagttagcagtgtttaattcaaatgttattgtgacataaggaaatacacttacttagatgctagaattaagttccatgaaaattgtggcattaatttaataaacccctcttgaacccacatacttatcattataggtagtgcaagttagtagtgatcactgcacaaagccatccaaaattttactgagtagagtaatacagttgctagttttgcttttcttcacaatattacttcactgtgaacacaaaaagtctaataatgtcaattttgtttaaaaaatgtgattactattaaccttttaaaatcatatgtatataatgtatatatgtatgatatctcagattttacgtgggagtagtgggtgggtgggtaggggagcaccctcttagaggttaagaggaaaggtatgggatggggtgtcaggaaaggggacatttgaaatgtaaataaataaaataataaaaatatgtgtgtaggtatgtttatgcacatgtgagtattaactactggtgtgtacatttgagggtacatgtatgaaggacaacaacctctgggggtagctagtccttgccttctaccttgtttgagataagcatatcttctttgtttgcagctgcgtgcagtttcaagggaatcttctgtttctgcctcctgtcttgtcataggaacactatgtagtagatgcatactactggatttgaaatcaggtccttttctttggatggcaggagctttacccagggaaccatcaccccagtccaccattaatatttttcttgaattgcatattaagcagtagttacaaaagctagtttggattaaaatacaagtatgataactgctcccctccagtgtcttctgtttccctgtatattcatataaaacctgaaagacaagcgacagccttaaccttaggaatgctgtttaccttctttaagatagggtctgttattggcctggagctctacaattaagttagagaggtccaacctgtgagccactgggatactgggattctctctctctctctctctctctctctctctctctctctctctctctctctctctctctctctctctctctcctgctagaatgacaagtgcccctccactctgtctgggatttctacatggatcctgggcttaatatcaggttcttctgcttaagaggcaggaaccttactgacagaaccattccaaactctgaatgcatggatttttctgttaacatatgtgttaccttcaagtacaaggttcaaagttcttttttaacaagccataatttatcatgaaaaaaaaatctcaaaaatcaaaggaatgtgttactagtagattcatgtaaagacttgtgttctttaaacatctaacaatacatcagtagagaattgagttaaaagtacataaaagacaggaaatcctgacatcagctcaaaagtttttttcctgacttaattaacaaagctttaaacggctactagtattccacctgcaatcaagggtaataaaccttcacggcagaagtcaaattctagggaaaaagttggaagctcacacttacaccataaaaccttgtttattgcaaccattagtcttctaagatatgccccacaatgggatttggtaaagccattacaaggtaccgtatgagttccatttgcctacagtaaatagaatgtcagaagtgtcagggggaaataaatatcgggctggttaaaagggagcagagatggctcaaagcatcattgagaggattgatttatctggcgtgctgtaatgactgcagatgtggatctgttattctagatgagcaatgaatttgatgagctgataacacagggccagagaggcctggttttaattactgatgaggaatttatttgtgaagcactgtgatttactgaaggtttgttctgttattgacaggtgaccttggagctttcctctcctgatgaatccccaaaaaggagcttttaaaagaaataatcaaacaaaaagtattttatctttacttagaatacaatgaagtcattcgagagacattgttagagttgaagctacattcttgctcacataaaacgtgtgctgctttggttgttttctgcttgcaattgaatgctgatttgtactgctaagtataggttatatttttcctcttaagccaaccttacgtctctgactagatgtgtcatttatcagtctccttttgtgaactgtatgaacttttgggccagatctggatggagatttgggatgtctaacactgttgcttcattaagttatagctaatttgtgtaatatgaattgggagtcataggggactttgtggctcaaacacagctctgatgatgagtacccttttcttgtttttatgaatgatatagaatatctaaattaaagaacacagtgtcaaaagaccagtattcatttgcattcatttgtatttactgtgtaactccttttttatatgtttcggaattgcctcaagttaacaaaatgataattttgaatatttgtaattccattaatacagctttttatcatggctgagtagagttggtaaggcaagtccttgttttttttaatttaaataatacatgtagactttgttttgcaatgtaaattcaaaagagagtttctaattaacacttgcctattttatttcaattggctgctgagacacgtgatgcagacttttgtgacaaccacactaatgtctgtatgtgcacactgttaagagttaatagcaaaaagaattgaccctgtccagtttatggatacagtttatgtttacaagctattaaagtcactaaagtaagaaaatatctggacttcaaaagctgtgaaaaaatgcatgcattgcattggatggcattaatgtgcactgaattgctacatgtttgtttggcaaaagccagggatctcgtcagttttgagagagtcaacagatttccttttgtagctcttacactttcttgcaattctttcttatgttgtttttgtttctaaggagctacgaagcagtgaccctgcactttctttgtgagaactgtaatgctttctgcaaaattatacaatctagtatgctggaaaccacaaaactgtgtatgacaaaaatatttttttgtatttcatgcatgtaataattgattattttatttgcagtgatatttttattaatttgcatcttgagtagtttagactgagaaaaatatttaacaaatatgagtgttttataatgaatttataatttaattatctttaatcgtattattttacgatgtatccaatatatatttagaagttgtggtatttttgatgcatgaaactagttgattctttttaaagttgaagactaaaagtcattctataatagcaaattattttctttttatggttttatagttttagtctgaaaatattcttttcatttctcacattttttcctgattgtttacaaatgtaaactatgtatagattctcatatagtcttattaactggaagcgttacttctcatattactgaccctgcataagttatgaaccaataaactactgtcaaatatgtctctaatacagtagcaaacttctatcaatcacagttcaacgatatttattttgccaattttaaatcatggtacttgatagatcatggatgaaattaattttcatatcaaaacttttacctagcagacacagaagcagcagtgctctcaaggcatgcggcttatttactttaatacatcctttagacccttgaggccaatctcctaacagaattctattactgatttttaaaagaaattcaaagagaaaaaattagtaagaagaggtataatataatgcctccagcttacttggtgcctgagatttaccaagtaaattagtaacagtgttatacacaccagttctctctcttgtagtgatatagagagtccaaaattgtgtattttatgtagcaaatatcccatgacaccactagtatttgtatgggtgtacccatcagtaaaaataaatttgatttcaaaaattgaaaaataaagtttatctagcgaaggaattgacacgagcgaaagtccgttgttagttaaaaaataaagatgattaagttgaagaatgagatcactcggcaatatgcttgccacacatgctaagaacctatgtataacaccggcacataaataaaatacaggaagaacaatgccatgtattggaaatgatagaggaaggagatatgagaggatccttggtgttcactgacaaactagtcttgccaaattggtgagctccaggttcaaagagaaatcttcctcaaaaactgagatagaaattgatagaggaaatgatttgattttgatattgatgcctggcttccataagcaagcatgtgtgtatgtgtggcatgcatgtacgtgtgcacccacacacacagtacatacacaaaagacacacaagcacacatactcacacaaatacacaatataccctccacactgtgcacatacgtaaaaaagtacacacacacacacacacatgttaaaatatatttagtttttaattgctacataaacacatgagaagttacatggtaaaatcattccaatgtgaaaattgtttttatctctctggataggtataaatgacagatcagttttcaacctatacccttgtggctaggtattccttcttttcttccttccttctttccttccttccttccttccttccttccttccttccttccttccttccttccttccttctataacaaaataaaatatgagaaaaacacaattacatcaaagttggacaagacaagcttactgaaacaaaataatccaagagaaggcacacgatcatagccccacttgttcaagcactgaggaatccgatagaaaccctaaactggaaaccataagtgcagaggatctggtgcagccccaggcaggccctgtgcatgctgccccacaggttttgtgaggtcattatgagctttgcttatgtttatttagaggatcttgttttcttggtatttttcattccttcttgctcttacactctctctggctcctcttccatagggtgtggcttccctgagccctgagggggaaggatttgatagagacatcctatttaaggctgagtgttcgaacatctcttactgtgtaatatctggctatgggtttctatatttatttccatctactgcaaaagaaagcgtctctggtgatggatgaacaagacactaatctatgagtacagcagaatattattaggagtctctttatcaccacatgttttagaccagtagtatttgatttcaccctacttccctgggctatgtagtctcaggctcttggtcaccttagcagtgtcaggtatgggttcaatttcatgttctggtccttaagtcaaatcagatattaattactcccataagctttatgacaccactccctagcattatgtctaggcagaacaccatgtagatcaaagggtttgtggctggattgccatttatatctctcttttcatagcaagctgagtacattccttcatataccaaagatgccagaacacagacagaaactaaacagggacacagtgaaactaacagaagttatgaaacaaatggacctgacagatatctacagaacattttatcctaaaacaaaaggatataccttcttctcagcacctcatgggaccttctccaaaattgaccatataattggtcacaaaacaggcctcaatagatacaaaaatattgaaattgtcccatgtatcctatcagaccaccatggcctaagactgatcttcaataacaacataaataatggaaagccaacattcacgtggaaactgaataacactcttctcaatgataccttggtcaaggaaggaataaagaaagaaattaaagactttttagagtttaatgaaaatgaagccacaacgtacccaaacctatgggacacaatgaaagcatttctaagagggaaactcatagctctgagtgcctccaagaagaaacgggagacagcacatactagcagcttgacaacacatctaaaagccctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaaaaagatagataaacccttagctagacgcactaaagggcacagagacaaaatcctaattaacaaaatcagaactgaaaagggagacataacaacagatcctgaagaaatccaaaacaccatcagatccttctacaaaaggctatactcaacaaaactggaaaacctggatgaaatggacaaatttctggacagataccaggtaccaaagttgaatcaggatcaagttgaccatctaaacagtcccatatcacctaaagaaatagaagcagttattaatagtctcccaaccaaaaaaagcccaggaccagatgggtttagtgcagagttctatcagaccttcaaagaagatctaattccaattctgcacaaactatttcacaaaatagaagtagaaggtactctacccaactcattttatgaagccactattactctgatacctaaaccacagaaagatccaacaaagatagagaacttcagaccaatttctcttatgaatatcgatgcaaaaatcctcaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttttggaaagatcaggaattcaaggcccatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattctaccagagaactcctaaacctgataaacagcttcggtgaagtagctggatataaaataaactcaaacaagtcaatggcctttctctatacaaagaataaacaggctgagaaagaaattagggaaacaacacccttctcaatagtcacaaataatataaaatatcttggcgtgactctaactaaggaagtgaaagatctgtatgataaaaacttcaaatctctgaagaaagaaattaaggaagatctcagaagatggaaagatctcccatgctcatggattggcaggatcaacattgtaaaaatggctatcttgccaaaagcaatctacagattaaatgcaatccccatcaaaattccaactcaattcttcaacgaattggaaggagcaatttgcaaatttgtctggaataacaaaaaacctaggatagcaaaaagtcttctcaaggataaaagaacttctggcggaatcaccatgccagacctaaagctttactacagagcaattgtgataaaaactgcatggtactggtatagagacagacaagtagaccaatggaatagaattgaagacccagaaatgaacccacacacctatggtcacttgatcttcgacaagggagctaaaaccatccagtggaagaaagacagcattttcaacaactggtgctggcacaactggttgttatcgtgtagaagaatgcgaatcgatccatacttatctccttgtactgaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacaccgtcaataagacaaaaagaccaccaacagattgggaaaggatctttacctatcctaaatcagataggggactaatatccaacatatataaagaactcaagaaggtggacttcagaaaatcaaataaccccattaaaaaatggggctcagagctgaacaaagaattctcacctgaggaataccgaatggcagagaagcacttgaaaaaatgttcaacatccttaatcatcagggaaatgcaaatcaaaacaaccctgagattccacctcacaccagtcagaatggctaagatcaaaaattcaggtgacagcagatgctggcgtggatgtggagaaagaggaacactcctccattgttggtgggagtgcaggcttgtacaaccactctggaaatcagtctggcggttcctcagaaaactggacatagtactaccggaggatccagcaatacctctcctgggcatatatccagaagatgccccaacaggtaagaaggacacatgctccactatgttcatagcagccttatttataatagccagaagctggaaagaacctagatgcccctcaacagaggaatggatacagaaaatgtggtacatctacacaatggagtactactcagctattaaaaagaatgaatttatgaaattcctagccaaatggatggacctggaggccatcatcctgagtgaggtaacacattcacaaagaaactcacacaatatgtattcactgataagtggatattagcccccaacctaggatacccaagatataagatataatttgctaaacacatgaaactcaagaagaatgaagactgaagtgtggacactatgcccctccttagatttgggaacaaaacacccatgggaggagttacagagacaaagtttggagctgagatgaaaggatggaccatgtagagactgccatatccagggatccaccccataatcagcatccaaacgctgacaccattgcatacactagcaagattttattgaaaggacccagatgtagctgtctcttgtgagactatgctggggcctagcaaacacagaagtggatgctcacagtcagctaatggatggatcatagggctcccaatggaggagctagagaaagtacccaaggagctaaagggatctgcaaccctataggtggaacaacattatgaactaaccagtaccccggagctcttgactctagctgcatatatatcaaaagatggcctagtcggccatcactggaaagagaggcccattggacttgcaaactttatatgccccagtacaggggaacaccagggccaaaaagggggagtgggtgggcaggggagtgggggtgggtggatatgggggacttttggtatagcattggaaatgtaaatgagttaaatacctaataaaaaatggaaaaaaaaagaaataaaggctctttgtaggcactagctctacttctccaagttcaatgagttgtgtgggtgatgtcttaagtaatgacttgctgtcagtttatggcgagaaaagtatagacttggcaacaacttgaattgttcagagattcccgtgtgaccactttggccaataactcaatttcatgtaacccaatcctcatattggaatctttatttggttacaagagatggccagttgggactttgtctcctgtaacatttagagatttcatttagatcaccttaatgtacatgtgtatattttatgcaatttttacagtattaggttttttttttaccccttaaatgtcgcttggttttagatgtcattccctgtattccattccataaacttctctcccctcccatgtaatcttccaattccagccccccaataaatatctctctattctatttcccttttataatgagatatgttccttctagtcctttattcttcctaccctctgtggttctatgtactgtagcttggctttcattgacttaattgctaatacccatctataaggatatttataccatatttgtctttctgagtctaggttacctcactcgggatgatttttctagttccatccatttgtctgcaaattgcatgatgtagtttttaacagctgagtagattgtgtaaacaacctgaatatattttatccattcttctgttgagggacatacagattgtttccaatttcaggctcaagagatggctgagctgttaaaggctaggctcacatctctgggtctatagattatagcttggttatcatttacctcatagctaatgttcatatataagcaaatacatgccatatttgtttttctgggtacctcactcaggattatttttttctagttctatatacttgtcctcaagtttaattttagtggttgagtaatacttgattgtgtgaatgtatcacatattcttttatcaattcatctgttgaggggcacctaggctgtttacaatttctggctatgatttagaaaggagaaatgagcatagtttagcaagtgttcctgtggtaggatgaagtgtcctttgggtaaatagccaagaacaatatagctgttttttgaggtaggtcaattctcatcatcttgatgaactgcctcactagtttccatagtgactgtatgagtttgtactcctacgagcaattcttactccacatttcgccaacactagctgtcacttgtttggttgatcttatccatactgaccagtgtaaaatgaattctcaaagtgattttgaattgtatttccctgatgggtaaggatgctgaacttttctttgtttctcagtcatttgtttttcctctagtgagaatttttgtttatctctgtaccctatttttaaattgagttctttgttttcttgatatttagtgtcttatgttctttatatattttggatattagtcccccattgactgtgtagttgataaaacattttctcattctataggctgatgatttgtctgaatgaagttgcttttcagtttcatgaggtcctattgaaagattttctaatcatttggttttcttcctttcctcacccttccattcccattccttcctacctctcccttctccccctttcttctttccttccattctctcaaactctctctgttttttcctctttttatgttttattatgtctttatgtagccaagatggatctggaacttttgatccccctttctcaatatccatactcctacccattgtgctgctattacagacaggtagcaccctggcctacttcttttcattccgttttcaaatatatatagtggtagtggcagtctgtcttctttatgttggattacataacatcaaaaattggtgaaaattttattttaattcattcttgatgcttttgaatttcctatagcctttgaaaaagtttcagaatccttttttacattcaccttctgtgtcattttaatgttctatttctctttacttcctgaatcatctgtggggtctattggatcccacacctaaatcaaaacaaaagtgtgtccttcattttctattattctttttcaattcactgtcctgaaacatttgttattaagcatcaccacttcagaaatcaactacaaaccccagaaacaatggcttttttctttagctcgctcactgattcattagcatttcctccagatttctcacactgaagttaaagtattctttaatacagagttcatacttgtacattttgactgcacataaaataaatatatcctttcaaatttttgtataatgtctctgtggttcctatttaaaaatcttaaagttttcatttagttgaatttggattccattttatgagtatttactttattttactcagatttttctttcaatgttttaaaaactatgttttccctttttccttccccttgcctagtttctatttctggccagttcccatcatacccctagcatgtttcaatagctttctagctcttttccatgtattattaggatttattacttacattgcttttggataagcattctaaaattttcataccatgctattgttaagaaactctaatgaaccctgttcttcctctcagattgctcttaatatcaagtttgaaactgctgaacattcagtgctttagttcattactttgtacttataaagaatcatttgaccttcagaatattgattctcatagctttgggtagaacaaatgggcttgggtttccttaatcaatattttcagtttcatatagtagaaggagaataaaaaaggttagttggtcaaataaattggacaaattagagctttctatggtttatttaaatgacaaattctagaacaaaaatactctctttatataaaaccatttagaaataacttgttatttccatggaaaaaatatatagtgaagttcagataatttaataattagccatgaatgcattcatattcagttgattataatatcatgttctcaaacttgattataatatcatgttctcaaactttatacaaaagttgtttgttaagaccaagtctcagtagagttaaaggcttatgtatttctagacgttatcttggtttctctaaaatcatattcttgatttatcctttcctgtttcatctcatttgacaagtaatgattgcatatacttattagttataatgtgatacttggtatatgtattttttgaagcttcaatcatgctatacctttactaaattatttttgaagtaggaaaaatgaattccattatttttaaatatgttaaacatactacactattgttacctgtgttgctttagtctctcttttttgtttgtagcacagcaaaaatactcttggtgtccctcatatacgtgtatttttcagataaaaaaatcaactgatagcatatgatagtacaaaactctttcagtactttcatgaatacaataattagaaaggattctcagggccaatagttagagagacaattgttttaaatgccctgtcgactgtttaatgaaggtgataatttttttcatttttttctattttatttattcattgacaatttaatatatacatatattgtatatatatacatatataatatacatattatgatcttgtctacctgtaatttccccaattccagctctctcaaccctcctccactacgttctaaatccttccaaactgtaagttatcttctttttttcttttttttctttttactagatattttcttcatttacatttcaaaagctatcccctttcctagtttcctctctgaaagtcccctatacctttcccccgtcctgctccccaacccacccactcctgcttcttggtcctggcattcccctgtactggggcagataatcttcacaagaccaagggcctctcctcccattgatggccgactatgccatccttttgtacatatgcaactagagacagaagctctggagggtactggttagttcatattgttgttttagctccttgggtactttctctagctcctccattgggggccctgtgttccatccaatagatgactatgagcatccacttctgtatttgccaggcactggcatagccttacaagagatagctatatcaggtttcctgtcatcaaaatcttgctggcatatgcaatagtgtctgggtttggtggttgtttatgggatggattatatgttacccaaccaaaagtaaaatttgattttgttgaggcagaggccagaatattactactctagatttaagtatatgtaacccattcttgagttattaaagctggtcaatacaggttcacaaatggttagagattaatgcagcctaattacataaagcagcttcataaaagttaaaaactatgttctttgagagaaactttaatatgcttcctctcaatgaaatccatagaactatctatagatgaattgcaatggcaaccatgtttgcaacctatgtctcaaactatagatgagcacacaggaatttcatatgtccttgtccttctcgtgcaagtgttcttatgggaggcactgtggatggccacaagtagggccatgaaagcatgaatttagcattgatagataggtttggaacaatatataaatattcaaagaaaattctagtgttagcaataggaaaatactacaaaaacacattcaagtatattgttcattgtgaatttgatacatatttggactagcatatatggacagattatgaccacttaattttgcatggaaaaagcatgggatgaaggtaaatggttttcatgttatttttggcagtggtggttttatttattataatattgattggcattaatgctggatttaatatatgctactccaagacgttttcaaaattatttggaaaacatcaatgattaaaaagaggcagaaatagcaaaatgagtagctatagatataaagagtttaaagtaccaaaaggaaaatagatataatggaactattaacttcagcatattcttaaaatgcaagattttgcttatgaacaatttaacattgaaaaatgcaaaaatgtagtagaaatagcaaagaggtaaaaattgaatacagatatcaactaaatgccatatatgtattatatgtatcctgtttcacatgataatttacactagtcttaatctaataccaaaatcaaaatatttcaaataacatgattatctactagaagaacaattaataagttataaattcactactaataagaaaaagatcatattttccttatacatagagcctagttttaaaaacttgtgtgtgtgcctctgtggggtgtgtgtgtatgtgtgtgtgtgtaggttagaaaacaagaaggggataacaagggaggagggaaggatcttataggagatgggaaagatgaattacgaggggttgaatggggtagaaaagcagaagtggaagaccagctggtggaaggaagggaatcagctggagagaacttacaggagggcattggaaagaagaataagaaagaacaaagtacaataacacataaatgtgaagacgtcatgctgagatttattaatttgtgcactaatctaaaaaaaaagaacgaagaaaaaaggttttgagaggtgagagggtgcgccagagaacctgacagcttctggaacaggcggaagcacagaggcgctgaggcagcaccctgcgtgggccggggacagccggccaccttccggaccagaggacaggtgcccacccggctggggaggcggcctaagccacagcagcagcggtcgccatcttggtccgggacccgctgaacttaggaaattagtctgaacaggtgagagggtgcgccagagaacctgacagcttctggaacaggcagaagcacagaggcgctgaggcagcaccctgtgtgggccggggacagccggccaccttccggaccagaggacaggtgcccgcccggctggggaggcgacctaagccacagcagcagcggtcgccatcttggtcccgggactccaaggaacttaggaatttagtctgcttaggtgagagtctgtaccacctgggaactgccaaagcaacacagtgtctgagaaaggtcctgttttgggccttcttcttcggccaggaggaggtccaaatacaagatatctgcgcaccttccctgtaagagagcttgccagcagagagtgctctgagcactgaaactcagaggagagaatctgtctcccaggtctgctgatagacggtaacagaatcaccagaagaacaatctctaaacagagtcaactataactactaactccagagattaccagatggcgaaaggtaaacggaggaatcttactaacaggaaccaagaccactcaccatcaccagaacccagcacacccacttcgcccagtccagggaaccccaacacacctgagaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcaaagcaaggcaacactagagatagaaaccctaggaaagaaatctggaaccatagatttgagcatcagcaacagaatacaagagatggaagagagaatctcaggtgcagaagattccatagagaacatcggcacaacaatcaaagaaaatggaaaatgcaaaaagatcctaactcaaaatatccaggaaatccaggacacaataagaagaccaaacgtacggataataggagtggatgagaatgaagattttcaactcaaaggtccagcaaacatcttcaacaaaattattgaagaaaacttcccaaatctaaagaatgagatgcatatgaacatacaagaagcctacagaactccaaatagactggaccagaaaagaaattcctcccgacacataataatcagaacatcaaatgcactaaataaagatagaatactaaaagcagtaagggaaaaaggtcaagtaacatataaaggcaagcctatcagaattacaccagatttttcaccagagactatgaaagccagaagagcctggacagatgttatacagacactaagagaacacaaactgcagcccaggctactatacccagccaaactctcaattatcatagagggagaaaccaaagtattccacgacaaaaccaaattcacgcattatctctccacgaatccagcccttcaaaggataataacagaaaaaaaccaatacaagaacgggaacaacgccctagaaaaaacaagaaggtaatccctcaacaaacctaaaagaagacagccacaagaacagaatgccacctttaacaactaaaataacaggaagcaacaattacttttccttaatatctcttaacatcaatggtctcaactcgccaataaaaagacatagactaacaaactggctacacaaacaagacccaacattttgctgcttacaggaaactcatctcagagaaaaagatagacactacctcagaatgaaaggctggaaaacaattttccaagcaaatggtatgaagaaacaagcaggagtagccatcctaatatctgataagattgacttccaacccaaagtcatcaaaaaagacaaggagggacacttcattctcatcaaaggtaaaatcctccaagaggaactctcaattctgaatatctatgctccaaatacaagagcagccacattcactaaagaaactttagtaaagctcaaagcacacattgcgcctcacacaataatagtgggagacttcaacacaccactttcaccaatggacagatcatggaaacagaaactaaacagggacacactgaaactaacagaagtgatgaaacaaatggatctgacagatatctacagaacatttttccctaaaacaaaaggatataccttcttctcagcacctcatggtaccttctccaaaattgaccacataataggtcacaaatcaggcctcaacagattcaaaaatattgaaattgtcccatgtatcctatcagatcaccatgcactaaggctgatcttcaataacaaaataaataacagaaagccaacattcacatggaaactgaacaacactcttctcaatgataccttggtcaaggaaggaataaagaaagaaattaaagactttttagagtttaatgaaaatgaagccacaacgtacccaaacctttgggacacaatgaaagcatttctaagagggaaactcatagctatgagtgccttcaagaaaaaacgggagagagcacatactagcagcttgacaacacatctaaaagctctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaactccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaatccttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttctgaaaagatcaggaattcaaggccaatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaagggaatacaaattggaaaagaggaagtcaaaatatcactttttgcagatgatatgatagtatatataagtgaccctcaaaattccaacagagaactcctaaacctgataaacagcttcggtgaagtagctggatataaaattaactcaaacaagtcaatggcctttctctacacaaagaataaacaggctgagaaagaaattagggaaacaacacccttctcaatagccacaaataatataaaatatctcggcgtgactctaacgaaggaagtgaaagatctgtatgataaaaacttcaagtccctgaagaaagaaattaaagaagatctcagaagatggaaagatctcccatgctcatggattggcaggaccaacattgtaaaaatggctatcttgccaaaagcaatctacagattcaatgcaatccccattaaaattccaactcaattcttcaacgaattagaaggagcaatttgcaaattcatctggaataacaaaaaacctaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaatacagaatggcagagaagcacctgaaaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtggaattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtttggagctgagatgaaaggatggaccatgtagagactgccatatccagggatccaccccataatcagcatccaaacgctgacaccattgcatatactagcaagattttatcgaaaggacccagatgtagctgtctcttgtgagactatgccggggcctagcaaacacagaagtagatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaatggaaaaaaaaaaaaaagaaaatgaccaaatgaccaatgggaaaacggtaacaaaagttacttcacgtaaagagaatctccaatttcagaaatattttaaagtcctttacacatcccttctgttgctaaagaaaatataaataatacagatttaaagaagttaaaaataagattttactcagtgtatgtactacagaaaaccagagtttgttagtataaaacaatgtagtctattatgttgcacattttgatatttggtcttacttcagtcattggaataaatttaattttcatgacaaacatctacaaaaaaaaaaaaaaggttttgaaaaagaaaactacagaaaatgtcatttatcagtgtaaatatttacaatgatagcttaagaaagtgttaagtatttagagaataaaatgtgaaattatttaaagagtacaggaatggttcagtgagcatatcaagacacatacaaaatgcataaatatttgttaagccaatacttaaatctgtctattaaatagatgagcctgaatttgagaatagcagagaaatcatcataactgcagcattaataatgcagagatccttgggagatgtaaaagtcttaaaaatactagtgctctagaaaacgaaatatgtttatgatgaataaatttatagaagaaatgatatagatggagaaaaactcacaataaaagcataaaagttattcaagtgtaaaatgatagcagagggaatacaaattaaaaatcggatcccatgcgtgcattgctattacacgtctgtaactggatgtggtcgttcctgaagctcaccatgtatagcagttctttacattctgcttctccaaggagaactgttgacatggctcctctgtgtttcttgttttcacactttgtttagatatccttatattttacatcactttctagataggtaaaattaataaaataaaaacaaaaacaaacaaacaaaggttagagatttcctcgggaatcatgtgcagagccatgaacattacagccatgaacattacagccatgaacattacagctatgaacattacagccatgaccattacagctatgaacattacagctatgaacattacagccatgaacattgcagccatggacattacagccatgaccattacagctatgaacattacagctatgaacattacagccatgaacattacagccatgaacattacagctatgaacattacagctatgaacattacagctatgaacattacagccatgaacattacagccatgaacattacagccatgagcattacagctatgatagtgggtaaaggaaagcctgtgagaaagatgaagtcaccatacttcaaaattatttaagtatcaactttttgtttctaagtctttgatattttcataaaagaaatgttaccgtaaatacctctcattaaatagtctttggcaaatactactcaaatacttagagaaagtacccaaggaactaaagggatctgcaaccctataggtggaacaacattatgaactaaccagcaccccggagctcttgactctagctgcatatgtatcaaaagatggcctagtcggccatcactggaaagagaggcccattggacaggcaaactttatatgccccagtacaggggaacaccagggccaaaaagggggagtgggtgggtaggggagtgggggggttatgggggacttttgggatagcattggaaatgtaaatgaggaaaatacctaataaaaatatttaaaaaataagttaaattacgtatgaattttactaattttggaaatattcatcttaggttgatcaagagaaaaagtttccctgacattggtcattgcattagttgattcttaagtaactcatcagcagtatcatatttcttgtaaggtgaaagctttccaatgattgtttgtgagtagatgttccaagtggagtatacaactgcaatagataatatatcacaattcaatgaatcaaaaactgcatttgacttgtgaaactttgatattattaaggccttccactgccctattagttttttcttctgatcagtacagtttataaaataaactaaggacaatggattaatcatgtatttatattatttgaattctatatactatgaataaaattccatttactaattagagccaaaattttttaaggggagtcagttctgtggttctgaagttttattaatctaagattttgcctataatataattaatgcaatgtgataaaaagttatttaaagaaaaaccaaaagggctaggctgttttcaagtcttctgtgacatcctgatatattgtataaattaacttcaatattcatcaaatgtacaataatagaattaagatttctgatttttacatcttttatttttaatatgtgattttattaataactataattattgcaaaatgaataaatattagctttatgtcttacaaactacagtgcacaaagactgtgagttgatgtcttttgaatgttaggcccatcttcatggtttgtttattaatgggaacattttgtaggaaaaggattcttgtgttctcaactgcagagaagaggggttattctccctaaattatttttattgatgtagtattagtcaagatatagaattatatagtacattaaaataaaaaattaaataacaattcactattgtactgaatttcagttttgtttcttaagtttttctgacaaaagtatatgtgtgaatttatcattatgatttttggttaaatttacaagtaaaatgcttatagtgaaaagacatctgtatttatgcatagggatacataatagttttgccaaagtctatttctcatataaaaatctatatacatatttgcataaaattagaaagatctgaaaatctgcatacacacatgaaatcatcaccccaatcatatctataacaattttcctcctcctgttttgtgtatgtttgaaaatttaactagaagtcacacgctttaagaaaaattaaggatatagtacataatgcttattataggcactttgttgtacagcagatctcttaatcatcttgtgcaaccaaaacacagcccactgaaaagctgttcattttctttctcctcagaacatagcagctaacatttccctcactacttgtgtgcgttgctctgggttatcacataaatggaatgtgtcatgtttctcttctgtggctagcttattttacttaactaatgtcttcgagttttctctatcttctgatatatgacagaacttttgtctgaatattattccattgtatatatgtgtatgtcccacagttttcttatttatgcatccactgatgaacttttggatcacctccctggtttggctaatgtgaaaaattcttctatacacataggtatgtagataactcttcaaaattattattctgtacttctcaatatataatagtaaagtggtgactatatcatgtgatagcttcatttttgtttttactatataagcctattttattattttttgagaattttatgtataggtattgtccttatatcatttataccccctcttcttcctttaactcctcctgtgcttctgaagggagagagatttgtagtctccttttcttatacaggcattggccacattaattagagaattatccttatgaccatatttaattttaattagttctttaaatagaatatctccacatatattcatataagaggttaagaaatcaacatattaatttggggtagacacaatttagttcaataaacttgtaatgatatcatttttgtgtggtagtgctatattaactttgtttaaaacatgtcaaaataagttttctcaaacattcgcaagatttggaaccctgaaaattattccttcagatttatatagcctgatataacagatcaattctaaatgatagtatgattcataaagttatgaattttaagcaatattagtagaacattctggaagtccagaatgagcaagatctagcttaacagtacctcatggactaatgacctaagtctccagtacaaggtgatgtttatgataggttgtgattaggtatttttagaaattttatacaaaataaccatactgagcatagagttccaggtccatggaattgttcctagatggtatttctcagattattagggaatctagaacagtgaccatagtccagggtgtgttctgctgacagtagcatattggctgaagaacctcagaaggaagattcaatttcacattttattcagtggtgttaaaaagaagtctagtgaagagaatacatcactagtcaatttgacaaaaaagctatttatccacccagagattactcaaaggaaacaacatctaccaagaggtttctggagaagaggaataatgtgaaaactgccaaaagaataaaaagggaaatttcaatatccctgtctgagagggaccagagctgaaaatgacagatggagaaaatttcccaaagcaaatgataaaaaggtgacatttggaagaatattcagagaagatgatacaaacaccaagttatgatacaatgtaaccttgtcaaaaaatttgcaagccatatccctatagttttccttacaaattgatggctgtgcacacaaatgtgcattattgtttgaaatgtaactcatggacaagatagtaataaaaataaaaattcagaatcatttaaatgctactcaatcacaggactataggacaatagaggactgaagtatggccacaccatgagcaccaaatactgcatgtgtgctccttttttaaatgtgagatatcaaaggaaaatttctttcttcttttaacttatatcttttgatttctcttattttctgtatttttgtaaaacacttttctgtgttaatactcctgtaagagtttgaaatcccagtaatgaacaaattttaatcattgaattcaaggaaactttgcattctggtgctaaaaaataaccttgcataattatctgtattaaataaatgtatgttccttttgtatgtttacatagtaaagagcacaccctttaaactttccatcatttatttgatgtcagatgaaagaaattcctatttttcttgtatttgaaaatagagttgggagatgtctttataatgaggagcttgctatcagttcatagatcatcctgacaacttttgttttccaggaaaggtgcaaactataagggacatcacagtttgtctctctgccaaagggacatatagaccttggagaaatagccctttgctgttcatttgactgttgaagttgtagttatttattgtcttttgtgtacacattctaaagtattgaatgtcagactgatgttcacattttgacatgcctagaagtaaggccttgaaagaagtgcattcctttgcagcttgtatgtcttcatgacacagaaaggtggttcttcatttatcaagtgcattttctttgaaattctacttgtggacctttcttgactagtctctttcctgaatttggaatgccatttctgttttgcatttgggctattgacctgatctttgctctttccagaggaaggaaagctgtcactcagaaacaataacgtgttgctaaattagtcactgtttttcacttaaaggatgaacatggatagagatgttcacatttatgtagaagtgggtgcaactttaagaatttagtcaagaacatatgtatttctaaactatatttaactcttctaataaacaaaaatcttgagaagtatattaagttatttgtttattgtgtttgtatgcaccagattactcactgtttccttgatgagaattctccttccatactgaatttcaacaatggtagcatatgatcctgattacatagaaatatcaaattaaagtaaccattcttattcttttaaaagtggctgttatctcttaaacattgatattgtatagggctttttagtagtagagctttgtaatatttcttggaaacaattttagaaaatataatttatagaatatcaacaaagtacaaagaattatttcagatcctgggaagaaaggattttcaactgtattggtttttttgtccattaccacctaaactactcagagagtatgtttctgcctatagcaatagtcttcagagagttcgaagtaattgcttagagcaggaatgctgataatcttgagaagggtgttgttctttgtaatcaaagtcaaagttaaatggtttcttatttctttggcttgctagttctctattcaaaacattttacattcacattcttttccctccctccctccctccctccctccctccctccctccctcccttcctccctccctccctccttcctcccccccctgtctgtctgtctgtcttgttttttcctttcttttttctttttgtttttgttcccctcccagtcaaccctccgactcttccacatcacatacctccttcctgtccctctgtctccccaaggatgtccccattccccaacctccaccccaccagacctctagactccctggggcctccagtctcttgaagggtaggtgcatcttctctgactgaatccagacccggctgtcttctgctgtatatgtgtagggggcctcatatcagctggtgtatgctgcctggttagtgttccagtgtctgagagatctcgagggtccagactaattgagactgctggtcctcctacagggtcgccctacttttcagcttctttcagctttcccctaattcaatcacaggagtcagatgcttctgtccattagtcgggtgcaaatatttgcatctgactcttttagctacttgttgggtctttcagagggcagtcatggtaggtccctttttgtgagtgctgcatagcctcagtaatagtatcaggtcttggggcctcctcttgagctggatcccactttgggatttcactgaactttcttttcctcaggctcctctgcatttccatccctgcagttacattcacatttttaaaattcatgatcatctttttttttcttccatttcaaaatttacttatttatttatttatttatttatttatttaatttattaccactccttgtcttattccccactcccatctaccctcagactgttccacatcccatacctccttcccacgcccctgtctccacatggatgtatccaccccacctgacctctaaactccctggggcctccagtctctttcttccttccttccttccttccttccttccttccttccttccttccttcctttctttctttctttctttctttctttctttctttctttctttctgttatgttaattttttaggttaggtgcatcttctctgaatcaacacagacccgacagtcctctactgtatatgtgttgggagcctcatatcagctggtgtatgctgcctgtttggtggtccagtatttgagagatgtcgggatccagattaattgagactgctggtcctcctacaggatcactcttcttctcagcttctttcagccttccctaattcaacaacagggttcagctgcttctgtccattggttgggtgcaaatagctgcatctgagtcttctggctgctttttgggtctaccggagtgcggtcatgcgaggtccctttctttgagtgctccatagcctcagtaatagtgtcaggccctgggacctccccttgagctggatcccacttggggcctgtcagtggatcttcttttcctcaagctcttctccacttccatccctgtaattctttcagacaggaacaattactgaaattagacttgagtatgcgcttccgaatacaataatcacctgccttgagaagtttagttagcttaagtatattctggattcaagttccattacaattttattgtgatttttgtttcatttcaaaatggtaaaagattcagtcctaccactaggaactaggacttctgggaaaaaaaaacaaacttgaactagtattttcacatgaatcgtaagattaaaatattggcatgcttttatttccacttcagcctagaaattgcctagttttaagaatttaccaaagagattttttcccattacttttttttttaacgtaaactgagctcagtttataaaatattctgaaacattcttctaagtggagaatgtttttatccacttacttttaagtctttaaatattatctgctaagtcttttagttcataatttttctccttaaacaaaaacaagtatcttgatataaactagccagtttttactaaaacatatgcaaaggaggaaaagggtatcagaacaatggttaacaacaacaaacatccctttgagggtttcattctagggtaatggctgctaaaattgtttagagtagttgaaatgaaataagatcaattaaagaacatgaaggagagcaagcaggacgttttattgcttttttttttttgacgacacatagctgcactctgtctctttttgtgtagaggatatttaaagtccttatgctgaataccatactagctaaatggagctgtaaatccaaagggatggggcaaagttctacagctaaagcagtatgccaacaattctacttctcatattattttaactgataaatattataattgatgaaacaaaagaacccacaaattttcccccacttagataaatgtcacgtggaactgaaagaaatcttatcttactaaaaacatagtaaagatggatataagacaaaggattatagaagtcacaacagccttttctttctagactgttaaaaggttttgctgagaactctataaagatgatggcaacctgaatgtatgaaataaataaaagataggccttgtgatagataggtcttgtgattcaattaaagatattcatatatgtatttttcagtgaattcaaatttgactgttaaatgactgctggcttgcatctatcattgtaaaaatttcatggactgttatgtagcttataaaacacttgcttttatggtgttgttacacagctgaaaaaataaagtgtcatatcagtatggggccacatttatccaaggaaaactaacataaggatatcttttgtcaacataggggatgagctgtatgataaaggcaaattttactctctgatctacccttctttcatgtaagtgactggagattaaagcttcagtctggagtcacattactattatatatatttcaaataaaggaattttttaaagagaaaaattctgacaataggagttacaagtattttcttaaggaatctcaggtccatttataattctgtatttttctttcatagaaatggacttatacataaaagaaaagccaagttttacaagaatttgtgtataggtataacatatgctttcaatatgcgtatattcatgatacgatatgtgggagaataattttaaggttaaatatacataaatccttttccaagcttttggggaattgtcattaatgtttttattgtagttctcatttagtcatttagtttggtgggaaaacatcccacctaatctttaatatattgacataagtactctttcatctgtgtacctcaaaggaagtagtttaatgagagaaatggttggatatttaaaaataacagtcttaatttgttagacatacttattttctaagagacaatgtgtagtttagatgcaagctcaatatttgaaaatgatttcatgatgtatgatacagaattatcttttcagtatttttattttgccacatctatttttaacctcttgttttatactaaatattgtttgtatgcatgaaaaaatctcatgttcatttttaaagttttagcttcctgcctttattaacatatttctcccatatctttacatatatttccttaacttctttttttattagatattttatttatttacatttcaaatgttaacccttttcccagtatcccctccagaaaccacctatcccatcctcccccgcccagctttcatgagtgtgctccccagccactcacccactcccaacttccctccctggcatttccctacagtggggcatcgagccttcacaggaccaagggcctattctcccattgatatcctacaagggcatcctctgctacgtatgtacctggagccatagcttcctccatgtgtactctttggttagtggtttagtccctgggagctcggggggatctggttggttgacgttgttattcttcctatgggattgcaaaccctttcaactccttcagtccttctctaactcctccactggggtccctgttctctgtccaatgggtggctgtgagcatctgtctctatatttgtcaggctctggcagaacctctcaggagacagccatagcaggctcctgtcagcaagtacttcttggcatcagcaatagggtctgggtttggtgtgtgaatatggagtggatctccaggaagggcagtgtctggatggcctttccttcagtctctgctccacacttggtctctgattttgctcccatgagtattttgttccctttctagggactgaagcattcacacttctttcttttggtcttccttcttcttgaccttaatatggtctgtgaattgtatcttgggtattctaagtttctgggctaatatccacttatcagtaagtgcatatcatgtgagttcttttgtgattgggttaccccactcaggatgataccctccagatctatccatttgcctaggaatttcataaattcattctttttaatagctgagtagtactccattgtgtaaatgtaccacattttctgtatccattcctctgttgagggacatttgggttctttccagcttctggctattataaataaggctgctatgaacatagtggagcatgtgtccttggtatatattggataatattttgggtatatgcccaggagtgttatatctggctcttaaggtcatactatgtccagttatctgaggaaccaccacactgatttccagagtgactgtatcagtttgcaatcccaccaacaatggaggagcgttcctctttctccacatcattgtcagtatctgctgtcacctgaatgtttgatcttagccattctgactggtgtgaggtggaatctcaggattgttttgatttgcatttccctgatgtctaaagatgttgggcatttctttatgtacttcttggccattcctttatgtacttcttggccattcaatatttctcagttgaaaattctttatttagttctgtaccccattttaatctctggaacctaacttcttgagttctttgtatatattagatattagctctttatcagatgtaggattggtaagatctttttccaatctattggtttgcattttgtcttattgatagtgacctttgccttacagaagctttgcaattttatgaggtcccatttgtcaattcttgatcttagcacataagccattggtgttctgttcaggaaattttcctctgtgcctatgtgttctaggttcttccccactttcacctctataagtcttagtgtgtctggttttatgtgaaggttggtccttgatccacttggacttgagccttatacaaggagataggaatggatcagaattttcattcttctacatgctgacctccagttgaactagcaccatctgttgaaaatgctgttcccccccccacccccactggatggttttagctccttcatcatatatccagtgaccataggtgtgtgggttcatttctgtgtcttcaattctattccactgatcttccttcctgtgtctgtaccaataccatgcagtttttaatcactattgctttgcaatacagtttgaggtcaaggatggtgattcccccagaagttcttttattgttgagaatagtttttgctatcctgtgctttttgttatttcaaatgaatttgaaaattgctctttctaactctatgaagaattgagttggaattttgatgcggattttttaaaatcttaatataattaattatactagtgtcttccttccctgtcattccttcaaccattcctatggtctcccttcatatcctcctagttttatggcatattttattacaatttttacatacacatacaaatacaaatgtgtaactatataaatacaatgaactaagttccttttttttttaagttcctttagtgttacttgtctgtatatgacttcagatctgaccacttcatatcagctaaccaattagtgagcaattcctggaaaagattgattcactctctcttagcaatcattacttgcctgtagttctttgtctaggagtggaactttatgaaatttccttctatgcttgcatgtctattaatattatccatgttcagattttctttatctggccatattatgttattatggataaatgtaccctatcagttctaggagaaatgatccaacagattacttcctggtcttctagaccttacagcctttcctcttacatgatgttctctgagtcttaggtgagggagttgtgttgtataagtatagatgcaccagttaaggctgggtttcccatgatctgttgatcaattaatttgatctgtgtggttttctgaattggtatgtgttataaagaaaggtttctttgataagggctaagagttacccttatctgtgagtaaaggatgtatttagattgcaattatgaattatgttggtttagtaaattgatgctagtaggctctcttctaaaatctatgacttcactattcctaggttgttggtgatgtttctagtaccaaacatgattttccttctgttgaatgggtattaattcaattagacaggtatgagttactgcccagatatgaatgttactgttgcacgattgtgtatatcttgtcatagtggtcattgctataatacattgatataataactttgttggaggctattaattgcttctcatccttgtcaaattgcatagtacttcgggtactttgaaatttagaaaacaggaaggactctttcctgttaaagctagcttatatcttctgaaacctgtgtcttaagtgtgcagtggcttatcttttcccttatgggcaacaaaggacaacagaaacagtattattttagggagtttgttagactatcttgaccaacaatttcaatggaagatcttcatgtttaattgtcgggtatttgttagatggtttaaagatctcatgggagcattgccagtccaagtgacataatttctttcatatctatctatctatctatctatctatctatctatctatctatctatctatatctatctatctttgtgtgtgtgtgtgtgtgtgcatctgccccacctggggatccatcccatatacaaccaccaaacccagacactattgcatatgccagaaagattttgctgtcaggaccctgacatagctctcttttgtgaggctatgccaatgcctggcaaatacagaagtgggtgctcacagtcatctattggatggaacacagggcccctaatgaggaagctagaaaaagtacccaaggagctaaaggggcctgcaaccctataggaggaacaacaatatcaactaactggtacccccgagagctgtgtctctaattgcatatgtagcagaggatggcctagtcagccatcagtgggaagagaggcccttggtcttgtgaagatcatatgtcccagtagaggggagtgccagggccaggaagcaggagtgggtgggttggggagcagggcaaggggagggtatgggggggggggctttggggatagcatttgaaatgtaaatgaagaaactatctaataaaaaataaaaaaaatatataaataattttagataagtataaaatgattccttgaggattgatcaaacatccttggtattatttgtgaacataaaataatttgttttatttaaatataaacaaagtaaataagtgaattataaatttaaaatacaacacttgcatgtgtcttacccaggttctctgcgtatacattatggctgttagcttgttgtttatatgggacccataactataggagtgggtgtgtctctgacacttttgcctactcttgggactttttgtctcattgggttgccttgtccagcattgatacgaggagttctgccttgttttattctgtcttattttgttttgtttggctgtcatgtcttggaagcctgaacttttctgaagaggaaaagaaggtgatgggtgtctagaggagaagggaggtgggtgcagcgctgggcagagtggagggagggggaactctctttgggatgtattgtatgaaagaagaatctattttcaaaaatataaataaaataaatatttaaaaaatacaatttcatttaattatttttcccataattaacaactaaaattgaggcttgggttggggagtacttcagtggtgtaacacttgcctagcatgtctgactgaagtccatggttccattcctaccctgtttaaaaatagtcataaagcatattaacatgatatatttagacctttggtgaaaactggaggaagtaactttggtgacatttctttagggtgcacattctcccatttttctctaattgtcattaatatgcagaaatatgaccttgtgaatcttggggtcctgtgttaatttaaattaatttggataaaaatttgaaacaaaagcaatcagcttaattatcaggcattcatattttgcttactcacagtagcctatcttgtcatctatctggctatgaaattttattacatactatgtgacaaaaacttcagtgaactcagaaaataaagattagttttcagtcttaactatttgttcctaatgagtattttagctttattgaccttattgttgtatatctttacatgcaactgggcaaggtttctttcttaaatgtcatcacggtattcttggtatgagaaacatacatttatcttctgtttatagtaatcagagcaaaaatgtgacattattcttcatttaacaatgtcttttctggtctgcctaacttttaaatttagctttatttatccttttgaagtccattaaatattttcacagcattaacaaatactaaacaaagaagcaaatgctacactccagaggagggcatcagatcccactacacatggttgtgagccactatgtgattgctgggaattgaactcagtacctctcttaccctgagcccagaagcaaattctaaactaagaaaaaaaaatgtttaatggttatcaaacttattctttatattttatttttttattaggtatttatttcatttacatttccaatgctatcccaaaagtcccccacccgctcttctacccattccggcacccacccactcccacttcttggccctggctttcccctgtactgaggcagataaagtttgcatgaccaatgggcctctctctccactgatggccaactaggccatcttctgatacatatgcagctagagacacgagctctggggggggtactggttagttcataatgttgttccacctatagggttgcagatccctttagctccttggtttctttctctagctcctccgttgggggccctgtgatccacccaatagctgactgtggggatccacttctgtgtttgctaggccccagtataatctcacaagagacagctatatcaggaaatttcagcaaattcttctagtgtatgcaatggtgtcagcatttggaggctgattatgggatggatccctggatatggcagtctctaggtggtccatccttttgtctcagctccaaacttctgtctctgtaactccttccatgggtgttttgttcccaattttaagaaggggcaaagtgtgcacactttggtctttgttcttcttgagtttcatgtgtttagcaaattgtatcttatatctttggtattctaagtttctgggctaatatccacttatcagtgagtacatattgtgtgagttcttttgtgattgtgttacctcactcaggatgatgccctccaggtccatccatttgcctaggaatttcataaatttattctttttaatagctgagtagtactccattgtgtaaatgtaccacattttctgtatccattcctctgttgaggggcatctgggttctttacagcttctggctattataaataaggctgctatgaacatagtggagcatgtgtccttcttaccagttggaacatcttctggatatatggccaggagaggtattggggttcctctggtagtactatgtccaattttctgaggaactgccagactgatttccagactggttgtacaagcttgcaatcccaccaacaatggaggagtgttcctctttctccacatcctcgccagcatctgctgacatctgaatttttcatcttagccattctgcctggtgtgaggtggaatctcagggttgttttgatttgcatttccctgatgattaaggatgctgaccatttttttcaggtgctcctctgccattcggtattcctcaggtgagaattctttgttcagctctgagccccattttttaatggggttatttgattttctgaagtccaccttcttgagttctttctatatattggatattagtcccctatctgatttaggataggtaaagatcctttcccaatctgttggtggtctttttgtcttattgatggtgtcttttgccttgcagaagctttgcaatttaatgaggtcccatttgttgattcttgatcttacagcgcaagccattgctgttttattctggaatttttcccctgtactcatatattcaaggcttaatctcatatgttagtagaaatacttataatgttccagtaaaagtcattgtctgcttattaaactattatgacacttactttatgtaatgaaaatttgacatttagattagatttaccatagtaaaattgttcattgcttttttctgattatgtccatactcagtctcatgaggaagtcagacaccattataatgtggaagacagtgaatggatgtgtggctttatcaaaatatagaattatttaaaacaaaccatgtaatttttcctgtgtgtttctttttttccagtattggttgtataatttcttctttggtttttgttgattattgggatcattcatactaaaagactctttaattcaataaaaattgttttcatgtaaaaatatccacactgtttttaaacaaagcaaatgaatggaaatcttgatattgtgaacaggatggctttagtgtgtgtataactgctaaaaactgagatgtactaaaagtcaaagtgaaagaaagtttctttcttttttttatttagctagtgaaccacttctttactaacagaggaactggtaaggtcatactgccaaaccttatcctctggtttacaccatccttgatgtaggcctggcgaagataatgataaactcatataatcacaacttttagtgttaggtttgaggtaattgatttagaccattcattttcttttcagtttgttttagcaaaattatatacatctaagagtgcataaatcataagtatcctatctgattatttttcacaatgtccctgacttgttatcaaccaaatcaagaatcagaacactgtggatatcatcaaaagaaaactttgatttgatttgatttgatttgatgagtcttaggcatcagacagctttgactcccaagccaggcatcaacctatgatgaataaaggattggcatcttctctgcctctaactgatacaagaacaccaataccaacaaggtgtctctttgacacttactgtgcattaatatttttatcttgtccattaaaattaaaaagcaaatactctttaaagctgattatatttagacccccattcaaagccagcttattaagttgttaagaaacatgcaatttaaaatggtattttaaaattatctttgcctaacccaattcataattgcaaagatacatgcactgcaccagacaattgagtcgattttgagagatcaaaaattgtacaaggagataagaatgggtcaatttgtcttcttctacatacggacctccacttaagctagcaccatttgttaaatatgctctcttttttttcccactggatggttttagcttcattgtcaaaaccgttcttatcttcttgtacaaagctcaagtccaagtggatcaaggatctccatataaaaccagatacactgaatctagtagaagagaaagtggggaagagcctcaaatacatggacacaggaaaatttcctcaacagaaaaccaatggcttatgatctaatatcaacaatcaacaaattgggacctcttaaatttgaaaagcttctgtaaggcaaaggacaatgtcagtaggacaaatggcaaccaacagattgggaaaagatctttaccaaatctacgttagatagagggttgatatccaaaatatacaaagaactcaagaagttagactccagagattaaaataaccctattataatggggtatagagataaacagagaattctcaacagaggaatctcacatggctgagaagcacttaaagaaatgttcaacatccttaatcatcagggaaatgcaaatcaaaacaaccctgagattccacctcaccctagccagaatggctaaggtcaaaatctcaggtagcagcagatgatggcaaggatgcagagaaagaggaatactcctccattgctgatgggattgcaagctaatacaaccactctgaaaatcagtctggtggttcctcagaaaattgaacatagtactacctgaggttatagttataccattcctgggtatatacccaaaaggtgctacaacatgtaacaaggagacattcttcactgtgttcatagcagccttattcataatagccagaatctggaaagaacacaaatgtccttcaacaaagcaatgtatatagaaaatgtggaacatgtacgcaatggaatagtacacaactattaaaaacaatgacttcatgaaatttgcaggcaaatgaatggaactagaaaatatcatcctgagtatgataaccaagtcacaaaagaagacacatagtttgtacttactgataagtggatagtaggaaaaaagctcgtaatacccatgattcaacttacagaccatatgaaagtcaagaagaaggaagaccagtgtgtgaatacctcagtcctacttagaagggagaacacaatagtcctgggagggagatggtagacaggacttgggaggagagaggagggagaggaaaaaaggggggccacaatcgggtgttgaaggaagaggagatgtatagaggatcaggaaattcaacagaggtgtgtagcaatgggggatggggacctggagaatagccaacaaaaagtcccagatgccaggaaagcaagagtctccaaggtctccacggggatgacagctgaaatacccaacaaaagggaaacagaatctgtagagaccatatccagaggttaagcatggcacttgcttgaagggtgggaccacccatctccaaattttaacccagaattgctcctgtctaaaggaaatacagggacaaagagtggaacagagactgaaggaaaggccatctagagtctgccccacctggggatccatcccatctgcagacatcaaacccagactcttgcgcgcgctcaacaggccaggaagaacgacgctgctacaggatccttctgcacacatttattcagtcctgtttcttctttctctatatctcccctgtttatatctcccctgtttttatatctcccttgtttatatctcccctgtttatatctcccctgtttatatctcccttgtttttatatctcccttgtttttatatctcccctgtttttatatctcccttgtttttatatctcccccgaaccctgggcctctcactccttttatactctctctcatccacgcactgcaggccacaccccctcgccagtcacgaggcttcagctaatcagggcagcaggggcaaatctccaccaaattggattcacctgtatcctggtacacctgcccagcactcaagatgtttgtgtcttatatgaggaagtcaggtgcaagtcatatgacttagctgcagtccctggcgcctttgggactaccgccacacctgctcctcacaccagacattattgcagatgccaagaagtgcttgctgacaggagcctgatatggatgtctcctgagaggctcggccagagccttatgatacagatgtggatgcttgcagccaaccattgaactgagcatggggaccccagtggaggagttagagaaaggactaaaggagctgaagtggttttcaaccccagaggaagaataacagcatcaaccaatcagaccccccccccccagagctggcagggacttaataccacatggctccagctgcatatatagcagaggatggcctgttatcaatgggaggaaaagctcttggtcctgtgaaggcttgattccccagtgtaggggaatgctatggctgtgaggcaggagtgggtgagagggtggtggagtacccttgtggaggcaggaaggcatgagatgggagcttcttggagaggatactgggaagagggataacatttgaattataaataaacaaaataaccaataattttaaaaaattggttgaattttgcaaagccatgatatttctgaaatgtttaagattttaccgtcaaattaatttctgtgttataacacatgcagttgaattccagaaagaatatattcatcaccatgactattacattagggtattatagtaatatttttgataatttatattttccaaaactgtttctaaaactatgtaacaatggagagattttttttctctcagtgatagttttctattcattacctcttgcagaataattattattttctgatttaaataggttgttcattactcagaaagaattaaacaagatcattagttatttctaaagtggagttattttcagagtcatagaaacaatcaatattttctgtctaaaattgtcaaattatacacatttgtactacattacacttatattagtaaattgccatttttatattaaataccttaatatgtaatgtaactttttgtgattgttttgaatcatttttattttcctgtaaatgtaacttgtgtctcagatgtaattgtcttctcagaggcttactgttgaataaatcagtcctttctagttctttctgaactttggctgcctggttcaactcagttgttccggctcaaactcctttccatgctgactgctgactgatttaagctggtttctctaagcttctgattgaattgctctgcttggtctcaaactaattctgacaatctgttgtaatcctctggctccttctccttctctggcttgttctgtcttcacctacaacgtaacctgtctgtgtaaaactatcttggtaaaactacctctgttgacctgcagggaactgcaggaactccactgcactgactgaacagaattcaactgttcttcactctgaagagcaccaaagtgactccattctaccgtactctcaactcaactctctccctgagatgtccttaagtagccattctttccttccttgtgagagttgggcatatcctatctctcattctgtcaaatcattctctgatttgtccctttgtctgcctttcaattagatgtcactttcaaacatagctgcttccttctacaaactaattttatcatcattaattagggattaaagatgtgaactaaggacatgtttgtattgcatccagagggattaaaagtgtgtgtcatgtctgcattccagttggatcacactgtaattccaatgtgatcccttgccaatgaaggcatgttgctggattaatttttcccatacatctttatttggttatctaggaaactcagtgaatctttcaatccacaaagccataattgcaggtaatgatataacttcaatactttaaaatcttgattattttgtgggatactgaatcaataggattgctccaactattaagtttgtcttagctatgcttcctgtttgtggcaaaaatcaacagcaagttctttattctacattaatatgtgggcttattataaaaaggcttttatgtgttttagggttctaagtgaggctacattgtaaagtcagacaagagcattgatggcataagtgtttattgaatatctgcaatgattttgaatatattatagaaatgattttattgtatagtaaacctctgaattgttttatttttcttttttctctttttaaagctagattttaaaataaagatttatatattttatataaatgagttctctatctgcctgtataactgcatggcagaagagaatatcagatcacattatagatggtgtgagccaccatgtggttgctgggaattgaagtcaggacctctggtagatcagccagtgctccacactgatccatctctccaggcccagtttatttttctcttcttccaatactggttaaaaattctgggaaaaaacaataataaactgctggaataaggtatggtgttggactgaatcgaggttgaagcagtgtcttgtaacaatggattaggcaacagaaaaattttagttttgtgttgggttgactgagtcctttctgttatcatgccaatcattgaacttctctagagcttatgttcctcatgtttaaaacatggagaaatactcacttttgccaggtgtgggtagtacttatgtgatcctaccaatttagaagctgtggtaagatggtatgtgtgagtttgggactagcttcatgggtttcaggttgccctgtttgattgtgatcctgtgagactgtggtcttgtgtatttaaaatcatttcacatttaccattttctatgtcaaaaacaagatttaacatatttttaaaatttgtaatgttctataaatgtaaatgttctacaaataataaatattattaggatgtcacatatctaagaaaagttgccaccaaagcttataacaggaggaaacaaaaatatggctccaaattatatgtcatatataatctctgacaaaattattaaaaaacatagaaaaatgcattcatcaacttatattatacatagattacactgtcttgtttaacaagattttgtgcgctcctaatatatactttgattaagattagactttaaaataaaaataactaacaactcatagagaataaaggggagtataatgtgataaatatgtactataaatgttaaaccactgtgtgaggtttttttaaagtaaatatatcctgtgaatatttttgaacagagtgccactgtggaactaatcttggtctcaaactcatgattctcttacttcagcccccagtctcttggggatagaaatatggtcaataacctccagcttaatacactgtttacatgttcttattttgagtgaaaaccgaaaaaagaaagctaactaaatttgtcattagtggggtcattttatatacagtagctgtgcatagttgagaattcagtcaattattctggtataacaaggcaattatcaatatgtgtcaaccacttgaagatttctaacttaatcaaagaattacttatttttggaaaatttgtccctattattatacggttgtacataaaattaatttcagttataaaaacaagcactgataccacatatttcatgatatttaatagtacttcagagttctttttatgtatcttcttattctcttcattaaatggattataaatttttggaatgctgtctgagttctctactttcctattacaaattgcctttgtagattgccacaaaattccaagggtagagaaaataggctatatcattctaaataatgtttatttggtttttaagttaacaccattgataaaactctgcaatacaattcagtgaatccataataattgtacggcaaatgcacaaaaccttataatattgatccttttggtttattacagctgcccttaaggtaaataaggcagtaacacctgagaccacagaattgatcataacatttattgtaaaaacagtgctgccatcaatttacttttaagattaaaaaaaaagtttgggctacctttaagtcaattgatcaacatactgggactgaagtgtcaggtttcaattatttttcacaaagcacatttccctgtaggcataccttacacctaacttggctagacactacaggcatcacatgctggtttgcattagtttccagcactgcaatatgaccatatctcctctaaatagtaaaaacttaggtagtcatgattgtgtgtcaagatgtgaaaatactttaaatgatacttttgaagtggtcagtctcatggaaatatcaaaggtacaaaagtagcaaacctatttagttcattataataagaagtgttccagcctgtttggaatcttctctgtcattcattgacaattctctcaattattttttaaaattttttattaggtattttcctcatttacatttccaatgctatcccaaaagtcccccataccctcccccccacacactcccctacctacccactcccacttcttggccctggcattcccctgtactgaggcatataaagtttgcacgaccaatgggcctctctttccaatgatggctgactagccatcttttgatacatatgcagctagagagatgagctccaggggttactggttagttcctactgttgttccacctatagggttgcagatccctttagctccttggttattttctctagctcttccattgggggccctgtgatccatccaatagctgactgtgagaatccacttctgtgtttgctaggtcctggcatagtctcacaaaagacagctatatcagggtcctttcagaaaaatcttgcttgtgtatgcaatggagtcagcgtttggaggctgattatgggatggatccccggaggtggcagtctctaaatggtccatccttttgtctcagctccaaactttgtctctgtaactccttctatgggtgttttgttcccaattctaagaaggggcaactaccagaggatcctgcaatatgtctcctgggcatatatccagaagatgttccaactggtaagaaagacacatgctccactatgttcatagcagccttatttataatagccagaagctggaaagaacccagatgcctctcaacagaggaatggatacagaaaatgtggtacatttatacaatggaatactactcagctattaaaaagaatgaatttatgaaattcctaggcaaatggatggacctggagggcatcatcctgagtgagataacccaatcgcaaaagaactcacatgatatgtactcactgataagtggatattagcccagaaacttagaatatctaagatataagtcttggaaagatcaggaattcaaggcccatacctaaacatgataaaagcaatctacagcaaaccagtagccaacatcaaagtaaatggtgagaagcttgaagcgatcccactaaaatcagggactagacaaggctgtctgctctctccatacctattcaacattgtacttggtcctagccagagcaattcgacaacaaaaggagatcaaggggatacaaattggaaaggaagaagtcaaaatatcacttttttgcagatgatatgatagtatatataagtgaccctaaaaattccaccagagaactcctaaacctgataaacagcttcagtggagtagctggatataaaattaactcaaacaagtcaatggcctttctctacccaaagaataaacaggctgagaaagaaattagggaaacaacacccttctcaatagtcacaaataatataaaataccttggcatgactctaactaaggaagtgaaagatctgtatgataaaaacttcaagtctctgaagaaagaaactaaagaagatctcagaagatggaaagatctcccatgctcatggattggcaggatcaacattgtacaaatggctatcttgccaaaagcaatctacagattcaatgcaatccccatcaaaattccaactcaattcttcaacgaattagaaagagcaatctgcaaattcatctggaataacaaaaaacctaggatagcaaaaactcttctcaagagtggtttcttttttacaacaaaattttttattaaatattttggaattccatacaatgtactaccatcacactcactttccatttctcccaggtcttatcaagtctgctatctatctatctatctatctatctatctatctatctatctacctacctacctacctacctatctatctatctatctatctatctatctatctatctatctacctatctatctatctatctatatctatccacccatccacctatctatctctatctacacgctaatgtatggatccaatattttaaatctcttttcaaactttggtgagattcaaatgtaacatctaactagctctggcatatagaattctaagccatttttgtcggaagaggtaaataatagactttcatggcttaagttcagaaattctttagggagcttagtataaacatgctactcactgacagatgtgctacttgtctgcattttttcccttacactctatttctatttgtttttaacttaagaaccagatggaacttcgaaaaccagatagctgtgggatggagggaaaagttaaagataagcttaatctgtaaatactctataagccacctggatatctgattggattctacaagtttacttcatgttggctgaatgaaactggaaagaaattgacaaagctaactgcatagtatgctatttgttcctttgatgctgtgttcactgcgtttcccacatttgtaggaaaatgttccaaatcctgagaaacatcttataagattcactgtattttaagtgagttttatggataacacaaagcagggggtttagtgttaaaaggaaccagatcctaagacacacttgctatagggatgggggtgtcaatcctttttgtaatacttttactaaaatgtgttttactttcagtacagtatttacatttcagaacaaggagaaattggcttttctcataattggctatttcaatctcatgtttcaatgaattggatcatgttatagttgatcctacaaagaagtgcaacagtagcactttaatatttttaatattcttgtttcttttccatacaaaagtaaaaacagtctccaggattgttttccactgcctcagagttaccattaatcaatcaccctttctattatttattactgtcagaggaacttgaggttctctcttttcttttgcttgcccttaatattatttgaaataaaaaagcccatatcagtaaatagtttacattatattcaaaaatcaaacatgacatctaaatgaattcaactttggcaagtaggtttatgtaacaaaaatgccttgtgtttatgttagtgactccccaagataattaagccatatttgctttgctattcctcaaatattctaaaaatgatgcttttctagtagcttttagttatacatcatcaggactgaagaatcagtttttaaaaagtgaatgaagatgagcgaatacaaagatagtctgtgaagtgtataatatgccattgaaatttttattaatatataaacacatatgcgtagtatatgcatatgtatagtaaaggaagtgttcagtaaaacaaaaggaggaggtctgtaaaaacagaaactgttggaagtatgtttttgcagtctgcttaaggaactgacaaaacaagctttttttgagataaagatgaaaaatgtccataggggcagatgttgccatttgccctcctgttgggactgacagatcagtgctgaagcaacatcagggcaaagaggcatcagcttcagtaatggagagttgtctaggggaaagattgctctatcacagtgatgggctcctgcatgttataaatcgaagattgttctttcctgccactgagatgagcagctctttcgccttttcagaatgaaatgttggaagagacaaggaacggatgaaaacaaaaaaagtgggagaaagttttatctcttcaacataaatctccactggaaacagacaggatagtgccaatctctggcttaaacatgaggtgaggaaaatgcttccttttagcaattccttctcaacccagcaaatagaacaggtagattatgataattctttgcatcttttgatctaacttggttctaactttcttttctaaattagtactatacagctttaaaaaaaatcaaattcacactctgggtttccaatgaaaaagaaattgaactgtctaaatattcatttacagggattagagaaatcatggagagcccaagatttggtatatggagaaccaggtcttccaaataaataaagctttgttttgtgactagacaccttctttgaggataggtctgataaataggctcagaaaaataatacttatctcccaagtgagctgacagtccagaagaacatagcactatgatttaagtataacacactgtttaaaaatgttagcatccttccaaactagtctgtgttactctatgtatccactatttgccttttcttaaagcctatttaaaatggtaaaacttttacagataaaagttttctgtaaaatatattcaactacatttttatattagtgaacatttttgaggcaccataaataatcagatgaattgcatgtaaagtaacaaaatacaaggaagcatacctattttataaagacaaaaattccagttaagaatccatggtaaattaattatactgtgagggttccaagtttatcatcatcacttaagtcacagatcaattacatgacctgcctaaaggcccaggggagtttattagtagaggtagaaatgaacagtaaaactcttctgttaagcatccaagcttttattttatattgtttgtttctgggaggattacagtcacatataaatgtactttaagtggaaaagagtataacatataatagtatgtgtaatttgtcagggaaagcatgtactattgagtgagatgtgtttgtagggaagtttagaacattagtgaaaatactaattgatcaaatttatcaacatacttgtcagcaactaatgccaaattataacttcccaaagagcagcatggttttcctttgcccattttattttggtgagagagagagggggggagagggagagggagagagggagagggagagggagagggagagggagagggagagaggagatgttactgatctccatcataatataattatagggaaaatcctcataagataaggaattaaggtagtaattttcaaactatcattatttaatgtggtcctggagtcccctaaaatgcatccaatgggaacccataacacctttttttttttttacaaacacatatatgtaaggatagctttctcagtgaatatggaacaaaagagcaaaataatccatcagattgaatgtaaaaacagttgtgaaaatctaggtgtcttctggatatatatataaatataatttatatataatgccagcctttatagatggtgcagccattaaacgttaggctcacaacttaaaaaggctcaaatataacatattgccatttatcttgctaagtaatgttgttacttgtttttctaaaatttatattgcaattataagtttcttttttaaaacaatttttattagatattttcatcatttacatttcaaatgctatcccgaaagtcccctataccctccccatgccctgctcaccatctcacccactcctgcttcctggccctggcattcccctgtactggggcatataaagtttgcaagaccaagggcctctcctcccaatgatggccagctaggccatcttctgctacatatgcagctagagacacgagctctgggggtactggttagttcatattgttgttcctcctatagggttgcaggccccttcagctccttgggtactttcactagctccttcattaggggccctgtgttccatccaatagatgactgtgagcacccacttctgtatttgccaggcactggcatagcctcacaagagatagctatatccgggtcctgtcagcaaaatcttgctggcatatgtaatagtgtctgggtttggtggttgtatatgggatggatccccaggtggggcagtctctggatggtccatcctattgtctcagctccaaactttgtctatgtaactccttccaggagtattttattccctattctagggaggaatgaagtatccacacgttggtcttccttctttttgattttcttgtgttttgcaaattgtatcttgggtagtctaggtttctgggctaatatccacttatcaatgagtgcatatcaagtgagttcttttgtgattgggttacctcactcagtatgatatcctccagatccattcatttgcctaagaatttcataaattcattgtttttaatagctaagtagttctccattgtgtaaatgtaccccattttctgtatccattcctctgttgcgggacatctgggttcttgccagcttctggatattattcttaagactccaattatgctgtactcactgtgctaaatcctttatgctttattatatttaacccatatttggaatttctaggtatttcttctgtaaagattctccctattaattcctatatctttcttttcttgccaccagttctcgttctcattgatttaccatgtgtaaaagggaacaacatacattggtcctcttgctcttgacatgtaagaaataaaggcaagtcagctaatctaattactgtatggcaacacattataatgtacaatgcctctgttaagtattgaggatctggttctatgctctgatttctgttcctgtgcttctctttccccatgatttcgattcaggattcttggtattttggaatgtgctgtagtttgtttcgaaattccacagatacagattcagatctgatagggcccagatgcttttaaatatacacaatatcacaaatgcaaaatgcaccaatgctgccagctttttaaaaattgtatattttatttatttacatttaaagtgttattcccttttccagtttcccctccagaaaccacctatcccatcttccccctcccatttttatgagtgttctccctcagccactcacccactcccactttccctccctggcattttcctacagtggggcatcgagccttcacaggaccaagggcctcttctctcattgataccctacaaggccatcctctgctacatttgaagctggagccatgggtctctccatgtgtactccatttatatagatacattataaaaggaccaaataagaggaaacagaaagcatacatgtattgatttaggtgtgactctctgtgagacagtattctttctatgaatttaaaatgtcttattttacactttgagtgatactggccacccaaatgaattggttagagaattccagatctgtgatttacttctcatctgcaagagtcatttcaattgaaatgagtgacagttttcattgtaatcttggttatcaactgtaagtatgttaatactattttatattgtaggatatataataaacattttaaaatctagtgttttaatctagtgttgtagatagaacagctaatgtagagacagtgctaattttaatttttttttacatcccaaccacagtagtttctccttcctgctctctgctcaatctcttcccagacctctcctctgcatcccccattcaccccttctcaacttcccttccaaaatgggtaggcctcccatgaatatcaaccaaacatggcatatcaagtttgaggaagacaaagcacctccccacatattaagattggatgaggcaacacagtactcaaaaagagtcagcggcagaccctgttcctactgttgggagtcccacaagaactctaagctacacaactgtaacatatatgtagaggtcgtaggtcagtctcatgctagcaggccccctcttgtcagttcagtctctctaagcacctatgagcccatgctggttgatttttgtgggtttccttgtggtgtctttgatccctctggctcctacaatccttcctttcctgtaggtctccgcatgtttccatcagttgctggatgcaagacctctctgatgacaattgggttaggttccaatctatgagtataggagaaaatcataaagaatcatttcattgacttttttggccagttttgttcagttctgtcctaggtctctgggtcttgtccctccaggcattgtcaggggtggctagttctcaggctggaccagtcattgattggccactcccacaatttctgtgtcacctttacatctttaggcaatacaaattgtagttcgaaggtttttgtggctgagtggtgtcctattttaaaaggaatgctatatatatatatatatacacacacacacacacacatatatacatgaagggacattattactaaacatattttacttgtatatttttacaggtcagctttatgttcaaagtagttttttgaataacttgctatttatagaaaaataatttttaatagacaaccatattgttagtggaatgactcattaaacatcaaatagtttaaatctgcatatcattaaaatactcataaacttgctttatcttatttatgaagctatgatatgttgagtgcgttgagaagctttttttgtgtacttttttaatgagtttgctgtaatttcacctttagggaatctttcactttttctttcatggaggcacattaaaaagaacagtatttctgtggctcgtcatgacagaaaccttttaagaaggaaatgtttaatgaaatcatgaataaatggaaacagatttgtctgtcaaaattaaacagcagtgttctttgattaatataaaaatctgatctaaagtagtttaagctgcttcatacaggtgacatctgtgtttaaatataattttctgtccctgctctggcatggctgttaattatttattcaatgtagttcaacatttagttaataaatatgtcaagcttttaccatgctgttctttttgcagagttgtgaatttgcaattagttttagatttacaacatggtgacagacagtgctgtataaatagaggttaaacacacaatttacatattaatttcatgattcatttattcaatgatttatgtggatatagattgtatttaatctctgtattgtagctgtttcaggcttgacgaaaggaatcactatgctagcagagaagtaatgatgtctgtattgggctacaggatcttgagggggaaatttttaaaataagatttggaaacacagtggtttcttgcatttaatattctgaaatgcaatggaaaagcaatagtgagagttcctaaaggatgacatttggtaactgagagtgaatgagaggcattaaccagctagcacagtaacttgaatgtggtatactgctactaaaatatttgctaaattggaatgacttaaagttaaggatcataataaaaatttaagagtaagtaaaatttgaggagttttaagcaaattccatcatccaacttctattacatttccagaagctcaaataacctctacacaatgttatttaagaatttcacatatgcacataatgcattttttgattaacaaacaccctccagatcagcgagcccctgaaacaagtgtcttttcctcaccagttctgggattacaagtatacttattcaccagtttctttctctctctctctctctctctctctctctctctctctctctctctctctctctctgtgtgtgtgtgtgcgatctctctgtgtgtggtctgtgtgtctgtgtggtatttgtatgtacatatgcaagtggagagtcaatgacaactatcaggggctattttccttccattttgttgaggcaagatcttttggtattttttctgttgtgctatataattgaggtagctggactctgaggttccatgtgattcttttgtctccatctcctgtctctcagtaggtatactgggattgttgatgtatgacaatatattgtttttttttaattgaaaaaggctttcttaaaatatattttattgtgttttcccctccccccaagtcctagcagatcccctaaacctccatatccacccaatcttatgttcattatcattctataaaacagacagacaaacgaacaaacacaagaaccaagcaaaacaccaaaaaggcataacaaaaaagcccaaacaaagcaaaatgaaaagaaagtcttgaacattggattcacttgtcaactcccaatgtttttacatgtgatctagggatggagttatcattcagcttatgcatctggtaccttcactcatcaaatcatgtccctagtccaaggtccttttagatactctaaggaactcatttaaaccacacttcctcaatattgttatacccattttgggaatgtaaatatgaacaagattcagagtcattttatgaatatttgaacccaaagatttctgcctccaaagacttacccctcattttatttcctcttttttttagggattgaggtaacataattgaaaggcaaaatgagttataatgtgcattttatgaagaaaagaatgggtaacaatctactacagggcaatcaaactttatcttgtacaagattagtttaactattatttaatgatactgtctatcatcatctataattctgttgatctttcttgcttttctttacggtcagaattgattagattcattgtcttattaccctttgtcatgggtttaaatccagatattctttatattcagagctcttgtacttcagtaaagttcttctagccaagaaattaaatactagtaaataatgttcaggcatttttatactggttttcttgaatcacatactttcttatgatttcaaaagacatgacatcttttgtccagttaaggcaatatgtaaatatgtgatgtgtactgaatctctgagataagagacaatctgataacatatctaaggggatttagtggaaaacaaagccatagcattaaagcattgtaaatgcaaaccatattctgttggtgaatcctttagtttctcttctgctaatggttctaagctttttacttcttcatcccatttcccacaattttgctgctttctaaagaggaaattagagactatgacttgatccaatctagagagaacatgtaacttttaaactcacagcaaaaaggctttgcatataaaattattgaaagtgactagagagtggaggatggagaggaatttctgggaggaaaatagttaatggagtacattgtattgaggggcacatacttgaaatgatggctatctcttcttgagcatttagtaggaacttttaaacgggttaatgagggtagttttaataagcccattcacattaagaaaacttagcatattatggctttttgtaatgtgagctgccttctcagacaatgaacaatactatctgcatatagaggaaaaatttttaaaaaatgttttcaacagtagattacctagaaaagggcaattcaatgaattaagaggccggaatttgtttgctactttttagcaaaggtctcaaaaataaattcatggaagatggtgcaaaaagagatgcggaaatttgtgtatttttttttactgccataaaacccacggaagtgagtcacttatactttaacttacttaaataattggcttatatcagccacgtattccccttttgagttgtatatgaggtttttgcttattggacatagtcacatctcacttttaaaccccttacacttttaatatgatgagtatatgactataaggagcaggtgtcaaacaatatttaaatgacatcctcaacaaaataaatattgaaccaccctgtcacactggtgatagaatatcaaaaaaatccccttcattgtctgctgcctctgacatttgttcttcaggaattatttgcagtttatcttctgagctggagcctttttatcagcacagcagttgaactacactgtaaaaaaatggtaattgagtattttatcaaatgcttctaacaaaacggactttgcaagtcgtaaatgaagattaaaaccattgcttgtgggcatgaacaaattggaatgatttattatctgaaacatcaatatgtcactgttcagaaataaaacgaaaagaaacaaacaacccagctcccttccacagcagaacttcctctgtcccacccccttacatttgtacccagagcattcttagtttccgcaaaagaagtggaaggtaagtacgttttaattatttgtgctatgaaaactactggaaaaaagactggagaaaagcatgataataataggccatctgctgcaggacattatgtagggaaaagagacagtaataaaagaaccctgtcaaaggaaagcaactatgaatgtgtacttcagtgctcctgattacagaaggagaattaaatataataaatgggggcaatttagaaaagtgaatttactgtctgtgtttaacacctaagtagccagtgctcttcaaatgggctctagctcacttgtctaaaaatagcattgaagaaagatattggaataatacgtattgcagaaaaatcctaattattctaatttgagggtaatttgtattaaactcatcatatgtggattttcacaatgtagcaatcaagtagagttaaaaacataaacattaaaaactccttataagtagcttgataagattttcccaattttattgaatttaatattgttatcttaaaagaaaacagtgaaagtgaaccagtgtaggacaaactcttcttttgataattcaagctgctaaaaatggtatataacctcacatgttgttgaataagaatgttagcttctttcaggttgccagcagaatgccattgtctccgccgttcattctctgtgtgaatctgaaagcatgctgctctcacccatgacaactcactgagttccaatcaaatgagtttgtaacaggtagaaatccaagctggggcctttgaaaaacgaaacaattaagtacagcttcttttggtttgaataaaaggacctttatgttcttctacaagtgctccccaatcttccatttcttttagttctatgggacataaaattcaggagacaactgactattcaacttagtgtcattttataaagatgtcatagaccattgagtatttaaaaatacaaataattttcttccttggtttttagtcataaagatacaaagttgtttcgtgaacaacatttaagtatataacatgtgcttaaaatacttgttttagatacaataaaatagaaaacaagaaatacatctaaaaggatatatccaggtttgaggaaaactatcaaattgtctgaatacaaaaccaacaaggaaacatcagattactaatgtgtaagaaggataagcgattatgacctagtgtaaaatgggaggttgaatttgatcattacgttctgactgaaaataccagaatgagcactatatatacacaattactaaatgcaaataaaatgtatataaagacaaaattgtttgagttacaggatattttaatggaaattttaaaatctagtttcattagcttaaattgaccttttctggtagtcatatttgcatccacttattttaggcaagttctctcagttgagttaattattaagccaacttctgaattgaaacaaaggtgagttaagcaatctaccatggatctacatctctagcccctgtgttgccaggttttaatagatatggttgcatttatttatgcgtgcaaaaaggtgatgctgttataaggcaagggaagtgtaaaagtagattcttctagtcttcttacggccgaggaggtttccttttaactactcaggtttatttaccttgaataaacagtatattaaccatctagaagactaatgtcatggtttatatttaaaaaaaagttgtgcccattttcacctattagttacatcatttctcatagagtacaggtgaaaaaggaatataatcaaaattagaaaacattatttattatttccatttgataaacattttattttcagtagctattgtcagcaagatggctcaaaatgtggattcatttgatacaaagtgaatctacaacctatttttctaccttagcaacccacatggaaagagacaacaagttcccacaggtagtcttctgacttgtctatataccctgtggtatgtgtgtccatacatgtgcaaatacacacagaaaacaaatacatgttaaaaactaaaaaacaaaatagaatgatgtgatagaaatattatcttgaagtaaattatgaatactgattgtattgtgaaaacagataacaaatgagtaaagttttgatctttgctttcaaatactttttaaaaaaatttattaaattattttatttatttacattccaaaagttgtccccgtttcttctgcctccttacctctgagatggtactccccccacctgcctaccaatgcccacctcactctgctagcatcttttctccctgagactcaagtttctacaggattaagtgcatcctctctcactgaggccatacaaggcagtcctctgctgcacgtgcaggggccacaaagcagcccatgtgtatgttccttggattttggcttagtctctgggagatctgagtggtccaggttagttaatactgttgttctttctatggggttgcaatccccttcaggtccttcagtcagctgctggtaaagcctttccaaggacagccatgctaggctcctgtctgcatgcaaattttggcctcagtaataatgtcaggatttggtgattgcacatgggatggatctcaagttggggcagtcactgggtggcctttctttttgtctctgctcctttccccccctgcattttctttacacgggaacaattttgggtcaaaaattttgaaggtaggttggtgacattatctcttcactgggggccttgtctatcaactggaggtagtttcttcaggttccatctccccactgctgggcctttcaggtaaggtcatcctcattgagccctgggagcctcttacattccaggtctctggggctttatagaggtcctcccatctccctaattcccattgctgcatatttcaattcattctcctggccctctggatatctgtcttagttagggttttattgctgtgaacagataacatgaccaaggcaagtcttataaaggacaacatatatttggggctggcttagaggttcagtggttcagttcattatcatcaaagtgagagcatggcagaatctaggtaggcatggtacaagcagagctgagagttctacatcttcatctgaagactgctattggaagactggcttccaggaagctagtgtgatggtcttatagcccacatccacagtgacacgcctaccccaacagggccacaccttctaatagtgccactctctgatcccagcatatgcaaaccagcacagtatctctcctgtctccccccataccttatcattcccctcctcctcttcatttacctctcccacccagtttcttccctccttctgcctcccacgattattttgttccccttacaagagggtttcatgtatccacacttgggccttcattcttgttaagcttcatacactctgtgagttgtatcatgggtatgctgaaatttttgatgaatatccacttatcagtgagtaaaagccatgcatgtccttttgggtctgggttacctcacttaggatgatattttctagttccttccatttgcatgcaaattctatgatgttttcatttttaatagctgaatagtactccattgtgtagatgaacattttctgtatccattcttctgatgaagaacatctgtgttgtttccagcttctggttattacaaataaggttgctaggaacattgtggagcatgtgtccttgttatatgttggaacatcttttgggtatatttgcaggagtggtatagctgggccttcaagtagagctatatccaattatctgaggaaccacaagattgattttcatagtggttgtacaattttgcaattccacgagcaatggaacagtgtttcttttctcaatatccccaccagcatgtgctgttgcttgactttttttttttatcttaaccattcttatttttaaatatttttattaggtattttcctcatttacatttccaatgctatcccaaaagtcccccataccccccaccactcccctacccacccactcccactttttggccctggcgttcccctgtactagggcatataaagtttgcaagtccaatgggcctctctcacaagcgatggccaactaggccatcatttgatacatatgcagctagagtcaagagctccggggtactggttagttcataatgctgttacacctatagggttgcagatccctttagctccttgggtactttctgtagctcctccattgggagccctgtgatccatccaatagctgactgtgagcatccacttctgtgtttgctaggcccaggcatagtctcacaagagagagctataccagggtcctttcagcaaattcttgatagtgtgtgcaatggtgtcagcgtttggaagctgattatgggatggatccccagatatggcagtctctagatggtccattctttcatcacagctccaaactttgtctctataactctttccatgggtgttttgttcccaattctaagaaggggcaaagtgtgcacactttggtcttcgttcttcttgagtttcatgtgtttagcaaattgtatcttatatcttgggtatcctaagtttctgcgctaatatccactgatcagtgagtacatattgtgtgagttcctttgtgattgggatacctcactcaggatgatgccctccaggtccatccatttgcctaggaatttcataaattcattatttttaatagctgagtagtactccattgtgtaaatgtaccacattttctgtatccattcctctgttgaggggcatctgggttctttacagcttctggctattataaataaggctgctatgaacatagtggagcaccatgtgtccttcttaccagttgggacatcttctggatatatgcccaggagaggtattgtgggatcctccggtagtactatgtccaattttctgaggaaccgccagactgatttccagagtggttgtacaagcttgcaatcccaccaacaatggaggagtgttcctctttctccacatccttgccagcagttgctgtcacctaaatttttgatcttagccattctgactggagtgaagtagaatctcagggttgttttgatttgcacttccctgatgattaaggatgttgaacattttttcaggtgctcctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttctttgatccatttagatttgaccttagtacaaggagatagaaatggatcaattcacattcttctacatgataaccgccagttgtgccagcaccatttgttgaaaatgctgtcttttttccactggatggttttagctcccttgtcaaagatcaggtgaccataggtgtgtggattcatctctgggtctttaattctgttccattggtctacttgtctgtcactataccagtaccatgcagttttgatcagaattgttctctagtacagttttaggtctggcatggtgattccaccagaggttcttttatccttgagaagagtttttgctatcctaggttttttgttattccagatgaatctgcctattgccctttctaattcgttgaagaattgagttggaattttgatggggattgcattgaatctgcagattgcttttggcaagatagccatttttacaatgttgatcctgccaatccatgaacatggtagatctttccatcttctgagatcttctttcatttctttcttcagagactttaagttcttatcatacagatcttttacttccttagagtcatgccaagatattttatattatttgtgactattgagaagggtgttgtttccctaatttctttctcagcctgtttatcctttgtgtacagaaaggccattgacttgtttgagttaattttatatccagctacttcattgaagctgtttattaggcttaggagttctctggtggaatttttagggtcacttatatatactatcatatcatctgcaaaaagtgatattttgacttcttcctttccaatttgtatcctcttgatctccttttgttgtcgaattgctctggctaggacttcaagtacaatgttgaataggtagggagagaatggacatgcttgtctagtccctgattttagtgggattgcttccagcttctcaccatttactttgatgttggctactggtttgctgtagattgcttttatcatgtttaggtatgggccttggattcctgatctttccaagacttttatcatgaatgggtgttgggtcttgtaaaatgttttctccgtatctaacaagatgatcatgtggtttttgtctttgagtttgtttatatactggattacgttgatggatttccatatattgaaccattcgtgggatgaaacctacttggtcaggatggatgattgttttggtgtattcttggattcagttagcgagaactttattgaggatttttgcatctatattcataagggaaattggtctgaagttctctatctttgttgggtcattttgtggtttaggtatcagagtaattgtggcttcatagaatgagttaggtatagtaccttctgtttctattttgtggaatagtttgtgaagaactgggattagatcttctttaaaggtctgatagaactctgcactaaacccatctgctcctgggctttttgtggttgggagactattaaagactgcttctatttctttaggggatataggactgtttagatcattaacctgatcctgatttaactttgttacctggtatctgtctagaaatttgttcatttcatccaggttttacaaatcaatttttattgactaataggctaaacatattcaacttatgggcgatatggtagaaaaatatgtggcttttaggaaaatgaataggaatcaatttttctttaactctttacattgatgaatcaagataaaaattttaaaatagttaactaccaacatgtgtcttaaaaaaaatccaatgattcatcagttggattgtgttagctttaaatagacgatatatgtaagttgtagaaattaatattttccacatgggtgtgatttggtcttaataaaggtgaataaattactgaagttttacaggatgctatcaaaatttaattatgattactaatataattttctccttagactttgacacacaaataaatttttacatgttaaagcatgtatgtcaacttttacacagaacatagaaaagaaataaaagcctagaatgatggctcagctattaaaagcactggctatttttctagaaagaaaataaaaaatctgtgtttgattcccagcactcacatattggctcacaactgtctgtaactccagttccaagggatctgacactttcttctgccccttacggatactaagcatacatgttgtatgcaaacataaatgcaggtagtatacacatatacataaattaaaagtaagtaaatatttttacaaagtaaagaaaaaaatgacataccactttttgagactcttgcaaggcaactctaagaatggagcaaactggaaagaaaaatgagacaataaccattactcatagttctctacatactcacttatgaatctcttgctttttatgaaatgctggtgaaacaattgctacatgccacctcctcctgaagtcacttggattagaagacacaattaatgagaaatgggattagttttatgtctgattttctaacatttatatgtgttaattcttcattattcatttatttcaatcattccaagttattatattcagataatagaaaagagggtgtagcatatcaaagacagcaatatttaaaatataccttctcattttattcatcactgtgctgatttttatctctatcaataatgttcagatataaatttggagtacttcagtttttaaatttacataaatttagatttatgaaatcttccctttgaatccagggaacaggtttttatcatggccttttattatgtgcagattataaaatagactgtatatttgtattttacaggagatttgtaagaaatatataattttttgtacctagaaagttaatattctcttataggagcaatgataaaatttagagtctagaagaaccatacagctaacgaatacaaattgaacattataaagacatgcttgtttgatcctctgagcaagttgaaattatttcttttcattataagttatttctttataggaatatttcttcctttaatgttacttgcttaaatttctatttgtaatatatcattcaattcaaaccttttcaaattggatttttcttttcagtacacagaatattataatatggtagttttgtcattttgtcttgtgagtccattataatactttgatttctttaagacagagtctcaagaagtatttaatttagacactgttattaagaatgaaaatttaaaaaaatatttatgaaagttgaataggtttattcaggtaccagagaagtgagaaacataaccctgaagagatgtgtgagatgatgtgaaaaccacagtgaaatgtacatttgatttgaatttaagtagtttcaaacctttagcccaacaacaaagagattttaatttagtaacttaaaggggctaccttacattttgtcataatcttgctaagatggttttatcaaacgactgactgcatttttacatatttcttcttaaaataatgcccaatgtgttaaatatgctgtttatccagatgataaaagttgaaaaactgaagcaaataatcaggatggcaatatttagatcagatagaattgtataggcctgactgaagtagctaacatttttgtgaatttaaagggagataacagccacaacaacaacacaaagaactgtgacaacccaaatgtgtttgtgttactaagataattgtagatcagatagttttgagattcaatgaaaggaatagacaggcccttagttttccctcatgcaggggaacagagagtacaacagtgccattgataagcaactaagtttagacttctgttaaattgtacaaatcagcatagaagtcaatctaaataaagtggcatatgtggaaagaacaagtctctgtaaaggtatactggatgagtctacaccataaattgaaaaccttatttgaaataaagtaacatttccataacattgtaaatactgccagatttcacaatgggataatggattcttttgttttcaatcaatatatcagcaagtctgaagctctcttggtttctgttgtatctgttgactgcattgtaatcattttttcagggggagagaggtctaaagatttttaatactgacaggcccacaaaagagcttctcctccttcccacttggttgtctctctttgtaacaaagatgacatccaaatgagtcatgcaaatgaccccatgccactcaagaaaccaattatttgacaataggaaggttttgcttttgtaaaaaaaaaaaaaaatctatgcattcatctttgggttaccattcgcagacttttctgtagtactctagttatccatatgtatatttcaggacaaattatagaaataaaagagtgcagtttcaccaataataatgtagatcatatctgctttccaaagattttaattctctttaccttttaattaacctatatagtaatatcctaattgtttacacaaaacatggtatttattctttgctgaagcctccaagtttaatttaatttgtttattgaggttatactgagacaaatattcaaagcgatctagtggatcccagaaataatatgtgtgttttaaaaatcaatttcagtggcaaggatgtattttttgatcattccagaacatctaatttagatctcagtgtcaaggtatatatatatattcatatttttcctttagggaatattattttatgagtactgggatagacggttcaaggttagtatttcttgcacagttgtaatgttcccaacagaaagatagatatatattgactgaggctggagttctagttctttctgttgctgaaggtcaacagccccttagaggtcctttctaaccttcagatgtctataggctaaattactgatgaatcactgcacttttctaaatggaagaaacttacactgtgctgagaagcatcccagtgtagtttgctttctgactgatataattttgaaagagatgggaagcaatttcaatccaggccccattccaaaactttatggaaatgacaataaacctgaccacttgggctgaatgtacttgccaataagatttaagtgcaccattctctcacaccccaacctgaattgtaacattgtgtaaggatcgatttagaatgagctgacattttacattataaatcatttaaacatttcaactatgtaggtactgaaggaatacagtattgataaggttgtgacacttgttcaaataggtaaaaacaagagtgtcatcttcaatgaataaaaaagggtttgaaaccttagagatgcaaaatgctgaaggcattacagaagaatagtaaaatacattgaatgagacactcgactttgtatgtacctaccagcacatgttagagcacatgaccactgcaagtcagggctgaaaaacctaaagaagcagaacacaaaatattacatttgagaagttacttaattccttcccactctgatatatatttaataaaaaaatataatttgaggggtttataactacagacttcattatggaatttaatactgtgaaataaaatattaatgtgataattgtgttctatcttagtctttcaaaatgatttcattttgaggacttaaattccaattgcagtattatattaatacacaataatcaacattttatatggaataatgatttaagttactagagtttgaaaataggactctaacactgagctgccccttctacccaagttatctgttaaagatatatatgaagtacatggaattatttccaacacatatataacttgtgatatgtatacttgtgacttcaaactatatgtcaaatttaatgtctactctctgtagatcccatgtctgaatttatctagctagagtcttaaataaacttattcaaaatgtgtcatttaaaaaaattaagtttcatattggatggatccccaagtggggcagtccttggatagcctttcagtgtctgcttcactctttctcactgtatttcctttagataggagcaattctgtggtaaatttttgagaatagtggatactattgctgatgccaaaaagtgcttgctgacaggagcctggtttaaatgtctcctgagagactctgccagagcagagtggtacagtagagaggtggatgctcacagtcatccattggactgagcaggggcaggccccaatgaaagagttagagaaaggactgaagaagctgaaggggtttgcaaccctataggaagaacaacaatataaaccaagcagaccccgcccccagctcccaggaactaagccaccaaccaaggagtacacatggctccatccacgtatatagcagaggatggccttgccgggcatcaatgtgaggaggtctttggtcctgtgaaggctcaatagatgccccagtgtaggggaatcaagggctgggaggtgggagtgggtgggtaagtggaggtacaccctcatagaagcagggggagggggatagaggaggggatagggtgtttccaagtgtgagaaaacagggtaaggggataatatttgaaatgtatataaagaaaatatacactaaaaaaaaaaaaagctttgagatgggtgggtggccccatccctcgacaaggggtcatgcctatctcctggatgaggtctatacaggttctatctcttcttctctgcttaaatcatgcccattgggttctgggagcctcttgcttccctggtatctgagatcctcccgtggatctccccattacctcatttccccctgctacatatttttatttgattaaacaatcatataatatagtgaacggtagttcaattttcagaatactatgaagctaaaggtaagaaaaagaggtttgccattcctagctatgttcttcctaaataccaaggaataaaaaagacaagaactcacagtccttagttcatatttgtttcccaatatgcttccatacaacctctctcataagtgcctatagaattttttttgttttgtttttgtttttgttttttaataatgtcaaatactaatttgataggtatgttgttttataagcaacttccttaatgccaaagcatatagtagctgcattagtagacatcagttatggtggaatagatggacttgggttgtctgatttaattttatgtagaacatttcagataattttaaaatatcttttttgacaagagtagtgaaaaatttattggaattgagtcacattgttttgcttatttaattactatgagtaattcaggggctaaatgtattaaatggtgctaccgaattgtgagtaataatgtccagtggttattgcatattaggttggctctgaaactgctccatgctttgttcatacttgtgtgaaggataattgctggataaagaaggaagtaagttgtttctgctaatagatacttgcaagtatttaatatgtagtcaatgggatagatgtaattcataatcattagtgtattaacttataattaaattaatggaaatataattctttccaagttgaatatctggggatgagaaggatttgatgaacacatactatgtgaaatttcaacaaagactgttaataattacattggagctagaggtatatcccaggaagcacgtttttaccaaagtaggctatacattcactctaagaataagttctataagtatgcagtgtagtttctcagagaactccgacttagctgataatgaaacttcttgatatcttctcaaaagcaatgaactaataatgatatgaatgattactttgctagaatatcccttttatggagggattatagagaatggttccttgcatagtatttatatgggttttccatttgactttccaaagttgaaaaagttattttggttcccagtttgcttgatggaagtgctgggtacaggggttcacattcaaaatgatacactgaagtaattcataatttgctcatgtattctgacccttctcttattccagtttctgtttcttttttcaaacttatgacaaataatttctaatctaggaaaacatgttctattttacttcttgcttcttcaaacctaggtgttttttttttttcacccaagcaacacaaatattgctgtttaaggtgaagtttgagagatacctgtgactattctctttggtgttctcagagcttactgtgaacttctttccttccttcctttttttttttttttttgttattttagtggatttaagctttatctcagtaaagcacacagaagttatctgtggattgtacattttgaaggaaaataagaaatgctgggtacctttcaaaattaggttactatggattaacctttatgtgataaatatacaagaaatgatctacatatgtatgtcaaactgtgaaaaacttctctgtatttctcatgactcaacatgggcattttttctaagtctcctttcttatatttagtgatgtgtatgtacagatcatttgagcaaagtggctgcaaaagtgatcagtactaagcagacatttggcactttgcttatccgtacaaccagagtatataatttatgtttgtctctgaaaaaaggagctcaagatatgattacttaagaaatagttagaataattgggaatttttttttactttttttaatttattttttaattagatattttctttatttacatttcaaatgttatcccttttcctagtttcctctctgaaaatcccctatccccttccccctcctcctgccccccaacccacccattctcacttcctggtcctggcattcccttatactggagcatagaatcttcacaggaccaagggcttcttctcctattgatggccgactaggccatcctctgctacagatgcagctagagatatgagtcccaccatgtgtttcctttggttagtggattagtcccaggtaattctgggagtactgattagttcatattgttggttctcctatagggctgcaaaccccttcagctcctagggtactttctctagctccttcattggggaccctgtgctctgtccaatggatgactgtgcgcatccacttctgtatttgccagaatggttgctttagaccaagatttgctacttgtactgagagaaaaggtaatctacctcccagaaatttattctgtattttgagaatcaggctattccagaacgcaaaaagcgagtggcgatgctaattcaaaatagggacttgaacatttcccaaatagcatgcatcacaaaaagcttggcttataataatggccatttgttcaatatctcccttttggctttctttatcagtaagtttttggagatgtatgtatgcacttggatggaacaattctttctgtaatgttcatttttctttaaaaaatctatttagaaattatatatttgtttttgttgttgttgttgttgttgttgttggtggtggtggtggtggtggtgtgtgtgtgtgtgtgtgtgtttgtaggaggatggctttggaaaagagtccattttcaattctacaatatagattatagggaccattcaggtttccaggtttcagcagcaagttcctgcacttgctgagccatcttactgacgccaaaattcagttttcttagaaaaaatgtgttttttaaaatatagttttgtatattttatatataaatatgccatagactgagtacttaaagaaaaaatccttggaagattgtgaaatgataaaaatagtctgtgaaaaatgtgtcttgaatttagtatgataatgtagattttagatgggattttcttttgctggcagaaatattcactttatggaaggaagttttattttgatcctgagaagtctacagttttaaaatgtatcttttacaagtttaatatgtttaacttaaaaatacttttgctaccttcaataagaatcaacaaattaaaattaagatagaactgaacaatttagtagctttatagttaaacttgactatatagcttataggaatcttaagatatgacacatgaaatttatatttttgccagttttgtgctcattcactctccagtgctatatttatttattaaatttcaacttatcaaaattgaacagatatttagactcagataacaaaagttgtctttcaagctcaatgaaaatgctcacataagtattaaagatgtagtacaaagtcattgcttttagtggcccatttgttatggatagtaacaggaataggaagaagaaacacagcgtgtgtatcttatgtgacctatattgcttttacaatattgaactaacatgttggattggatgatggcaagaggaataatgatcataagccatgtgcaagcatctattatttgtagcttccaattatttcagtcatagaaaattagactcggcagatagaagagataggattattctatatattgtagaaggttaatgatgaacatgataaaatttgttaatatttttactgtaacacaatgggatatgcaatagatgcaattaatttggcagaatattctttgttatagatgtgtcaaatataggttaataaatgcaattgtaagcattctaatttttgtaaaccttgtctttatgcttcagtgctaaaattgtttttgaaatataaaaaaattagtctggaaatataaagaaactatttcgtggtcaatgatagtcttaactacttgtcaatcaaaggcagaagtttgttgagacatttaattacaagataatgtagtcatcaaaatgtcgttgtggtaactgacagctcattttggtctgaaagcatgctactacctcccttgaggtcagagatgttctgaggttaacttagtaatgacaagtcctttattatcatgttatgacattgaaaaaaattgcaattatactaataaattaataacagtaataaaatgacagtcataattgcataatatacaagttgtcaactgcagttttgttacatggttggaatttttatcttatcagtatatgtacattatgttaatgcacagacagaatggtttttcaaacgacttctctgcacatatgggatgctagtgtatcgatattttgatctcaccttttttcttctagtttctcttctgctgctttacagtgtcttaaatggagagaaatactaattatcacctgattaacttagttttaatgtgtaattaacatctttattacttcatgaatcttgcttttttgtaatgctaagtagaattgttttagtacatctttttttttttttttttttttttattggtaatgaatccagaaaaatataaatggaagttgccagggctttatacttttatttcaccatcccttttacattgaggaagattgagaacactatatatatatatatatattcagatattttacatatataatttatagaatggatgcacttactgtaaaagaaatgttggtaaattattctaaatatctatagatatgaattcaatatttagaggaatataaatgtgttgacataatttttgatttcttagcataaatataaaaaatagatttcttatgtatatgccatattctaatgtgaaattctccaagtaaccctaatttaagaatgaataggcacctttaggaatttgttagtaacagatttatgagtggagtgatataggcctgagtttgtagagaatttatgaagaaaatggttagatagctgctgcttctttttcttatcttttatctatcatttatctatctatctatctatctatgtatctatctatgtatctatctatctatctatctatctatctatctatctatctatctatgtatgtatctatgtatgtatctatgtatgtatctatgtatgtatgtatgtatgtatgtatgtatgtatgtatgtatctatctatctatctatctatctatctatctatctatcctccagattttattccccactcggtccaccctatgattgttccacaacccatatctcctcccaaccccccctgtttccatgaggatgtccccaccccaccccaagcccacttgacctctaaaccctaaggcctcaagtatcatgagggttaggtgcatcttctctgactgaaccagacccggcagtcctctgctgtatgtgtgttggggacctcatatcagctggtgtatgctgtctgtttggttgttcagggtttgagagatctcaggggtccggattaattgagactgctggtcctcctagagggttgcccttttcctcagcttctttcagccttccctaattcaacaacagggatcagctgcttctgtctatttgttgggtgcaaatatctgcatcggactctttcagctgcttgttgggtctttcggagggcagacatgatatgcccctttttgtgaatacttgatagactagtaatagtgtcaagccttggggcctccccttgagctggatcccaatttgggcctgtcactggaccttcttttctcaagcccctctccatttccatccctgcagttctttcagacaggaacaattatgggtcagagttgtgactgtggaatggcaactcgacccttcacttgatgccctgtctttctgctggagccgtctctacaagtcacctctgtagggtatttcatctaaggtccttccttccctttgagttctgaaagtatcttaccttccaggtctctggtatattctgaagtgtacccctcctcgccaacctcctacctcctgaggttgtctgtttccattctttctgctggccctcagggtttctgtcctttcccccctcccaatattagataatattcccctcttcctcccccgtgtccaatttcctacccaggttcttctctctcaccgtcccaacccccttgtgattgctttattctttctaccaagtgggactgagttgtcctcacttgcgcccttcaggttgttgaccgttttgagttctgtgaactgtatcttgggtattctgtacgtttttatggctaatatccactaattagtgagtacataccatgcttgtccttttgggtctgcattacctcactcaggatattttttagttccatccatttgcctgcaaaactcaggatgtcctcattcttaatagctgagtagtattccattgtgtaaatgaaccacattttctgtatccattcttctgtggtgggacatcttgggtgtttcaaacttctggctatcccacacaaggcttctatgaacatagtggaacacatgcccctgtgacatgatggggcatcttttgggtatattcctaagagtggtattgctgggccttcaggtagatctattttaaattttctgagaaacctgcagattgatttccagaatggttgtaccagtttacaatcttacctgcaatagaggagtgttccttattctccacatcctctccgacatgtgttgtcacctgaagttttgaccttagacattctgattgctgtaaggtggaatctcaggatcttttgatttgcatttctttgatcactaaggatgttgaacatatctttaagtgcttctcagccattcgagattctctgttgttagttctcggtttaattctataccccattttttgattgggttgttaaggtttttttggtggttagtttcttgagttctttatatattttggatattagccctctatcgaatgtggggttagtgaagtttttttccccaatgtataggttgccgatttgtcttattcactatgtccttgccttatagaagctctcaagtttcatgaggtcccatttatcagttcttgatcttagagtgtgagccattggagttctgtttaggaaatttccccctgtgccaatgagttcaaggatctttcccactttctcttctatttagattcactacatctagttttgtgttgaaccacttggacttgagttttgtgcaaggtgacaaatatgggtctattttcatttctctacatacatacagccagttagaccagcacattttattgaagatgttttctttgttccattgtatatttttggagtctttgtcaatggtcaagtgactggtaagtgtgtggtttcatttctgggtcttcagttctattccattgatcaacatatctgtctctataccagtaccatgcagtttttatcactattgctctgtagtacagcttgaggtcagggatggtgattctcccagctgtacttttttttattaggtattttcctcatttacatttccaatgctatcccaaaagtcccccataccccccccaatcccctacccacccactccccctttttggccctggggctgtacttttattgttaaaaattgttttcactattctgttttttgtttgtttgtttgtttgtttttttgcctgtccagatgaattcctttatccatgtttttgaagaattgtgttgggattttgatggggaatgcattgaatctgtagattgcctttggtaggttggccattttcactatgttaattctgccagtccatgagtgtgggagatctctccattttctgagatcttcttggatttctttcttgagagacttgaagttattgttgtacagatctttcacttgtttggtttgagttagcccaaggtattttatattatttgtggctattttaaagggtgttgtttccctaatttctttctcagcctgtttatcatttgtataaaggaaggctactgatttatttgagttaattttatatccagcctctttgctgaagttgtttatcagctaggagaagttttctggaagaatttttgggggtcacttatgtatacttatcaaatcatctgcaaatagtgatatatttcttctttgccaatatgtatccccttgttctctttttgttgtcttactgttgaatcaatctcaactaaatttggagacaagcaaggatacccagtctccccatatgtattcaatatagcttctgcttctttacatagggctaatctaatgcttttgcaatttttcttctcaggagaatggaagcttgtatgctgtttttctccttttaatttgtaattacaactctttatatctcctccttagtatactgaaaaacctctgggttttagaagaattaaatgtttgctctttgataattaatggtacaaaatttgctcaagcctctttagagttaaaacataaataaactctttgaaggggggaaacatgaaagtagtatgcaaaaggtcacaaatcctgtttaatacatataaggtatacaaactgggagtcttacattgttttatttccttaatgtgtagttgcaaatttttgaacaataatactgattaccgtaatagtattttatttggtagagtttgctgtgtttcttgcactttgtttttttttttttttttccttctttttctgagggtggcgatattttacatggtagcacataaaaccttcctaaaatacatgagagatatactatgaaatgatgacattaaggtgatgggatagatggcagaaataattcattaaaatgtagagatggaattaaaatttaggttatctttctcaagattttttttaaactgccaagtttatttcatgacatgtatagagagctctctgttaggaaataggacgtgcaaaatttagccttttccatttttggtcacacaggacatagaacatatggcctaactcacactagtatgtactatatcattatgataaaaatttggccacaatcctgttttattgttactaaacgtgtcctgtgacagggaacaatgttctttcttgcttcgtgcttcttcctttaaaaaataggtaaatttctaatctgtattgtgggaaattcaaaaggaaagtaattctcttagtttctactttttaaccatataggtttttttttgcatgaatatacagcaattttaagttgacaatataaagtaaaatatattttgatcaagtagagcttcttattttgaggtatctgttgttgaatagactgatttacatagggttacacttactgagcatcaagtgaaaatttcttaagtatagatcaactgtgtactgtgtgaagtacttaagacagcatgacttaatgtcagctgggcaatggaaagactagataatttttatattctattatactttgagattttatgtttctacaaatatcacagccgtttctttaatttatttaatagagtacacttccactatgtgtaaacatacacacacacacacacggggagggagggagggagagagagagagagagagagagagagagagagagagagagagagagagagagagagagagaatttggctttagattgagtgttgcacacattttattatcgattaaaaagcttgtgactatagaaggcacttgtacatattttaattagacatggctacacttgtacatactttaaacagacataatatgtagtttctggttagaaagactatgatttataacatctttgctcaagaaggttcagatccatgctaggcagacgttttagaatgtagtaaatcctactagatgaaactgcatgagggatggttgcatagaggatttttgttcctcaaacaattgggtgcaatcaaatacagactcaagagaaagcaaaaatagtactggttctactattactatatgcgagaattaggaggaaatttaaatatctgtgaacaattgtaggaaaaggtcgttagtttgtttagtgtttataaatcagtattgttatgtgactttccagtgtacatgaggtatctatattttaaatatttatcagtggctcatccataaatgaacactttgccatttctataaaaagtttaaaaatgagtgagatgacagaaagattgaacatctagtaattacgatctttcaataccattttaataacaagttatataactcaaaacataactataatacagtatctaaatatccttgcatattctaccacagaattgtgattgaatttttggtgaggtcaggtttattgaaaagtgaactagttttagtcatatgaataataaatttgaattcattttaattaaacttttttccaattaattttattttatcattgccattttattaccttctttctttctttctttctttctttcttttctttttctttttctttctttctttctttcttttttttttttgagacagagtttctctgtgtagccctggctgtcctggaactcactttgtagaccaggctggccttgaactcagaaatccacctgcctctgcctcccaagtgcttaaaggtgtgtgccaccaccacccggcttattaccttcttattcaagttgtatctttaccattttatgtaagaacgttgtttagtcaaattattgccatattagacagttatttgctatttatatccagatttttatcatttgcaaattgaatttttttctttttacatttcaaacattgggagtaatataatctgatttgggaaaagaacttagttataaagacagaatgcatttggataagttatatcagtatcaaaagtagacaatttggggattactggctattagtatcttagtggaacattggaaatagagatgacatagatgtaatccttgatttgaaactccctagatattgttttaggcaaattactttgtttctgtaagttgtatgtttttttttaattcttcacttgcattgacagtctctctctaaatgagttatttgaatacttcatataagataactacaaagtgtttgcatacaaatatctatttattattttaatcattttattcatttatatatctatttgtaaagagtttcaacttgtctctctgccagaatgttcctttgaaagatttctgtgtaatttaaacacaatgcagcatgaatggggcttctcagaggtgtgaaatttgtggcccttgttagcatttaaacattatacttcctttattttatagagaaaaatatgattgaattttagattgaatgtatacaggacaattccaaataccaccattttctgtgaacaagagggaaacaaccgtcaatttatttatcatttactcattcattcatttaccaaatatttttcagaaatgggctgtgtatatcatcatagtcaatcatctctgtgttaagtggatgcaaatagaatatacgtttaaaaaacaatcataaataaacctatgcaggaatgaatttacccaattttatttttatatgtacttaatatctttaaatattccatacacgagtactatatttgcactatttctacgctactctgtcctctgttcaactcctcccaaatcttaccactccctttcaaattcatggccccttcttctttaattgttcttgctacatacacacatgtacatgtatgtattgatatagttgctgattccatttaatgttgttcatatgcatagatgtgagtggatgactacttgggactggataactcatcagaggactcatcccctggaaaggcctattctccttttcttgatggtccttaatttccagtatttcttcatctagtgataggaccttgtgagattttccccatctacactggcatatcaactggtactataattatttaggtcttgttaaggcaaaggtattgttaagatttcatgggtctagttgatgtcatatatagaacccacattttgaagcagatgtctctcacagtcttcctgtccagattgcttcatgtcttatgtcctctgagacttagttgtataagttgtggtatatatttatctgttgtggttggggaccatcccccaaagattcaattgttcactttagtttgatcagttgtggctttatgtaatggtctctgtctgctgcaagcagaagctacattgatgagggagaagaactacatttttctctgtaggtacaagtataagcattctgaatgaaattaggcattgtattggcttaggcaagtagatgtagtaggttctcctctagattccatggactcaccagatactagtagttaactaggtttctaggaccaggaatgaactcttgtctattaagtaggccttaagtactattagatggtctctgattaaagctaggatataagagctactattgcacccttgagacaactagagttttatttatttatttatttatttatttatctatttatttattcatttattcattcatttattcatttatttatttcttatgtgtatgggtgtttagcttgtatgtatgtcctgtgaactatgtttatgcttagtgcccacagaggccagaagaagacattgtaccttggaatttgagttacaagttgttttgagctgctatgtaggtgataagaattgaacccagatcctttataaggcaaaaagtactctcaataatgaagccatcttatcagctcctgaagcaattttattttaaatacatttctttatagaagattcaaatcaggtaattgcataccatatggaaagccattgacttgaatagtttcattcactatcaaccataaagtcttagttggagacaaaatatatgaaactactcacttaaaatcagattttcaaataagaattctgagcccaaaagctcagaatacctatgatacaacccacaaactgtatggagcttaagaagaaggaagaccaaagtgtggatgcttcaattctacatagaagggggaacaaaataatcacaagaggcagagaaaaggagggacctgggaaggagaaaggagggggagggaaaaagaggggaacagaatcaagggttggaagggacaagagagaagtacagagggtcaggaaattgaacagaggtacacagcagtggaggatagggaactgggggtagccactaggaagtctccaaagccagggatgtgagaggctccctctaggatgactttagtcaaaatacccaacaaaggggagatagaacctgtagagaccatccagtagataggcatggcccccagttgatgaatggggccacacaaccatctcaaaatttttaacccagagaagttcctgtctaaaggaaagattgggacagaaaatagagcaaagacttaaagaaaggtcatccagagattgtcccacttaggaatccatcccatctgcagacaccaaatccagacacaattggtgacaccaagaagcacttgctgataggaacctggtgtggctgtttcctgagaggttctactagcatctgaccaattcagatgtagatactcacagccacacattgtactaagcccagggaccccaatggaggaggtaggagaaggactgaaggagctgaaggggattgtaaccccataggaagaacaatatcaactaactggacccacccaagagctcgcagggactaaaccaccaaccaaagactatacttggagggatccatggttccagatatatatgtagcaatggatgaccttgggcagtggggcagaagtaggtgagtgggtggaggcacactttcatagatgcaaagagggggagagggaaatagtatggggagtttgtagggggaaaccaggaaggggtatatcatttgaaatgtaaataaatgaaataataaataaaaataataagtatttttggactttttatttaccatgatgaacaaaatcatctaaatatttgtacttaagcagaaattaagaaatgaaaatcagagagaaaatgtcatttgatttttgagacctgaaacttgtcctttcctttgatttactaaccagtaggcttagtccaatgatcttggaaagattttccctatattcatttggctttcaatttgctttttattcctaagctgcaatttgaaacatagctttctgacttgctctcattttccttcgtacatcttaagacagcaattaaaaaaggttgggtgcataggttactattttatctatctctattactctggctgagggagatatttaataaagacaaagtgtaattttttttatatctgatgccctatttatgctctttgccctggagaagagcttcattcaatatcagagtgttgtttcaaatcactgaaaaataataattggtttgagtagtccacagtgatacaattccttcacaaaacaggtttttctgtttatatgtgaatggggaggattattcatcttggaagattaaagtggcatggtggggtgaaagaactatgcataaattactgctatagcacagttgagaagcaggaagagaagctgagcatctctatgataaacgctcttataattagcaagatcattagcatggacagaatatactttagtaatcacaaagaagtctttaagcagttagcttcacgatgtagaggggaaagaacagaaataagctatatccagctgaataggctttttagaatctccaaggaggtgacttgtctgttgatggccagtgggggtgcaagagtggaataattacttagcagcctgtaaacaatgtgagatgtgaagtatgtgtccccctcccccacttttcattgagagagtttcttgttgagatggctccacagggacaggcagcagagaaatttgattaaatggatgcctggggtcacgaccctgtctaaacatggtgcagctctcagcattaatcaaagattttttttttcttacttaaaaaaatattctgaccttgttctatgtgagtacgagtgaacagtgaatttggttgttgttgaacaggaggctgtctaagtttgtggacatttttgtttacagaaagagaacagcaagaggagaccgtcttctagcaaaatagtacttctaaccttattttagatcgggttatgggactctaatttgctgataacttatcaacagctagtggaaatttgagttccattagaattcatgaggactcgtttattacagaccaatgttgacaacggtctgagtgttcagaagtttacaacattgtggttagtatgagattcctatattttaggaaatctcttagattggctttactttgggctagtgttttagaactgttttcaaattatttttcaggaaaatgttgaaaactatagggttttagaatcactagaatagagttccctggtgactcacataaagccaggaaaattagaatgtgcatgtggcattttattaaatttgcttatggtgatatacttttccattaacatttctttgaagaaagaagccaaattggatccagttaggtggctattttctttataggagtgtaattccaagaatatatacttgattctagagcatcaaaatcctttttgttactacaaatatgaatgcttttgtagaatgttgtctgtttacagcagaagccctctttctttcctcctctttcgtttttgcttttgtttttgtttttggttttttttttgttgttttttttttttttgtttttttttgagatagggtcttactatttagctctagctgtcctggaactcactatgtagaggactctggccttaacctcccttgctttacaagtgctggaattacaggtatgcatttttaagcctggtttacaacagaaatcttaataacaactataaagtaagggtattctaactgatttaagttcaacagatgcttgtgttggtaatttatattaaaaaatcatttcacaacatgttgacttatttgatgatctgactttgtgaccatggaaaaaaacaaacaaacaaacaaacaacaaacaaacaaacaaaaaccccaaaaccactaatcaaaagattgattctagtgatgatctttgattatcggttataatttttatcatatttgattctatagcaatgtgaataaattataggttatgtggaagcatagttttcctgtgtactataatatgcttggaagtcagtaatgtgctccaaaaatgatcataataaaaataataaagtttttgtttttgctaacagtatgtagttaaataaatcctgttgactgaatgtggtgatcaattatagatcataaagacattttaagtttagcattctttggatggctgtttataaaatacagtttgtacttggttttgtgaagtaagaaacattgttacagttctgttagatgataacttatggtaattgaagaaacattgaactggaaagcactttccattgaggtcgaagtattataaatgaaagcagatcatttgaattcatccacaaccaagtgggtttaatgtttcatgcaatatttcagcactaacagagaacatgatttctgtttaaacagtttatttcaattatacatatgtttaatgcttgaaaatttgcttttataaccaaaaatgtaatgatatactgagaatacccaaggaaagatatatttttactacagaattgtgattccaccaaattagactataaagaataaaacattgaccttgaaagtgaatattcaaagccttcacattgctctatggagtttgggaatgtcaaaacaagttgattttggtgtaaagtttcactggatgaaatgtttagcaagtttctacaattgagacagttgtaggaagtgaagatttctgtgtgaataaatacaagccctcatcaataataatgaaccaaatatagttatactgtttgatgccaactgggcttaaaaatattaaattttccagagtgatagctctgtgtgcaactgggattgctgtcaacctgatcacctgacttagatctttggtacgtacatagtggaaatagggagtcaacttcagcaagttttactctgacttccacatgtgcactgtgacacacatacagcacatgtatacacacacacaacacacaacatacacacacacaaatacataaacaaaatttaaaaaaatatgaaagttccttacagaacatatgacagaaagtctagattctgatattttactaccttttgccttagaataacaaatactttaaattgcaatgtaaatccatgaagatataaacacaagtttgtttgtctaatcatagacaggtgcttgtcttccagtctgacattaatattatggagttattgttaattctacttcaatttatgagtaagtaaaagaaaatatgcatatcaaatcattagtgtggagctattcatacttctatttattgaacatggtgttatgccatgaaatatctactctcattcacagtttaaacaatgtactattattgatataaacacttgatttgcagtgtgtgcatgttgtggttatagttgtagagaaagagaagagacatatcacaattccagggccttactttctataacagaaagctgcttgtattaagactgatacatatgtaaacaaagcaaaattaaagaaaagttagaattgagtcgtttttatctgagcttacaagctccagtttgaaaggcttttagcaatataggaacttttgatttaatgattggttaaactaaacatcaaggtaagtaaaggactgcattttcctgagtagaatagagtgaaagcagcttgttgagaggctgcagaggagcaggcagagggaggtcacttgtttgcagttttgaaagcttggaaggacactgtgtgctggggttaagaaaaggaaagagtttccaattaatttgtaggtagtgttttgtacttatggtattagagtcactaaatttggtagctagaaaacaacgcagatagttagtaatggttttatggcatattgtatagcaccttgctagtctgacctattgatttttgttttacttcttttttttgtttgtttgtttttttttttttttttttggatgcaaaagcaagaggtttattttccattgcatcagggtcaaccctacatcagtcccttaaggcgagtaacaagaaggtgatcctgaatggctattgcaagcagattttatactttttaggggcacaggttatatcagtaaggttatagttcaaacttactggctaagcatattttttctttctttctttctttctttctttctttctttctttctttctttctttctttctttctttcttctttttatttgctttttaaaaaataggtatttacttcatttacattttcaatgctatcccaaaggtcccccataccctcccccccacactctcctacccacccactcccacttcttggacctggcattcccctgtactgaggcatataaagtttgcaagaccgatgggcctctctttccactgatggacgactaggccatcttctgatacatatgcagctagagacatgagctccggggtactgcttagttcatattgttgttccacctatagggttgcagacccctttagctccttgggtactttctctagctcctccattgggggtcccgtgtttaaaaacatacaatgtttcattttgaaaatgcctcaattaaaacaaatttatgtacttatttttggatatatgtgtatttgtccattgtgtgtgtgagacatgtattattcttgaaatgtgtgaaggagatttattactctttatttcctattggcatagtacttcatatttggatgtattaatactgttaatagttcattttagaatattttaaaagaaacttttcttaaaatatttatttattttaaaaaattaaggcttaaatcattgtgatttaatgcttctagatgcagatttcttcattcaattttattgctttatacatcttaatttacatttgtgaagcattagttctcagcaataaccatttaatgctatttcctgaattcccaaataaatcaaaactttaaaaagatgtagtactgcatttttaaaatatcatgtatagatctgttctcccaaattcttttgctctgatcacttttaaaaatcagtactataaataataatttattgattactaagtattgtaatcgatttttaagaaatagtaccagttttaaagatatcccctgtttaatgctgtcataaactcttaaaagggatgttcctgctggttaatttcttaaggctgtgtcattgaacacttccattatatggcagggaagatgcaatagaagcttaccccgaatctttgtctgaattctccagtgagtctgtttaaaggaatgacattgttgaccttttcacactcctgacagtagcaagtgtggtcatttagtctgaactggaagcaagggggttgtaaagagagaccgaaagctaacaatgagaattagtaactactggacaagcctaaatgtaggagaaaagtactcttaatttacatcaaacaagcttgtcacttctttatatagcactcttttagcaatactgatcaaagagcaatagataattgggagaaagcatggagatgtgagatttcataggattaatctagattaaaaatgttagcactttgataattagttcaaaaataaattgaaaagaatattaatcaacttgtaatagatgacataaaaaaacaggggatgtctttaaagctggtactatttctcaaagatcatttatgatacttagtaaccaccaaattattctttattgtaccttttaagattttttttctgtttagtctctgctcaaccctgtccccttatttctaggttaaaagttttaagggtgagtgaccacatccctcaacagggggccatgcctaacctctggatatggtcttgacaggttctttctccaatttattgggcatttcagctaatgtcatccccattgggtcctgggatcctcctgctttcttggcatctgggactttctgttggctacccccagttccccatcccccattactatacacctgtgttcaatttcctgaccctctaaacatctcccctgtctcctcccatatctgatctggtcccctctttttttcctctccccctcctctcttcctcccaagtccctcccaccctatacctcctttgattattttatccccctttctaagtaggactgaaacatctacactttggtcttccttcttcttgagcttcacatggtttgtgaattgtattgtggctattccaagcttttttgccaatccatttatcaattagtgcataccatgtgtgttcatttgtaactgagttacctcactcaggatgatattttctagatccatccatttgcctgtgaatatctttttttgtttgtttgtttttttcgagacagggtttctctgtatagccctggctgtcctggaactcactttgtagaccaggctggtctcgaactcagaaatctgcctgcctctgcatcctgaatgctgggattaaagtcgtgcaccaccaccactcagcttgaatttcatgtttttaatagctgagtggtactccaatgtgtaaatataccacattttctgtatccattcttctgttgagggacatttgggttgtttccagcttctagctattataaataaggctggtatgaccatagtagagcatgtgtccttattacatgttggagcatcttctgggtgcatcttctggctcaggagtggtataggtatagctgggtcttcaggtaatactatctccaattttctgaggaacctccagactgacttccagagtggttgtaccagcttgcaatcccaccagtaatggaggagcattcctctttcaccacatcctctccagcatctgctgtcacctgagtttttgatcttagccattctgactggtgcgaggtggaatctcagggttgttttgatttgcttttccctgatgactaaggatgttgaacatttctttaggtgcttctcagacatcagtattcttcagttgagaatccatttaattatctatctatctatctatctatctatctatctatctatctatctatctatctatctatctatttttaatccagattttgtcccccccatgtccaccctcctactgttccacatcccatacctcctccccactgcactgtttccaggaggatacctccagcccacagcccaatccatgtgacctgtaaacaccctggggcctccagtctctagagggttgtgtgcattatccctaattgaacccggacatgtttctgtttagctctgtacttcatttttagtaggtttatttggttctttggcatctaacttcttgagttctttttaacattggatattagccctctattgggtataagattggtaaaaatcttttcccaatctgttggttgtcattttgtcctattgactgtgactgtgtgtaaaattgctttgcaattttatgaggtcccatttgtcaattcttgatctttgagcataagccattggtgttctgtttaggaatttcccctgtgcccatgtgttcgagactcttcctcattttctctcctattatattcagtgtatctggttttatgtggaggtcttggatccacttggacttcagctttgtacaaggagatcactttgcattcttctacatgccaatcaccacttgagagagatcagaacaagaaaattctgtacaccagatttaaactgttttttgtaatttcacataagagattgtatattctttatgtctatatggcaaatgaagcaaattcattttcatgttattataatgataattgatttatcaaaatctttttttattttattagatattttctttatttacatttcaaatgttatcccttttcctggtctctttctgataactccctcccctttttccctcccccttccccctgctcaccaacccacccactctggctttctggccctggcattcccctacactgaggcatagagccttcacaggaccaaggacctctcttcccattgatgaccaactagtccatcctcttctgcacatgtagctggagagatcacttcatgtgtcctctttggttggtgatttcgtctctgggagctctgggggtactggttagttcattttgttgttccttctatggagctgtaaactccttcaactccttggaatttatcaaattcttaatgataacaatatttgtgtcccttattattataactaaattttatttcggtataagatctaattatttatatataatgtttacatattatttaggtaaataatattatgcctattattataccccaaatccctaaaatatgaattattattactattattattatcattatatactaatagttattactactacaatcattgccattttatacaccaatataccaggtctgaacatgattctattactcaatttataagattttgtggtatcttataaataaagtcttaccatcaagttttggagagtaatcaagggaaattacaatagtttataatacttggggttgaggggactgactgaccaacaactaaaaatcagttaatcctttcctggcactgtactttttattagataacttatactgtctgggagatgaactgaccatctgttatagattgaatctattcaatctctttttacacatgtatatattttacaaagcttctagagtagtagatttccatatggactttttgaagctcttcaacattagttatccttcctgatacagcttcctctacctgacctctcatcttccacttaactttccttgcctgattgatcacattaccacttcatatcaacagtatcttttctcaccactcttgaaagatcctctccttcgaatcttttatagttttctgacttgtatggttattcaaatttaatcacaaatatctgcaaatttaaagataacatacaggtacaataaaaaatgtggcatttgtttttctgaatctctcttacccaagaatgattattttcagctcaatgcatttacttgcaaatctaattatttcatgtatcttaacagcttaataatattttattatgtaaatgtagcatttttgctatctgttcttctgttgatggatgtctacgtggtttgcattttctggctattaatatatcagtaaacatggtggtcaattatctcggtacttctccacagtgtttttcatagtgattgaaatcaattttcattttcaatctattttaatattgtgttaattttctctcctaccaataaagagcttttagtgatacctctgcttgtggttttagtgtttgttttggatatcatgtatttctttgtttccatgtgaatttaaagataattttctctcaatttccatgaagagttatactggacttttgatgcgattgcattgactctggagctgatttttatagaattcttgttttgttttgggtttttttgtttgtttttttgtttttgtttgtttgtttgtttaccatattaatcccactaatccatgagcaaagtctatatttttcttgttctctatttggtttagagatcaggatagagctagcttgatgaggatattttaaaagtatccttttctgttctattttatagaatagtttgataaaaaattggttatagttattcctttaaggcatggcagaattttgcagtaagtccatctggatctgggtgttcttttaaaaattagtaattgttttattgctgattcagtcttattgcttggggcagatggtatgtcatatgcatctttacatggttccaatttggtggaataaaggttttggaagtatatctttacatttttctgcattccattttaagtgttattttgtgtttacttttgcaatactgtctattcaattccattttcagatcttgaattgttagttgtttttattatttctttcagttgtttctttgcggcatttactcttcagtacagcatttatttatattctttgtgtttttcaaacacagttatgattgctattttgaaaatattgtcttgtgtgtcatctaagttgcttttctcaggaaaattttctctgagatttctggtttttggtggagacacattttatggtttttcctgtttatggatttttgtgatggcacctagacatcaagaattaactcatattggtattttcaatatggttttctgtcccacttttattgcatgttttgatatttgctgctatcccaatttcttaggtctttagctaaaaaaaatttcatgtttagtcttgaggcctctcagtgttaagatatgaaatagaagtagtctttgctctgcaagtgctaagtgccacatttgagaacaagagcaaattttcggtagagctagttattgttacagatcattagaagactgcagaaggtactgaaggtttcattttgatggggttaggatctgtgtgggcagggtggtgttacctgtgggtaatctatgatacccttgagaggttcctaggtggtagggttgtcaagaaccaggaagtaggctgtgctacttggtgaagatgtgaataacccacttggcagggctgtggtcctcatgtgattgagtggtgctacccatggaagttgcctgagattctgtcatccacaaagtgcagggaggtggaattgtggtaagagtgggaggaaagatgtgctacataggtgatgtacactgggcaaggaattgtcatcaggtgggtgggctcaatatatgctgtttctatttctgtgtctatgaaggctaaaggtcagaacattgtttgttataataaatacttattggcaaaaattttgtgagtttggttgtgtttccctattcctgatatccacagaagaattaacttccatatctcataacaaatatcagaatcatttattttaccatcataatataaactgatgtaaattacagatgagagtatcattttactgaactaaactttagaaagaagtcttctgatcatgtggttaggaacagtgtacatttcttcttcttttttgtggggggctttgtttgtttgtttgtttgttttttgaggcagggtttctctgtctagccctggctgtcctggaactgactctgtagaccttgaactcagaaatccacctacctctgcctcccaagtgctgggattaaaggcatgcaccaccactgtctgaatcatttttttcttcttaagataagcatctactaaaatcaagtatctgacttcttgtaggatattttgctctctctcctaaaaatttgtttcttctattaagttatatgtgaaagcttagttcatgacaaatctttaaaaatttctttccctctccactaaaataacattactttcttttttctcttcttcctcttcttcctattcctcctcctcctcctcctcctcctcttcttcttcttcttttcttcttcttcttcttcttcttcttcttcttcttcttcttcttcttcttcttcttcttcttcttcttcttcttctctcttcttcttcgtcttattgttcttgttcttcttgttctcattattcttgttctcgttcttcttctccttcttgttcttgttcttcttgttcttgttcttcttgttcttgttcttcttgttcttgttcttcttgttcatgttcttcttgttcttgttcttcttgttcttgttcttcttgttcttgttcttcttgttcatgttcttcttgttcttgttcttcttcttgttcttgttcttgttcttcttcttcttcttcttgttcttcttcttcttcttcttcttcttcttcttcttcttcttcttgttcttcttcttcttcttcttcttgttcttcttcttcttcttcttcttcttcttcttcttcttcttcttcttcttcttcttcttcttcttcttcttgttcttcttcttcttgttcttcgtcttcttcttcttcttcttcttcttcttcttcttcttcttcttcttcttcttcttcttcttctttttgttttgtcttgttttgttttcgagacagggtttctctgtgtagccctggctgtcctggaactcactctgtagaccaggctggcctccaactcagaaatccacctgcctctacctcacaagtgctgggattaaaggtgtgcaccaccacttcccagctatagcattactttctaaagatgaacaaatatttgtatttctaatgtgcaacatacatatttgttggtagttttctgctctgagaccttgtgggaaaaatctgaccaagtaaaatcacccagacacagaccatttcatttgagaatcaaggtttcctattgtttctttaaataagtaatcatgtcatttacacaacataatataaaattagcaaagagaaaatgattttatatgcaatattttatattttgttttcagtacttaaaagtttactgctgtccagttatagtgtttttataatatttctgagattgccttaattcacttagtgttgcttatcattagccacataaatttttttgcaaatgatttttctgggtataaataactctattgtttgtatataccacatttcctcatccattattctgatgtttgagatatagaatggttacataatttatttattttacaataattttgccatgtattttctggctgaacattgtaatcccagttgtctcctgactcatggaaattctttagttcttctgttagtatccttagtgctgggtttatgggtaaaggtggctatacctatgttaattttattcttgctcaagacattctagctactaaaattggttaaaaataaaataaaagagtcaagggtgagggaaaccaacaatatgcacatcatcattgctccttaatatttttgttgactcttttgtgaaggatttttctctgatttaattgattttaatttctcttacagtatgaaagaagcatcaactcacctataatagaacagctgaattagtcattaaagaccatattacctcaatctcatgccctaatccacatggctatattcacacacacactcgcgcgcgcacacacacacacacacacacacacacacactttatctctttgggcaaaggttcactccaggagatgtttttccttctaattagatacacattatccactcagtctgattgtgaagtttataagttgattccctctcactttttctcttgtcttcagtgtcttaaaccagacaatgaaaacaaagatacagtagaactcattttctcattattgatttcatgcaccagctgccagctgttttagctcgttcatttatataaccctctgggcaactttttaaaagtacttttctttgaccatctgctaaatacgattggtttaataattaaagactcaccatcccctttcaaagaaacataaatgttgctattgaagctaagatatcagcattttgaattaaaagacagaggcagctttcattctgtacatgggcattgaacactttgagacactagttttttgtgctttctttttctatccttctctgtacataacattaatgtgaaaaatatcccaaatcttacaagatttttgcttaaaaattcctattccatctctttatattttgccttcagttaataagagttgattcctaagcttgatgaaactacaattttataaatacacaagtggctttggataaggcacattagctggattcatggacaacatgacccattataatgaatgcagatatatttccagagagattcaagttcatgcatgcaatgtagcaaagctggaaataagtcagtatcactcatgtacaacagcatcatggtttaaacttttggcttggactcttcattttctaaaatattactttcacaaaagcagcaacattagtagtgtcagaagctacatgcataagtctcaccaacatgattgcctaacaaaagagatgaatgagcaagtgtggctctaatagacataccaaaagtggatggggtaagtccacaggcttcaaccctacttaaagaccacaggcaactaaggaaagctaagaatgggagaaataatcttcctcaagaatgattacagcaattagttatccaatacaaaatggtcatcactaaaaatacacatacaggatatatatgtagaaaaagcaggctgtatttagaaatatataatataatataatataatataatataatataatataatatatatccatgtaatgataatgtcaaaaagctacgattatgaaagagaatgaggaggcatatatggagtatttggagggaaaaagggaaaggagaagtgatgtaattgtattacaatctcaaaataaaagtaacaaatctatatctatctatctatctatctatctatctatctatctatctatctatctctatgtgtgtgtgttttatctatgtgtgtctgtgtatatctgtgccacatgtgtgtgagtgccagtgaagaccaggaagagggtggcatataccttggacatggtagaggcaattgtgagccattcaatgtgggttatgataagcaaactagggtcagctttccaatactttggaatgtttctaaaacttacagcttatatctctaactgaactttaataagtcagtggttttgcaatacatatagtattcttttgaaaatactccatcaaccattggaccaaacacagggtccccaatgtaggaggtagagaaaggagtgaaggagctgatggggtttgcaaccctataggaggaacaacaatattaaccaaccagatctcctagagctcccatggattaaaccaccaaccagggagtacatgtggagggacccatggctccagctgcatatatagcagatgatggccttgtgggacatcaatgggaggagaggtccttggtccagtgaaggctagatgccctagtgtaggggaatgccaggacagggaagcaggagtaggtgggttggtgagcaaagggagggggaccgaatagagggtttttggaggggaaaccagaaaaggggataacatttgaaatgtaaataaagtaaatttctaagaaaaaagaaaatactttaaaaaatgaaatacattgcactttatttcaaggatacaatgagactgacctgtaaaattatagttgtatataatgaaaactgtatttcattttaatgacaatattttactgttattaattgaaggaccaagtagcaagtagcatatgagctgaatttgtgcaatttgaaattgtctggtcagacattttttgatcagctaccctattctccctcaacctcatctctttgagttttttgtttgggttgttttgtatttcttgaggttattgtttcatgattgtcatctgaaaagacttaagtgtagtgtatttaatacttgaatacaaatctttccaggattaaaagaaatctctttagaaatatttccatgttttagccaagtttcaaaacaggaaaaatattctgaaaaatatctattcttgcaagtggtcttcttcctattagtactctttggtatatatatatatatatatatatatatatatatatatatatatatatgacttttgctccttattttgtaatattattcaaaagacattaaattgagataaaaatgtgttttccaaactataccttccaatattcttgcacacacaccattcccaactcctcacaccacagtttggcagcaataatatcttagcaaggccattcttaccttgttgccaactcattattctcttacagccttattacaattgtgctatctgcaaatgccactgtgcaggctcttcagatagaatgaatagccagtgaaaatgacaacagataaaactttctccaatctcatctttgatcattcttgattggtaagagagagggaaaatactagttggatttgtaagtgaagggatgctatagatgtgctacttagactgattttctccactctctgttcttttctctttcttttctttcctctccctttcctttcctttcctttcctttcctttcctctccctttcctttcctttcctttcctttcctttcctttcctttcctttcctttcctttcctttcctttcctttcctttctttctttctttctttctttctttctttctttctttctttctttctttctttctttctttctttcttttctccctccctccccttttctcttttttcttttcttttttcttttggttttaaatacatcccaacagtagttttgcctccctccactcctccccatttctgtcccacctcctctctcctcaagatccactcctctgtttcccttcagaaaagagcaggcctcccaggaacattagctgaactgctcttaagactgtattttgttgttgttgtttttgtttttttgatgcaatgtctatagaaggctagcttttcagtattatgtttttaaacattttttgagaactttagacagtatgccttgataatacttacttgtacaacttcccataattgctctgaggtacacctcagtttcctaccccttcctaacttcttgttctccacttttttgtaatagtccattgataccagtttatataggaagagtccttttattgttttgtacttagcatattctgataatattacaattaatggaagttaactgatcttgaaatgttctgataagatagacctttaaaactgaaattttcattaaaagcttaaatagcattctacaatgatggtttagtgttatctaaacaagcatggctactggaaattgaaatgtgttaatgcatgttttatattggttaaaaacaggttactctgagaacaggaagaattgtgtagtgtggttgtatatattgaattaaaattatgcatttagcttcttggggggtatttctatatagttgacattgatttatatttttatgctaaatataaatgttattatcataactaaaattatagtaatacttgagaaattatcaaagcaaagaaacatagtttcatgataagttcttgaaaaatatcgcaatatcgatttatatgaaatggtacctgggacaggagatatatttcagtactataaactaaaaaaaaaaaaatctgtagcgtgaaatctttgacatttctgttatgatagagtaaatgcatcgttttttaaccctatttataatgtagatcagagaaagaaagcatactgttttattgtcatatagaacaataaaaggaagattaagaaaggttaaattctgatttcagcacaccagaagtgtagattcatttgagtcttctttttattttataactgttgtttgcttaagataattttgtctcaaattaattaatcagccttacacacagtgtgctatagatttatcttttgttcctctagacagtataaatcttggcatgtcaattacgtgaaatagtacattccacattatattgctgaaggaaacttttttgcggttttgttcattgtatcacaaagttccatactgctgatcacatttctgtgaaaacccctgagagttatatatggagtattaaggtaaatacacacacattcaaacacatagcctaaaatagaaatttattattaacttttttcctctaataaaacaaggtcattgaatatatgaatgttttagaacatacaaatatttatggggaaaatacagctgtaacatttgtcataacaacacaatgtgtgatttcatttaacttttaaagttctatagtgttatgttataacatatcagtcatttgaagccttatagctaatatgtgcattcttttttgatctgagtatatttccttactttcctgagaaaagactgcatctttattatctctttggtaagaaaaatttgctataagtcaaatcttaaataatttaagaagaaattttaaatttagaaattaaattaataaataacttattaagatttttactttgatgacaccaaggaatcaaacatgagttaaataatagctttgaagtattttagtgcttagctttgagtaatgatgaagaatgtacacttattgctcctgagcatataagggtgatggtatatattttacttctttttctgggggaactatctaatcctgtcaacacaaatattattgagcctaaacacatagaaaaccttaaataaactttcagaaataaatgaatggctttccttttattctgtcacatacaactaccagctaaaacttggaaattcttttactgttaaatattttaagcaatttttagtaaacattacagtgtataattacctggggattatgttttccatatgatatgctacctttttcgttttgattaatataaactacagtatactcattttattaagtcttcaacaacaaactataacattgtgaatgtatgagtctttattttacacttccaaaaagcaaataccataatcttcttactattttatatgatttagtgctttttttaaaagtgattttagtggtggcaaaataaaaaaaaatcataattaactgtgttatttagacttttgaaaattttcttatacagtatattttggctatgtgctttccccttcctaaactcttccaagttcttcccacctttctgacaagccagctcatgttatttaactctcaaaacagaaccaaacaaaacaagccacccccaccaaagcaacaacaaaaacaacatgtgttagccaaatatttctgggcatcaagtctgcccagcagtatgactaaaacttcattggagaaaactgacttttctttgtcagtggggattaattgcaaataatgtcttagttaaggtaagataggtttaatcaaataggtgctgcaaaagctgactttaaaagtttaataaaaggaaaaacgtttaaactattacattgatataattgtactaaaagatttctggttgaaaagtttaataaaagaaaaaacatttaaactattacattgatgtaattgtaataaaagatttctaggtgaaatcatttaatgcaatatgcagcttgtgttgaacatatcatttgattaataccaaatgattcagttgaacgggaggcaaatatatatatatatatatatgtgtgtgtgtgtgtgtgtgtgtgtgtgtgtgtgtgtgtgtgtgtgtgtatatatattcaaaataaattcaaaataagaaaattaaattaaatttaaaataagaaaattaccttgccacacattatcttgaaggttacaatttgtggtaattttcaaagactaagcaaacatcaaatccatagtagtaaatctttaaagtctgtaattgatcatacctatagcaaatcatactgagactgtgtcagaaaaatcctgggtttatttttgccttagggtggtaaaatgtgtgtattaagatgctttaacacatgctcagctttagaacagtattcacataaattgccagttagagatattgtatagaagtcagtatatcgctgtgaaaagattcatgtggggtttggaattcaggattcctattatacttagaagtatgaattctaaaataattaggaatgttgccttccaattccttttcacattagaaattattacaatttacatgccacatacagttctcattttaataaatatgcttatttttaattttgataatacttctgttccagatagcacagacaagaatatcagcattaacatttctctgtttctggtaatttgactacttccaatatagggatataatcctagaatctaaactatattattgaccaaatttcacccaattaaaataggtttaaggaaccaaccagaacccccagagctcccagagactaaaccaccaaccaaatagtccacatggagggactcgtggctctagctgcatatgtagcagaggatggccttgctgggcatcaatgggaggagaggtccttggtcctgtgaaggctctatgccccagtataggggaatgccaagaccagaaagtgggagtgggtgggttggtgagcaggggaagtggggagggaatagtggggtttcagaggtgaaaccaggaaaggggataacatttgaaatgtaaatttaaaaaatgtagaaagaaagagtaaaataatatttagcaggtgatttagattgcatagaatttattcctattagtagcatattatatctttaatttttagcttagttatatatattatatactaaattacatcttaagaaactaaaaatataataaatagaataatttacttgatttatttaggatcagatggttattagttaaagagatagtttagaagaaagtgtccttaagccatgctctttttaaaaggtgtttttgataattcatgtataaggaaaatatcattttcttctcaagtgactatcattgatgttttcccaaaatactatatgattagcattaaacaatttcgattacatcaatgatcatattaattttttatatgacaacacagtgaagtaagtcatataagcttaatgttttggtgacattgaactgaatttagggccttgttccacctccactgaacaatatcctcatcaatttagcctttaaaccattgtcaaatatttattatactgcattttcaacatgtcatctacaaaaactgcttgtttacactcatgtataagtatacatgcgttccctcatttgtttctttattttccttgtagcgtgtattgtgataaattaaagctaaaaacctaatgtttacaatgaataataaaattgcatttacctctgaaaaactgttgagcaaaatcaaggggtctatttttaacgttttgtttctctacagagaacacattgacacgtacttatatgtagatttgcatattgtgttcagcacatgaaaagtctataccacatagtaattgcagaaaacagaaatgctatttgatttctagtcttatataatttacagaacaattttcttatgtatagtaattgttcttgtgctactactatgactctattctattttatttattaattgtttttagtttcagcaccaagagactattgaaagaggatacgaattacttttctatttaaaatttgtaaaggcaaagatgatttaaataataaagtcaaggctttcaacatcttttttgagttctttgttcctattcactaaatgctctgtaatttgtatctaaagaatttaagacctatttagtgtctccttgctattgatttttttttattttcatttgttctgattgtggtgggtaaatggggagtgtgaggtaatgggggcatgttatttgtcagtatagccaaaatgtattgtttcccactacaaatgcaccttcagaaagaactgggtggtctttcattgacacttgatgtgttttattttaaaggagggcattcaaaaatacaaagacattccttaagatgtgatcattatacaccaacagcctaacaaataagcagagtaaaagaccaagaatctcatattggatttgaacaataggcaagaaggggggaaaaagaaagcctagttgtcttagacagattttcggtgtgaagattgctaaaatttattctgtgtggaagacaaataatgtaaggttgagagacataaggaatgcatgatgcgatgggtaggaaggatctataagtcatatctggagagtaataccgttctctctattaacaagtatttactttcacaacacgatcatgggtgagttctttctctttcattttcttttgatttacaaagaattctttccacaattggatgaattaaaaaacaaaaacaaaaaaacctaaacgatgggaaggattttcaccaaaaacatttgagatgacttttgggaaatatttaggaaaaatctatggtggtagtattttaggatgaaaatgacaaacattagagatgatgttatatacagggacatttttgaataaagaaatatttacatattactagagaagtaatctagccattattatgagataaagagaaaagaagagctatgcagtagaaaagtatccacaatttctgcaaaggagaaaaacagtagcagtttagacagacagaaaggccaagaagaaatcagtcttcagatctgagcatttagtaataatcataactttgtcaaagttttagctagagctttggataagcttctggatacacatatgatattggaaattttaattggagacttgggttttttgattttactaaaacattattgtagatatctaagatagaacaaaatatttatttattctaaccaagaggaaattgctttgcatttcattgggaacaagagataaaggcaagagtaaaattttagatgagcaaaagagattgtttagaaagcaaaaaaaaaaaaaagttcacaaattaaaaaaataggaatggaaggaccacaatattctttagcagaggtaatttcagtttcagtcaattctctaatcccaaaattttaatcttgaaatgaaatagtattattcatataagaaattgtaaaataactcaaaagtctcataatcaaatatcatgcataaatctgtgggagataatacaaataaagtaataccgactttaaacttttactaaaatatatacatacatgtcaaactattcagactgaagttgtatttatgtatttatatgtagaaagggaaggggataaataatatacttttgttgtaacttaaaaataaagaactattataaaatactttattttagtaaaacctagaaagaagacctggaactaatgaggtttcatctagaaaatttcctttgaatacaattactccaaagacttgttagccaacacctcgcttctaaagacttttcaactgtcctataatgttggacagtcttgttatctctgggatgttttaatagtaaggttttgttgtttgtaaagaatgtcagcctagtgattacaacaagcccataattgtaccctaaaggcacacaaaaagtacccattgaaccgagagtaagaaggtagaactcgggctctttgctttctttaagtgaccagtgttaatattaatacagtaataattattataaaagagtctagagaagaatgaagtagttggaagacagcaattttcactagacaattgttctaacactttgtatatatttatagaaattttccaatctgaaagtccaaagtaaagctaattgtttggaggagaagtgaaactaagaatgtcttaaaaataaaatttagcctgatttttacctacatgtatggctttaaaaaacaaccctatctacaggtatgtgatgattgcctcattttgtatataattccacttatattattatgtttagatctagtatatatgcatacatatgtgtatacaaagtgttacatttatatattatgacacattttatattgatatatatctacatatatataatatttgaatgcatcatttaaaaggaaggattggattgactttaacattataaaatatgaactgtaaagaagacaggatagatttctgagttctatcttttttaaacagtaaaggttgaagaacatttcatagaaaatataccaattcagtatacatatgaagagaggatatcaattacatttcttataatacaaatattgtgaggcacacatttcatgagaagagaaacctgccaaaacaaacatctgagtttcttagcttttctacttcatttttctgtagcaagcaaagagattaaacctctaccactttttttagttgggaaaatatttgagttttttttggtcagtgttttctgaaagacagaaaggatatgcctcttagctaaatattgctaacagctattgcggtaactctttatgttttagaagggaaagactatgcctcaggtatgctaattcctatcaatgccaaaaacttctcagagggattttaatttgatataagtgaatgttaggtaggtttcaacaatttaagaagaaggcaattaacatattttgtggctaaagtggtcagcttatatagcttggttttacaagtaaacatactatgttctacagggagaaagcaatttgcatatagtcacataggcaggtacttgttccctttgaacaagtaattcaaagttgtaagccttgttcaacatctttttcctttaccagtgttagatgttgtttaaagtagacttgtgacattatttcatgaacttcaaatataatatttatcggtaataaaataacattacactgatccatgttccattctgtgctgtttccagggtatgtttttacttatgatcatgctagcttgagactttcaatggaaagttttttttttcattttttcttttatcttcacttgcttttgacaacatccccagccatctcttcctcaccacatagtctttcaatgcattttctataccttgtcagttttgtttcctaaaacatggttctttttgagtctttgttcttcaaaacttacctttgaatatccaaatcaaatttacacttaacaattaatatattactgaccacttcaagtaaagatgataatgttcatcagaaaattcttatagaatttacttcactaatctattcattattaatagcatatctttgggtgaatactgtatgtcaagaaatcaagtaacagttgttacctttggttctatatctttctagattgtaatattcatgatgctagacactgtgtttgaagatatttattttcttcatagttcatagcacatagctatttgaacatagctgatgatcagtaagtacttgtacaataaatattgactccagaagcagttgtgacagtgtgaggcctctatggtatccatatgcagactgtggcatatcgagtatgttcgaaaaattttcctcaattcctaaagaagtttattgttttcaaaacttaaaaatcacaaactttaccaaggctaatactatttcagtcccattcacatagataaatgtcaattagaagtacaagagcacattacacgctaaagctttgtttataaaagctcattgatgattcatactcacatatgctaaattcgacagttgcattatttgatgtttaggcaatgctctataaatgcagaaggaagaatcaatactatttagatatgagattggtaaagtgtaaagcagctctgtctagtttctcaaaagttaatactttgtaatttgaagtgcctgactctattttttaattagtaaagaatatgcattttatttatctttaaatagtagagtggtccttgtaaaggattaagtcatgggatgagcataaaggatttaacagactttcaaaacagtaatcctctttattcgtactcgggcccccaccctcagcggtacaagtacaatcctgtccaggattcctttgctttgaccctgcttggttttctttatctgcagcttgactaacccagagaggattaccagaataattaattggcaaacgaatttattttcttaggaaccactcagttgagtattagacaaataagacaaatgtgagaagaaagtctaataatgaaataattctgtgctcatcaataatcaatatatattattccattgaattacatttagacatttagacttaaaagttttacatgggctttgatttcaaagaatattcactcaacttgcaaagagtgatggttgttatataaatcatgttctgcaacaattgatgtgcatagcaaaaatagattcttaaaatatgttttatgaaaatgatattgaaggtgatgaagtgatgatcttaataatttaaagtgttcctccacatgaaaatattaatttatttaatttgataagtatttcttgatgattgttaaaaggtgacatctgccttaggtattaggtattatgtgatgattaatagtgaacaaaaagcaaaatatggtctttcatgaattgataggttttttaaaaggaaaatatattaaaaataaaaataataattgcacatcatgatgttacatgatgaaggatacactttagttatcaaattcaaagttaagtttggttttatagtcctcatatagacactataatatttacaaagcaaaccagttttcagtttcatatcatattatgatcttagtaccaagtaaaggtcaattaagcagcatttgtatccaaatacctaaaggaattgaatagctttaagtcagctgctacagaacacattgagatataaagtgcatgaaagaagttatgagccaagtatgaagaaaatcccatataagattcaaacaatggtaatacaataggtaatgtgatctgatctccacagacaactttaaaagatttttaatatatatttcctattaatttatcttctttatcaatgacaattgttgggatgggaagaaattgcttcattctatttatttactatatttttctgagtaaagattaatatactgtattagagacacaaatgacaaaattggaagactttaagaagcagcctatttaagcagttccaccaaaatatagatttattgtaagttgataactgaatcccccttaaaagtataatgaccattttcactggaatttaaatatatacttattattttaattcaatattataatttctgtgagcataatcaaagttctttttagtgtcctggtttgcttcttggctgttgtgataaaatgctaaccaaaaaaaaaaaaaaaaaaaaaaaaaaaaaccaacttgtgggaagacaggttggtgtggctcaattgttagagtctttaatggaaggatactaaagtagtaactaagtgcaggaatctggatgtaggaactgagacagagatcacagagaaacaatacttattggcttgctcagcaggtattctcagtgttgcacatcctagcaaatagatagtactctatgcagtgggctgggctctcctatgccaatagaacaccctcatataggcagggggagggggttgggataggggggttccggaggggaaacctggaaggggataacatttgaaatgtaaataaaaaaaactaaccagtacccccccagagctgtgtctctagttgtatatgtagcagaggatggcctagtgggccatcagtgggaggagaggcccttggtagtatgaagatcatatgccccagtacacgggaatgccagagccaggaagtaagaatgggtgggttggggagcagggtggggagagggtatagggggctttggtgatagcatttgaaatgtaaatgaagaaaaatctaataaaaagaagaaaaaccaaataaaagaaaaaaaaataaagaaatcaagtaaataccctggaaacattcccacaggccaatcttatgaaagcaattctttctttttttttaaagtatagaatagtttaattagttcatggggaagggagttaagagggtagttgaggcagagaaaggcagagagagggagagagtagagaagtagacactaggcatggccatgagcacataaagagagggtgtgaagggaatgggaagagaaggggagcaagagggcaagagggcaagaggtaagagagaaagacaagagcatgaaagcaattctttaatttagattccttttcccagatgtgtgtaagtctgtgcaccattgacagaatctaattatgatctatggaatctgtcttcatctgaacagcctgcattaagtacacttctgtaaatgacagtggcaacttcaagggtcaaaggggtgtcttcctttattacataaagatcatagattttttctttaatagataatcaatctagtacttttaaatgaataccccatcaataatatacatatactggaatttccagctaccctaaacttcatatgagaaaattgtcttatatttgggtatatcatacttcagaactttaaaatattttttatacaactcaaactcaaatttctactaatactagagggataacataaattcttcaggaagtcatagtagtagatcatgggttattgtagggaacaacataatgctgcttattgtttgtttatttatcattgactgatttaaaaaattccttgttaaaacataaccttaaaattcaaatcttatataattcagctctttataatatagtcaaaatatatttcccaaactgggtttgccaccttactgacagtacagaattagcaagagaatctggtctcttctactttttacttactcatgtaatgtttgttcactatattatatgacctgaagataaaatacatttcatagttttgagcagaaaaattttaaatacaacaaatttagaattagcagtcattatgaattagattagcagatttctaatactgacttattctttgacctaggccaaataatctcagagactaatttctccatgacatatatggtgatggtactgaggtagttcatacactaaagctaccctacttatccaaacatattgtataggaagaattacattaattacagggatgaaaggaatggtttctttttgtctttcatttcactacacaccaaaagttttactaaactttagaagcccaaagtagttaatcccgaaaagttaattttacctttaaaatattattaggtacttttcactgtttgaagtattcgaacggaatagcttccttaattacacctctgaggttggactcaaatttatattagtatcttcagtttatcctcaaaatgattaagatactttagctaagtgaaattgagtttttaaagtatatgtttttgttgattatctgagacttccataagacatatttttcattgtattcatcactctttccattggttctcagatccattctacttctctattcttcaacctcatatactcttttttgaaagtaatccgtagaatccattttgtccactagagcatggtaaacctaccagggaccacacccttataaaataaaactggctccccttccaactatcaactgtccagagctcttagttatggatgggaagtaaagaactagttcttccatactagaatagtgcctgtcttgatcatgggtatgtcgataagcacagatgttgtgagttcagaagggcagtattgctattacaatcagaagatactgatttgtttcagtaccctctgacttctggctcttccaatttttcactccttcttcttacaatttttcactccttcttccttagtctttgcagtttaatcagttgtgaatttctgcattaactactacccactgcacaaagaaccttctctgacaagttgtgagaggtatggatacaaagattaaaaatttacagggatgtttgctactgtgtcattatagcagaatagtagttggtttactattgggacttttgaactccccaaacatgggttcttttccagacttacagtatcaggaaagtgatttttctatggtctaagtattaggtttcaagaaggagaatttctatctttgagagttctatgaaactcaatccagttaaatttggatatttcacagcaatcagtggctttaattttgttgagctttgcattcacagccccaaagctggaataataaatgcatgaaaatttattaatcagtaaggtacaatgtaaaatggtctcaattgcaatgaaaatgtgctgttcattattattatattttttcctgattgatatgctaaaattgcatatacactgttgtaatgaagtgcagcaatggtgatggttagagatgatccattactattattaccaccaaatgttagggacctctgtgattaaaaaaaaaacttagttttgtacacaaaagaaagacaggtcattgattaaatagagaaaagccctagaatctagtgatagattgcctattggtttaaggaagtgtacagtaacagttatttgatacttagtgtattctatttacgagaacatcttttcaaaaagtgaagtgacagaatagaaagatagatgcaaagagcttattttattcctttgtcttcaccctagtaaccctagatatatgtttgcatttgttatttatttatacaccctttcacagatctttgaaataaggaagcagtggctagaaaacaaaaacaaaaacaaaacaaacaaacaaacaaaaacaccctgaaatgtattaagtaagaaggtcattagaaaaaaaaagtggcaatgaagtggcttctctttcattttagttttgagatgtatttttattatgtttctcctttccattttttccctccaaactctcccatgttccctttctctgtatccttcaaattcatgggccctctttcctccaatttttatcacatttgaattgtataataatatataccctccaatataacctggtgaatccatctaatgttactttatgtatcttttcaaggctgtttggtatgattgtgtgtgtatgtatgcacatgtgtgcgcatgaatgttacccttgtgaggataatataaaaaagttcagtcttactccagaaataattatatagataattatataattaacggctccatgtttagaaaataagtaaaatgtttcatcttctggttggtcatataaaataagaaaaatcataagtctcccccacccccagaaaagtggtggaatgaatacccaatgggataggaaagaaagtttttagagaacgggaaaagatatcacattgctgaatctttttttttttttttgaattgttatgacccaaggccattttctttagcagaaacctgtaacttgacttcctttccttcaaataatagaggagagccctaaaccatgtgacatgttcacattatacacagtgggaattagaccagaaacaaaacaaaatttccaaatatttaaagcacgatctagaagaaattcaggctttcctatcttccttgtggtcttcccttcttgtgttttattgtgtgtaaactatctaaaatttctgcacaatttaagagatattttgtgaaaataataaagccttgaataattggaatctgactaactaaaattctcaattaaccagttttatttatttattttttgctacactctccttttagaaggaagaggcaaatgacaaggaaacaagctgttaacaggtatttatgtatttattttttaaaaatcaactccctgggaatgtcttggagcctttacagattcagcccaatttccataatcttgttctctatattatacttgtgaagacaggaaagggaagccattaaaaatctcagcatcaagcctgtaattttgcttactgataaaaaaaagtgaaatccggatggttaattagaaccgatctatccatatgacgtttcttgtcaattggggtttccatgatttcactatttcctattagtgatcatttatatttatgaattgggattggatcataagattgcacagaatagtgatagagtacaaagtaacaaatgcccttcatgtgactgaaagtagaagttagagaaaagtcaaaagtggatggagattgaatgagagtcagtgccataaaatgtatgtgtaacatttgtgtaaaataataggatggtaattgaagtgcctacctacattttgactgtggaattcttaggaaggtacactcacttttgcagggcaacacaggttaataagtgtgctatagcaatattagaagataacctcagctattctatcaggcatgggaatatgtttgtatgattaacagttcttaagtgcttgaaattccttcctgtctgataagaaatttaaaaaaacatttaattgacaagatatatctgaaatttcctaaaacaggtatgacagtttcatttaagttgaaatgatctgtagcatgttggagtctcccatgttttagggtttattgtaggaaagagtaacaatgacaaagcacgttttgatattgcctggtagtattgtctcttctttacttccatgtgcactgtttaagtgaaatttattttttgatgaggtttccctccttccttgtgggccccatgttttctatatgtgttttataagaaaaagcatcctaggacattgagggagatatagaagacactgtgtaatgtgccctatattttcaatacagaaaatgaaaattgctttgattgtttttctaatatctggaaaattttctgtactaaaaattagttttcaatgccatacatataaaataatatccacatgacctgaagcagtgtgtgtacctccttaagcgttaaactttgtttttgactatgacatccatgtagaaaagactagtaccaaatagactttaaaaatgaataatttcgggaaaggggatgagatagaggatttcagagggggaaccaggaaaggggaaatatttgacatgtaaataaagaaaatatccaaaacaaacaaacaaacaaacaaacaaacaaaaaatgcccagaagtactgcatgtattttgtaggtgatgtttattctaagaaattttccttttgtcttcctataaagacacatttacctcctacggtatttaaaggtaaatgtctatgggaaatgtaagagtaacacatttctggttattagcacagagagtagcacgcaggcatgtgcattgtactgtgatttgagtagtgtctatgttaaagtacttttctttcagctataataaattgaactgtgtaatgtgaaaaaatttctgtgaaaacacataaaagtaatgacatacaaaaatgaataattttaactgaaaaaaatggattaagtttttcatttgggtttgtttcttgaaggttctgactttaaattactgggagagaacttaggtatgaaaatcactttcatctttcagtttctagtaacttggcatgcaaatcattccaaaaattttaattaaattaatgatggtttataactatatcaacttatttatggataacaaagtatcccattttggatgtttgtgataaaattttacgtttactgaaatctgagaaatatcttgaattgatttttgaaagtgtatgtgttgattcagccatataaactatagagaaactaagaggatcaaaactaaaatgcttatggaaatgaggatgggaatataaatgaaagagcataagcaatatggaatagtaaggagtagagtgacctagaaagtatagttttactaatggtagtggatactatttatgccggcagattgataccgtataaggctacatataggagtttatttttaaggttcttaagagaggctgggtgtctataatttcatgtaacactttccaactattaaaaggtgcttacaaattcaatgtaaaaggtgaaaaattaggatgtttttgctagctgttctctaattttaaatcctcaattacttcacttaccaaagaaatcatagttttacactatgtcctagtagtgatgatagaaaattgatgtaaataaatggagtgcttgtcatattttcaacatagtaactatgtacttcatgatattttcactttgtaaatgtggtcaatagagttattcttcaaataacttgacaattaaaataaaattataattttctcactttcatgttaattaatcaagtgcacttttggttcagccctaccatttccaaaagagaatatttaagcagtgttctgtcacctaatataatcgagatttcatttggaagcccatttgttttttctttaatgagacaaaagacatgtgtataacatatgctgttttattgaaaattggcttgcctttaaataaattcccaatcccaactagtaaagtagttttgtttttacaaatagttgaaaaaagaaatataagacatctaagtagttaacacaacataactcttgcttggcattgaaagagaaaaaacaaaagtcagtcctcggagattttatttgatgttaactgactactgtgagggtttgcttgtttgtctgtcctgccctagacctaagcacatgaccccactgtgtgctagtgttttgacatcatacatttctttcatcactggtcatccaaactcatatttgttttaaaaagaaacaatcaaatctcattcttttgaggaaaaaaaaaacagtaagaaaaatatcgaagtatgcctactttgccaacccttatgatcggcaccataaatccccaatcaagatattactagtatcatttctcagcgtactttacaaagtagaaagaggaagaataagaatgtgcaattttaagtcattagtacatgagataacatcattttgatgatagaaatgaagacttaatatagtcactatggaagataaacaatttttaaatgtataagattaacatataggataatatagaaacaatgcttatttatctttctatcaaacattgaactattggactacatgtaagatgttgtgtgataggattcaatgcatttaaatatattaattggtcaaataaaattgtcaactaatattttatcagatttgacataaacaagataattcaaagcaaaattttgaagagtaatggactcttttgtcataaaaaatacataacaagtatccaatgatctaatgtgattttctctgtgttagttcatcttaccagactgggaagtaggtgatattaaaatctttattttacagtgatgatgctgaggccaggagaagaatatataacttgtctgaaaacataccaccaatatttttcagggccagtatgtaaatggtgttaatttttaaagtaaatgtgcttttgatctatattttgtaacctgtgacttttgaaattagtctaattataacattatatctatatgtatatctatatgactatacatataagctcatatttattacccacagaaaatagtatctctatctagaaatcaggttttgtgatatcactttaattgtgtaaaattaagaagaataattaaaataaagttcaaatggagcaggaaaaatgagaaatactaattaagaccccatattttggaaaaaccccatttgtcaagcattaatgctataagtatcaagaatctcctttctatattgcatcagattcaaagttgtcctaaagtttatatgcgtcattgcttttcatttaaaactattattgtatttatgcatatacaatattctgtggatagtgggagagatattaaataatatctcagtgttataaaggacaagacagtggtacaacaccattttgagactatgttcaggttttaccactctaaacattatattgcaatgcttgaatagagtgaattgccaaccattattctttatgactgtgtctgctttcttgcatgtttatatttggaaaagaaattactcaaatatttttttattctgcaagttattttaagagaattcaggttgactgctcagtaatttaattcactgcttctttttagataaggtagtaattggattttgcgttctggaaagacttgattaggatgatcgggatctttaccttaagaattagtgcagaactatcaaggtttcctatattcagtgtcctagaaaaatccatttgaaagtgtctaatatggtaagaggccaaactagaaaagagaaatagttaaaattgattttatttaatttaccagagttgcaaatgcatcaaatgtccacaaccagtagctattctcccagaaatatatcctcttgtagaacaaagggcctattattttaaaagacctcattgtctaaatgtcacaagaatcccagagaatccttttgagagtttttactcattttggcttgattgtgacctaattgaatggctcggatttaagaacattcatcctgttttcagttaaaatcaatcctaacaaccgttactattatttttttttaatttaccatttgcactagtttagtaaagagaacttataccagatgaatctagactatttttgctcagctcttttttatactatatggtagtttaaacaaagtatccaacttttaaattaagcagtggaccaatcactagaaacattgcatgtcaaaatttgaggttagagtcacatagatcagaaaatattcaatatttcattcattaaacagacagttcattaacagggagaaaagacaattaaaactatatatgttctttcatttaaaaatattgtagttgctcttatttgttataaaaaccgaaaaccagaaagtgtaaactgtgttgtgttgtatttatcaagcacatttccaaaaacaatacaatatatttgagatattgtttccttatttacaaaaccaattgcaatcattccatggcattcatatttgtaaatcaaaaaaactttgacaagcaacatttattctcttctttaccacaaaacttctataccgtgtacacttccatttgtaacagtagcttcaaatatatttatgttctttgctatagacagtatttatacagtaacacattaatattagtacagaaaatgctggatttcttttcttttattaaaaattcagtctgaaccttaaacaagtcatttacaagttgtttccttgagattacctacattcttgtccatctgaccttgtaattttgctcacagttggaaatgtaatgcagagtgactaagataatgttgtttacacagactttaagtggagtgacattatagtcaagcaagtgtcacatcacccaaagtgaaggaagacttaattaccataatcctgtgaatactaaaatttctttgccatgtgtagcataataatgtaatgttctgcgtggtatatttaataatgcgaagggaaaaggcacattaggccacagactgtgattctttaaaagtgaacagagtagaattattgaaagacagtagaattttaaagtaggatgcttgtcctaatattcaggtgaagtttttctttctttcaaaccctgaagagttgcctagtgatacgaaaatgaaaggagtgctaaaatatccataaatctagacaccagtgagtagggtaaatttcctggagggtgcagggtagtgttaactaaatgactaagacaggataaagaggaaaggctgataacaacctattattgtgcaatggggaatataatcattaatttacaaagagagtggtgacattttctaagattgtatagccccattcttaaaagtttgtcagtgtaactaattagttgctaaaatggagttgattctaagactcagcatgaatgcatttagaaaggcaaggcattgtccataaattggtatggtgtgtaatacatcttgatgaatggtgcaaaatagtgttaagaaatgggactattatgccaaaatggccgttcattggtttgtagtacttgaaggaattatgttccatggcaacgtgctctaaattcctacagataaacatgaagtaccccaaagacatgtcctgttttctgtctttgataacactcagttttcaatacaatgaattcattctctgtaatctttttcactgaattataactataaaacataccattactatagattattacttggatttaattgttcttaactaatttattgttttcagtaaggaaagtataaaaccaatcagcagtaaaatgtaaaagtaagatttaaaggtcttagaaagttgatatattgcaaatgtatttctcaatcaatagattcatgctactggtgggttattaacaatttaccaatcatcatactagatcagctaatatgcactgtgttccagcatttgtaaaaaatacatgtaaaaccatatatgcaaatatcatacagaatcacacaaatatcagccttgttttataactgggagaatgtgaaatgtccatgaaagttattataaaatatgacaatatgttatataaaaacatatagttactgttagattttcatctagatattttcaatttatttaggattcccttcacttaggtttagcgaaacagcatgttactattgggaaacagtggaccaacagatctgaatttcatgatgctttaagaacaaatttattttaaattacaatatttattttgttaataaattttacaagttcccactcagtttgcatattgatttaattaacatgatatttaaaaattaataaacagcacaataacatttttaacatggatacctactgataaagcatacagtattagcaaaatgtcattatagcagatgctcgcttaaactgatcctagtaaactacattattatttattcatgagtcattatagattcgttgtttttttcctctttagaaaggattctagaagttaaatgaaattgaaaaatagggaattcatataaaaacaaataagtacatgtttctctaatgtagtttttttaagtccataattcgttttacaaatttttccgttagtatcaaataattaaaaaaaatacaggaacctaatactcgttgaacattttaaatgtatggtatttttattcaccacttttagaactgtttatttaaatcttcctcaattttttatttacattccaaatgtttccccccttcctggttctccctccctgagttcttcaccccatctcccctcctcaccacaccactgaaagggtgatcccttctttacctgttcaaccctccccccaccaccatcaatgaactttttttttttttagggtttgcccaactaccaccagaggttgcctgtttccattctttatgttggtcctcatggcttcagtcctgtttccccctaatacctgatcaggttcctttttcccttccctgtcctctctcccacccatgtccctccctccctcccccttcctgtgatttctttcttctcctctgaagtaggattgaggcatccttacgtgggcctgcccttctgcttgttaatcttcttgagttctgaggattgtatcctgggtattctgtactttttgtctaatacccatttatgagtgataacataccttcatgtcctcttgggtctgagttatctcactcaggatgatattttctatttctgtccatttgcctgcaaaactcatgatgtccttgttctttttttcttttttaactgtaatttttgtgggatattttctttgtttacatgtcaaatgttatcaatttcctggtcatccccgaaaccttctatcccgtctcccctccccctgcttctatgagagtgttcccccacacacccattcactccttccgccctaccctggcgttccactacactgggacatccagtcttcacaggaccaagggcctttctgcccattgatgcccaacaaggccatcctctgctacatatgcagggggagccatgggtactctttgattggaggtttagtccctaggagctctgggggatctggttgtttgatattgttgtttttcctactggttgaaaatcccttcagctccttcagtctctaactcctccattgggtaccctgtgctcagtccaatggttagttgcaagcacctgcctctgtatatgtcaggctctggcaaagcctttcaggagacagctatatcagctcctgtcagcaagcacttcttgatatccacaatagtgtctgtgtttggtgactgtatatgagataaatccccaggtggggcagtctctggatggcctttccttcagtctctgctccatactttgtaactctattaaaaatggggtacagagctaaatagagaattctcaacagaggaatctcgaatggtcgagaagcacctaaagaaatgttcaatatccttagtcatcagggaaatgcaaatcaaaacaatcctgagattccacctcacaccagccagaatggcaaagatcaaaaactcaggtgacagcagatgttggtgaagatgtggagaaagaggaatactcttccgttgttggtgggattaccagttggtacaaccactctggaaatcagcctgatggttcctcagaaaaattcaacatagtactacctgaggacctacttagaccactcctgggcatatacctaaaagattctccactatgttcacagcagatctatctagatttataatatccagaagctggaaagaacccagatgtccttcagcagaggattagttacagaaaacgtggtacatttacacaacagagaactactcagctgctaaaaacaacgacttcatgaaattcttagacaaatggatggaaattgaaaatatcatcctgagtcatgtaacctagtcacaaaagaacatacatggtatgcactcactgataagtgatattagcgcaaaagctcagaatacccaagatacaattcatagacctcatgaagatctagaagagggagttaccaatgtgcagatgctttggttcttcttatatggggaaacaaaatactcatgggaggaaatgtggagataaactgtggagcagcgatgttctcattcttaatggatgaatagtattccattgtgtaaatgaaccacattttctatatccattctttttttgttttctttttcttttttttgttgttgttttgttttgttttgttttttggtttttcgaggcagggtttctctgtatagccctggctgtcctggaactcactttgtagaccaggctggcctcgaactcagaaacccacttgcctctgcctcccaagtgctgggattaaaggagtgcgccaccaccacccggcctatatccattctttgtttgggggacagctgtgttgtttccagtttctggctataacaaataaggctactattaacatggtgaagcacatgctcttgtggtgtggtggggcatcttttgggtatattcccaggagcagtatagctgggtctttaggtagatctatttccaacattccgaggaacctccagattgctttctggagtggttgtaccagtttgccatcccaacaacagtagaagagtgtttctcttcctccacatcctcaccaacatgtgcttctcagccactggagattcctctgttatgaattctctgtttagttctatatcatttattgattaggttgtttgggttttttggaggttagcttcttgagttctttatatattttggatattggccctctattggatgtggggttagtgaagttttttttttcttcctagtctgtaggttgccaatttgtcttattgtctatatcctttgccttacagaagcttttcagtttcataaggtctcatttatcaattcttgatcttaaagactgagccattagagttctgtttaggaaatttccctctgttacaatgagtttgaggctctttcccactttctcctcctcctcctcctcctcttcctcctcctccttcttcttcttcttcttcttcttcttcttctttttggtttttcgacacagggtttctctgtgtagccttgtctgtcctagaactcactctgtagaccaggctagcctcgaactcagaaatccacctgcttctgcctcccaagtgctgggattaaaggcatgcaccaccactgcccggcccactttctcttctgttagattcagtgtatctggttttatattgaggtctttgatgcagtttttatcactatttttaatcaatgaacattttttataaatacttttatagtgttaatagtcataaatttgtagttagaaatcatgtgctcaatcctttagtttcccattaactagtcttatgatcacagataggacacttgacacctacaagtctctactccatagaagagacctaatattaattcttggagggagagtgttgtaacaagacaaaccagcaaatgcaaaagtttgtaaaaactctgtgaaaatgttcagtgattattttagaactgccttgaatgtggtaatgatgttttgactttcttttttttttttttaaagatttatttatttattatatgtaagtacactgtagctgtcttcagacactccagaagagggagtcagatcttgttatggatggttgtgagccaccatgtggttgctgggatttgaactctggaccttcggaagagcagtcgggtgctcttacccactgagccatctcaccagcccatgttttgactttcttagtgtatttctagaatttagtgtatttcatggtgttagtattcaataatcaataaatactgacaaattgaatatattatcacattcttttcttttctccccaagtaaagtatcatatggtagcttatgataacttataacatatttttgaaataatatatcaaaagataggaagaatcatgtagccaaactggctgttatgtatatgcaaaaggtacctactttttttttttttaattttagcttttgttttgctgggatgtgcttctattcaatggctgactgccttctgattagatttcaatttctttaagctgaccagattttcctttgaaataagggtactggagctttcacctcatcactgtggtgatgtgaaatccctgctgcagagtcactgagctagtgctagaagaagaggagcacctgtgagcacaggctgtcagaaggccctcagagtcttggtttcttgagggtacagctgctacactgagaagtggttggatgcactttgccattccttctgcaaccacagcagactgcctaaaggatctctactttttttttatgtataatgtgcattgattaacaatagttaagagaagggtccattttagactactgaagactaactggctctgcgaggaaagtgatatggcagactctgttaagtaaaaatattttgatgagaagagtagtgtgacctcacagcttccattttgtctaaatctccattcaattatgtgttcagtaagggttgccagaagaaagtgggactaggttgaagcttttcttttccaaaaatcaattggagttattatattaaaatttgacatgtttccagatttcctagaaatgctaggagaacatctgaaatctacgaggtccccatccagcttcggatattggaaaatcatttaagccaactctaggctttagggtttgtgagacagtgggaaagatcagtttcagggtcttttttttttcctttgggttttttgagacagggtttctctggctgtcttgaaactcactctgtagaccaggctggcctcaaattcagaaatctgcctgcctctgagtgctgggattagaggtgtgcaccaccacgcctgtcaggttcttttttaaacatgtaataataatgatgcataatttggtctgtctgataattcatgaactctaaaattgagaaagaatgtttgagttaaacaaaactttctgtggattaatgttgtcctggtcatttctaaaaggagttaatcaaaaattttctgatggcagttcaatcacatttatagtattgcttttatttacactatggaatagtagggaattcttttacccgttttttgttctgttcaaaagaaagtgtagaatttaataattggaaaatatatgtagcggatgggaaagagaagagggtttaatattagattatgtgtactatgactgaatacttgtaacgattactatttttctcccagaaaccactactttctctcaaaacatggagtgtccatttagaattatcaatttgagattttattgtattagctatttcagcttttgttcaaatatacagggtgttatttaattgaataagaagactctcatgtattttgaggagaatgaagctaatttgttatgtagaatctaatcataatttttaaaaaatgagcaattacagtgagctttaaaacagatctttcaactttattctgtaagttacatttaagacacttttcttgtataaacatactgagtttaccaatctttaaccaataaattccagcacggcaaaataattagtgaaattaagttgaaaatgtaaacaaataaagttattactcattctgtaccaaactacaaatgtgggagaatattttaagtgataaattaagcatgaactgcttgaatctgtaagctgaacatgttagcaaatggcttgtgtttgtaattagtatttatggccacaggagagtgcctctattaaaaagagtgacaggaaattgatcagtttaggttgccatagaaaccaaaaaagttccattgcttgtgttgagcttaatctatcaggttatatatctacgcttagaaatatttttattaactgaaaaaataaactattcaataatgcaaaagaggttaggctactgaaatgattaacaaagtccagatgaacactcgactacttaataacaagcttaagtgttctatggttgtcatgacatttcttctacaaagaaaatgatgtcttccaaaaaaaaatcttaaaactcgatgaaaatgcaaatctctttatgacagtatgtggttgtcacaattataatgagagacaataattgatgatttatgagataataccatggcaacaaagtctttcatcattggcacccctcggtcactctttttaaatagatgcttgtgagtgcctctgaaaagttttcaccatgaaatacaagaagatctagtcagatatgaatcttttagatctaatttacaacgcagaggaggtgttgacaatctgagaatcaacaacataaaagctgacagtgccttattaagaaaaactccaataaattagtaaacatgtttagtagctgaaaatggacagacttgactttgttacttaacctttcaagcaagtctttactgcgtcacctaaatttggagagcaagctgttagtctttcaaagttatgttgtctggtaataaccttttataatagatgagaggagaggattcttgctttgaattcatatgaaataactttttaaaacttgactttaatatttttattaatctgaaataaatgtgttactggatattttataatggctttagtattttggtagatcaagaaataaatttttggcttatttagaggtgattatgcatcagtattaatctgtaatattctgttccagattactagtcatattggaaagctgtgaactttccatattaattttaatgatagttcatgaaaatgagatctttaacattttttatatttaggaagatccttgaattatttaactacttgtgtaattgaaagaaaatattagctaacgtttttaagtcctttccagtgaaatatgacaaagattaataaagagttgtagaattagcaacaattggagataatctaatacaccaaaggtatcagatttaaagccaagaatataatgggatcctaatataaaactaaatataggcttctgtatgtaacattcataaatatgtagaacattttcagtccttattgcttttatgtgtcaagagttttacaggataaaattctgtaatacacatatccttcggaaatttatagaagccaataatacaaaataggatttttggttattgtttttatttatatatttgttgcaaaagttgtgcaaccctactcagcttgaggtgacatgactctgagaggtttgtgatttttttttccccaactaaaatgtaagaaaatggagtctgtccatgaacgtaatgacttatcccagctaatatgaaaatataaattaattgtgattctgaatattttccttgattgttgagaaacctcattaaaatatgattatcttgaagggaaacatattatttattatttatttaaaaggagagtataatcttcagcatatatatatatatatgtgtgtgtgtgtgtgtgtgtgtgtgtgtgtgtgtctgtgtgtgtgtgtgtgtgtgtgtgtgtctgtgtgtgtgtgtgtctgtgtgtaatgtatgtatacattattcccaatgttctttccttctatttatttctttctttctttctttctttctttctttctttctttctttctttctttctttctttctttttctttctctctctttctttctttcccttccttccttcctttctttcctctttctttctttctttctttctttctttctttctttctttctttctttctttcttcgtctacattccaattgaaaccccctcaatcctctccccacagccccacccccataccccttctcccattccccaatacccttctcagagaagagtacctctgagtacaaaccagtaccagcacattgtctcatcaggagttcatccactccaactgagtcacagcaaagcagtccagctaggggaacaaaatccaaggcagacaacagagtccaagtcagggacagtcccctctccagtggttggagaacccatattaacctataatgctaaggtgcatctgctacatatgtgtagggatcctgggtccattccatacatgcacttttgttagtggttcagtttccctgaatctccatgtgcccaggtcagttgactctgtagatgtccttgttgtttccttgactccttgggcttcctcaatccttccgctggctcttccacaagattcccttagttctgcctaatgtttggctatgggtctctgcatctgtttttatcagctgctgaatgaagcctctaagactccatttgtgctaggttcctgcctgtaagcatagcagagttaccattaattgtgtcaggggttcatactctccaatggggtgggtctcaagttgggcttgtaataggtggtcatttcctcaacatctgctacatcttcctgcatattttgtaggcagggcaaatttggggctaaagtttttatgggtgggtaattgtcctcctctctccactggaaattctgactggctacagaagatggtcatttcaggccccatatccctggctgataggaatctcagctagggttaccccccatatcctctaagggacctcctccataccaagtctctgaattgttccagagattcccccaaccaattttctttctctctttcaattatctcacccttcacccctgctctctccatacctgatccccactctagtctcttgaggggtaggtacatcatctctgaatgaacacagacccggaagtcctctgctgtatacgtgttgggggactcatatcagctggtgtatgctgtctgtttggtggtccagtgtttgagagatcttgggggtccaggttaattaagactgctagtcctcctactgggttgccatcctcctcagctcctttcagccttccctaattcaacaacaggggttagctgcttctgtccattggttgggtgcaaatatctgcacctgactcttccagctgcttattgggtcttctctagtatgatcatgctaggtccatttttgtgagttctccatagcctcagtaatagtgtcaggccttgggagctccctttgagctggatcccactttggacctgttgctgcaccttcttctcctcaggctcctctccatatccatccctgtaatttttttcagaaggaacaatcatgcatcatagttgtcactgtgcgattgcaaccccatccctcacttgatatcctgtcttcttgctggaggtgggctctatagcttccctctccctactgtctagcatttcatctaaggttcgtccttttgaatcctgagagtcactcatatcccaggtctctagtgcattctggagggtccccacaacctcctatctctcgaggttgcctctttccattatttctgctggccttcagggcttcagtccatttccctcacccaataccagatcaggttcccttctcaccagccacctactgtccactttccctctcaagacactcactccctcctcacttatgatcagtttcttctccctcccaagtgggactgaggagtcctcacttgggcccttcagcttgttgacctttttgagttctgtggactgtatcttgggtattctgtactttttttttttttttttttttttttttttttttttttttttttttttttgctaacatctccttttgggtctgagttacctcacttaagatgatattttctagatccatccatttgcctgcaaaactcaggatgtcctcattcttaattgctgagcagtattccatcatgtaaatgaaccacattttctgtatccattcttataataggggacatctaggttgtttccagcttctggctatcacaaataaggccactatgaacatagtagaacacttgcccctgtggcatggtggggcattttttgggtatgtatattctcaagagtgctatagctgggtcttcaagtagatctattttcaactttctgaggaacctccaggttgacttccagagtaccagtttgcaatcccaccagcaatggatgagtgttccttatagagcatacaaagtatttatgagtacttggttaacaatgtgtatatagccatcaaaaatatatcaacttaaagccaatactgtttattataaattagattgatattgactttagaagtaaagacattattttggatcatggacagatatttagcttttgttgattgttgaattgaaatcaattccttgtgatggaaagagcttccaaattaaaatagtacagatacagtgataagctgcaacatatggatttttttgcatttgtgagatacttacatgtgtgggtaatatgtgtgcatatatgagtgctcacgattgtggagacttgaagttggcgttggatgccttcctaggttattctcatccaaatatattgaaatagggtctctcactctgtcaagatctccctgctttgtctatctttctagtctgttccagggatgcccttctctcattctttcaagtactgggattgtaggttgggtgtgccataccatttgacatttattcaggttctagggatcttaaatctgtttatcgaatcatgctctcatgctgttgtcaaaatattataggtaagttgaggcattttttttttcaggaacttgtgggccaaatgttttgcgatcccaaaaattacaggcaaaagcattacataaaacattaactctcaaatatcaacaattattttgtcagattagaacatttcttcagagcaatttggactaatttgttagttcatttattattttctattaatcaatttattcatttacgtttgaaatgatattcccccttacaggttacccctcctcaaacctcccctcctctccccttccctcctcctcccctttacctctatgagggtgctcctccacccactcacctactcccatctcactgctctaggatccccttaccctgggtcatcaagcctcccacccctcccattgatattagataaggccatcctctgctacatatatatttggagccatcgaaccctccatatatactctttcgctggtggtttagtctctgggctctctgggtagtccagttagctgatatttttccttctatggggttgcaatacccttcaactccttcagtccttcccctagctcttccattggggccactggactcagtcagatggttggctgtatctctgtctgtattggtcagatgcaggtagaacctctcagagaacagccatactagactcttgtcagcaagtgtttcttggcatcagcaatggtgtcaagtttggtgtttgcagatgggatggatctctaggtggtgcatctctggatcgcctttccttcaatctctgctccagtttttgttctgcatttcctttagatagaaacaattcttgagatgggtgggtggcatatcattcaactgggggccttgcctattgactggatatgttctctacaggttctatctccccttgttaggtattttggctaatgtcatccctgttgggtcctgggaatctcttgcttcacaggcatctgggactttctagtggctaccatctgttccccatccccgactgcaacatattttatccaatttcctaaccttctgtacttctctcctgtctctttccatatttgatcctgtacccttttttccttccccctcccttctacctcccaggtccctcccttcctctacctcctgtgattattttgttccaccttctatgtaggactaaaacatccacactttgggctttcttcttcttaaggttcatatgttttgtgggttgtattgtttaataatagttatatacttattctaaattctgttctacaatacattttgttgttctcaaaccatcagtttctaaagatatcgcagttaaaaggggagtgaagtgattttcatacttttcttacagttgagaaagttttgtaacctactaatggcccatctgggaattcaatgcatatcatgtgacaggatgtatagtatttcattgcattgcacaactgagtgctatgtggccatagtacactaggtttaatagtaatatagttagtttgaagtgtatactaggaaatagtgatggactctaaactatacctattagaaactagaaatgttagtgttatggctctggtactgtagaaacaagagataggttttcttcctatcttaaagccaggggaaaaaagcctcaaacacaaatccttataattctcatggaaatattattgtggtataattgtttgctttgatacaaaggatagcaactatgtcctttagctaaaattaggggcggaacctgagactgcagtacatagggaagcagactacccaggccttacctgaggcacaagccccttctgctccactcgagtccaggctaccttgccagcggagtcgcctgacacccgcaagggcccacataggattccccacgggatcctaagacctctggtgagtggaacacaacttctgccaggagtccggttcgaacaccagatatctgggtaccttccctgcaagaagagagctttcctgcagagaatactctgcccactgaaactaaggagagtgctaccctcccaggtctgcttatagaggctaacagagtcacctgaagaacaagctctaacagagataactataacagctagcttcagagattaccagatggcgaaaggcaaacgtaagaatcctactaacagaaatcaagaccactcaccatcatcagaactcagcactcccaccccacctagtcctgggcaccccaacacaaccgaaaatctagacacagatttaaaaacatttctcatgatgatgatagaggacatcaagaaggactttcataagtcacttaaagaattacaggagagcactgctaaagagttacaggctcttaaagaaaagcaggaaaacacagccaaacaggtagaagtccttaaagaaaaactggaaaacacatccaaacaggtaatggaaatgaacaaaaccatactagaactaaaaagggaagtagacacagtaaagaaaacctaaagcaaggcaacgctggagatagaaaccctaggaaagagatctggaaccatagatgtgagcataagcaacagaatacaagaaatggaagagagaatctcaggtgcagaagattccatagagaacatcgacacaacagtcaaagaaaatacaaaatgcaaaaggatcctaactcaaaacatccaggaaatccaggacacaatgagaagaccaaacctacggataataggaattgatgagaatgaagattttcaacttaaagggccagctaatatcttcaacaaaataatagaagaaaacttcccaaacataaagaaagagatgcccatgatcataaaagaagcctacagaactccaaatagactggaccagaaaagaaattcctcccgacacataataatcagaacaacaaatgcattaaataacaatagaatattaaaagcaggaagggagaaaggtcaagtaacatataaaggaaggcctatcagaattacaccagacttttcaccagagactatgaaagccagaagagcctggacagatgatatacagacactaagagaacacaaatgccagcccaggctaatatacctggccaaactctcaattaccatagatggagaaaccaaagtattccacgacaaatccaaattcacacaatatctttccacgaatccagcccttcaaaggataataacagaaaagaagcaatacaaggacggaaatcacgccctagaacaagcaagaaagtaatccctcaacaaaccaaaaagaagacagccacaagaacagaatgccaactctaacaacaaaaataaaaggaagcaacaattacttttccttaatatctcttaatatcaatggactctattccccaataaaaagacatagactaacagactggctacacaaacaggaccaaacattctgctgcttacaggaaacccatctcagggaaaaagacagacactacctcagagtgaaaggctggaaaacaattttccaagcaaatggtctgaagaaacaagctggagtagccattctaatatcagataaaatcgacttccaacccaaagttatcaaaaaagaaaaggaaggacacttcatactcatcaaaggtaaaatcctccaagaggaactctcaattctgaatatctatgctccaaatgcaagggcagccacattcattaaagacactttagtaaagctcaaagcacacattgcacctcacacaataatagtgggagacttcaacacaccactttcatcaatggacagatcgtggaaacagaaactaaacagggacacagtgaaactaacagaagttatgaaacaaatggacctgacagatatctacagaacattttatcctaaaacaaaaggatataccttcttctcagcacctcacgggaccttctccaaaattgaccatataattggtcacaaaacaggcctcaacagattcaaaaatattgaaattgtcccatgtatcctatcagaccaccgtggcctaagactgatcttcaataacaacataaataatagaaagccaacattcacgtggaaactgaacaacactcttctcaatgataccttggtcaaggaaggaataaagaaagaaattaaagactttttagagtttaatgaaaatgaagccgcaacgtacccaaacctttgggacacaatgaaagcatttctaagagggaaactcatagctctgagtgcctccaagaagaaactggagagagcacacattagcagcttgacaacacatctaaaagctctagaaaaaaaggaagcaaattcacccaagaggagtagacggcaggaaataatcaaactcaggggtgaaatcaaccaagtggaaacaagaagaactattcaaagaatgaaccaaacgaggagttggttctttgagaaaatcaacaagatagataaacccttagctatactcactaaagggcacagggacaaaatcctaagtaacaaaatcagaaatgaaaagggagacataacaacagatcctgaagaaatccaaaacaccatcagatccttctacaaaaggttatactcaacaaaactggaaaacctggacgaaatggacaaatttctggacagataccaggtaccaaagttgaatcaggatcaagttgaccatctaaacagtcccatatcacctaaagaaatagaagcagttattaatagtctcccagccaaaaaaagcccaggaccagatgggtttagtgcagagttctatcagaccttcaaagaagatctaattccagttctgcacaaactatttcacaaaatagaagtagaaggtactctacccaactcattttatgaagccactattactctgatacctaaaccacagaaagacccaacaaagatagagaacttcagaccaatttctcttatgaatatcaatgcaaaaatcctcaataaaattcttgctaaccgaatccaagaacacattaaagcaatcatccatcctgaccaagtaggttttattccaggaatgcagggatggtttaatatacgaaaatccatcaatgtaatccattatataaacaaactcaaagacaaaaaccacatgatcatctctttagatgcagaaaaagcatttgacaagattcaacacccattcatgataaaagttttggaaagatcaggaattcaaggcccatacctaaacatgataaaagcaatgtacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattctaccagagaactcctaaacctgataaacagcttcggtgaagtagctggatataaaataaactcaaacaagtcaatggcctttctctatacaaagaataaacaggctgagaaagaaattagggaaacaacacccttctcaatagtcacaaataacataaaatatcttggcctgactctaactaaggaggtgaaagatctgtatgataaaaacttcaaatctctgaagaatgaaattaaagaagatctcagaagatggaaagatctcccatgctcatggattggcaggatcaacattgtaaaaatggctatcttgccaaaagcaatctacagattcaatgcaatccccatcaaaattccaactcaattcttcaacaagattagaaggagcaatttgcaaattcatctggaataacaaaaaacctaggatagcaaaaactcttctcaaggataaaagaacctctggtggaatcaccatgcctgacctaaagctttactacagagcaattgtgataaaaacttcatggtactggtatagagacagacaagtagaccaatggaatagaattaaagacccagaaatgaacccacacacctatggtcacttgatctttgacaagggagctaaaaccatccagtggaagaaagacagcattttcaacaattggtgctgacacaactggttgttatcatgtagaagaatgcgaatcgatccatacttttctccttgtactaagatcaaatcttagtggattaaggaacttcacataaaaccagagacactgaaacttatagaggagaaagtggggaaaagcctggaagatatgggcacagggtaaaaattcctgaacagaacagcaatggcttgtgctgtaagatcaagaattgacaaatgggacctaatgaaactccagagtttctgcaaggcaaaagacaccgtcaataagacaaaaagaccaccaacagattgggaaaggatctttacctatcctaaatcagatagggaactaatatccaacatatataaagaactcaagaaggtggacttcagaaaatcaaataatcccattaaaaaatggggctcagaactgaacaaagaattctcacctgaggaatactgaatggcagagaagcacctgaaaaaatgttcaacatccttaatcatcagggaaatgcaaatcaaaacaaccctgagattccccctcacaccagtcagaatggctaagatcaaaaattcaggtgacagcagatgctggcgtggatgtggagaaagaggaacactcctccattgttggtgggattgcaggcttgtacaaccactctggaaatcagtctggaggttcctcagaaaattggacataatactaccggaggatccagcagtacctctcctgggcatatatccagaagatgccccaactggtaagaaggacacatgctccactatgttcatagcagccttatttataatagccagaagctggaaagaacccagatgcccctcaacagaggaatggatagagaaaatgtggtacatttacacaatggagtactactcagctattaaaaagaatgaatttatgaaattcctagccaaatggacggacctggagggcatcatcctgagtgaggtaacacattcacaaaggaactcacacaatatgtactcactgataagtggatattagccccaaacctaggatacccaagatataagatacaatttgctaaacacttgaaactcaagaagaatgaagactgaagtgtggacactatgcccctccttagatttgggaacaaaacacccatggaaggagttacagagacaaagtttggagctgagatgaaaggatggaccatgtagagactgccatatccagggatccaccccataatcagcatccaaacgctgacaccatttcatacactagcaagattttatcgaaaggacccagatgtagctgtctcttgtgagactatgccggggcctagcaaacacagaagtggatgctcacagtcagctaatggatggatcacagggctcccaatggaggagctagagaaagaacccaaggagctaaagggatctgcaaccctatatgtggaacaacattatgaactaaccagtaccctggagctcttgcctctagctgcatatgtatcaaaagatggcctagtcggccatcactggaaagagaggcccattggataagcaaactttatatgccccagtacaggggaatgccagggccaaaaagggggagtgggtgagtaggtgagtgggggtgggtgggtatgggggacttttggtatagcattggaaatgtaaatgatctaaatacctaataaaaaatggaaaaaataaaataaaattagggcatatactccaattggaaagtagttacaataacgacaaaatataaggtaatttttgtatgtaaaattaactttattgatttagcctgaatttttttatcaacataataatgtgatgtgaagatgaaatggtaaaacttgagaattaaggcttggattgaaatggcataggaaaaaatctaggagtactcctctttctagaattcatcttttctagacaatctgttcagttcttgtaccacctgtagtttcatgtaccatatatgttttgttttcctaactatcccatgaccttttagaccaataggaccaatagtgtcattaatttatttttatatataccaaatattgttctcatcattaggtgttcaaataataattgtaaaaagacttgtaaattagtgagtaagtagggataatataaaaataattttcaactactacacaaagtaatattaaatagaaatagataaaatatttctggttgctcagtagtttaactttgtcccttcagaattgcctagggacatggattaatttctgatactaataaagggactctaacatttggacagctatttattgactagagatgatttgccaagttcaccttgcaaatattaatatctgtcttatttgtatggcccttacacattccatgttatttttccaggttacatcaatttagtgtgtaggacaactgttgaagatactgctaagaatcatttattaattactaaacatttggaatagtgcatggatacagtggcaataaacaatgatatacaatagttaacaggaaatgttgggacagaagtaaaactggcagttttcagttgacctatagcctatttcaaaatgatagcttccatctgtccaaacaacaacaatgcctaacgaaagcaagtgaaactagcccttaagcaaacaggtgaaccatatgtaagacaaagcagcaccccaaaggcatttgtagtacacagtcattatttaacccttgacaaaataaacaatgctgacagaatgtgttgaacagctatgatgtatgaacagtgtcaattcagtaggctgataacctatagcttgacattcttatctattaatttctgacagagtcatcattttgtttttgttactttattaacttgctcctttgatagaaaaagataacatttctactttataatgtagaactacattactaagtgagagctttggggaaatactgatgaagatctggttttactaatgaatgatccttcacacttaggtttgtattctgtagatgtttctcagtatgagatgactttgtttgcatatcaacagcagacaataaactgtcatatcattaaattacttatgccaaataatcatgataacttccttttaaaaataatacttcgctagaaagtgtactatttttccaaattaaacattgctgcttaataaattaatattttggtcttgtgaattgtaattggaaaataacagctgttcctggttggaacccaatatttgcttttctaatagtttctctttcattgtgaatatagcaggaatttcacaagccttcaaaaaaaggggggagtaaattagtctcatttcgtgtgcctgggaattagaagaaactaatgttttagtgacaacttttcaaacaatttgcttttacttggtagattgctttccattactatgattatgttcactcataatagattaattaacagtgtcaacttgaaattcttatctcagatcccaaattaaatgtttttggagctagtaagccaatactgattgttcttatttcattcattgtttttgtttttgttttttttccccttctttcccaagggacaatctctttttacaatgtttcctctaaagaacaacccctctattctgacctccactgtgtccttgttctattctgtttctaggatcttaaattaattgtccagcccatttttctgccacacttgctgtgtctgtctatccatattaatcatgcagtttattgtcaaactcgtgcttcagacttgagaatgatttcatgagctctccggcatttggcagctgtatcaagtgttaggcaccaggatgattttcttgtgtagatttattgccaatatgccctgagcacctgtgtcttataaactaaaataccattaatgaaaaaaaagccaggacttaaaagcagattagatcttttggactcttatagctgggatattatctttcttttattcagtgcagcgctcacttctggagaaatagttagatgtacttggtcaaggttgtctactttctttactcttctctgtagtgtgcattagtcaatagaaacacagctctcacagaaataacactttctaattaattttctttgcttaattccattttccttcatctttttcctataagaaacagataaataagctttccattcatattctatatcaccctaatttcaaataatataaagtcatcattatgaattaattttaaaaaattattttatttatttacattccagtcattgtcccctcagtcctcgcttccacagttcctcatcccattccttttccccagagtttttaacatgtatttaaagaacttccttagaggtctggatggctcttaacttttccccgaggtctctactcattctctcttttcccttttccctgttcttgtgcagacatttacttttggatcttcttaaaatttcttaaacacatttctctaaatattcatgtaacaaatgcaatatgtcacctgagtagttattttttgtctccaaactctctgaggagaaataaaaatgatgttgtacattgtctctagttaacaatttctagtcagagggaaattactgtatattctctaatcaagcagaaatactaagaagtgagaatgctatatttaggagtacatacatacatacatacatatccatataataacaattagtgaagaaagaagagaccatgaaattgaaagagaatggggagagatattttcaagtattttgagggaaaaaaaggaaagaagaaatgtaattataatcccaaaaataaaatagaaaagtaacaaaaaataaggagtaaagggggaattctgtgtctaagtctgtgcaaagaaccctgcatgtactaagcatgttgaaagacatatgtttagaaattcaattaaattgcacccattgagaactatattttgaatccaaaaggaaaatccagagggatagcgatgagacttctattttttgaataagagaatggtcagtataacttctaagagcttacatgtgctatgtagtgtaggatgaatacaactcagccaattaacttcagtattatctgcaagtcatttgtcctctggttttactaccttcagtgccgggagttgcttttgctgaatatatgcctatattcaatgtgttctttcttacaattttatatagtatttttattttattattttaaatttttcatataatatatgttgattatcttcattccctcccttgcactccccccacattctctctcctactcatctgataccatattaagactagaattatgcaaaggatctatctatctatacatatgcatgaatttatcataaatgatatttatttaattggttgttttcaagttatatttattggcaaaattagagagatgttcttttctgctaagagtgagcatagtaaatttacttaatctttacaaagaatattatctcactctaagtcattgtgccaagagatggaaattcctgaaagtgtagttgtagagggaaattatgtagggttatatcatcaagagatagatcggttttttataggcaatctcctgattcttgaattaaaagtaggttaccataaactgcacaaatgattactggcttcagtaggcagcatgtctaggagaaatgtcccagtctttgtcataacagaaactgttgttaaaatccgagtattatttctttaagctattttgacctggaactactgtctgaaactttatgaactcagtattcttagctacaaaactaaaataaaattatcttggaaggccattttagaaattagagacttgactgcacagtgaatggaagactcatctgcagtgattatcaccagtgagggatttttcttttggctttaggtcccaatggagaagaaaacctgctaaggaataaaggaaactggctagtgaatcacaggtacctcagtgatgggaaggcatgccagcaaaggcacagtgccagtaccatatgccaattaaataagcaagtgcactttctctgtgtctatattttaatatgctctaggtccctgaataagatagttttcttttgaccagaaataaacatcactgatgactttattgtcttgtgatgcataaatgagtagtcagactgttaataaattttttgtgacagacgcagacatgcacacttccttttccttacagaattataaattaacatctctaccgaggcctcccttaaaatattccatggagtttatgccttgtctaataaaatcacaagtactgtacatgtatttgtgcctaagcatttttctttttgtaacagaacacatttacatgaacaaaaaacagaacctgtcacattccccagaagcttatttttatgctataattgtgtttcagaaaatttaccctctgtgtaacccttaatcatattcacatgcacctaaagtgtattgcttaatgtcacaagttaataataataataataacatgcctcatttacatttatgtaaaattgaaagaacacaaggaattgtaaatgtttaaaattatttgcttcattaagacatgaattaataagggtttgtgcatataaattctctcacattttaataatttggatcatatttacttattctttacccagagaacatgttgagaaatttcaaagattagtatattgaatgctgctttttacagcgtttaaataactttttatataataaatcaaacccaaaggaaaatgtaaataattacatattatgtatgagctttagaaactgatagtataaagctaattttcatgcacttatacaagcataaaacatctttctgttctagactgttctttttatttctacttattatgcacaaaagtacatagtactttacaatgcatacttgtactcagattttttagaataatggtagattatgaaggcaaactttatggcacttcttatgaagctttaaaataaagaaactattttatggttatgagcaaatgctttcattcttgtaccaaacacgtattttaagtgcttacaataccagttcacagttgtacactgcttcataatctcacatgagctttaactcattttatctcattgtgtttctcctgtgtatctcatgcagccttaggaagtagagtcccgtatgaatggttcaacaagaatgtcaagattatttgagaaagtaatattttcttattatttgagtcggttcttggagaatgatatatttgactaggtttcggccaggattgaggatattccagatggggaaatgacacaaataaaaagtgagaaaacataggtatgcctgagaattttgtaaaattatattttactagaaataaaagaaatggaatgaagtggtttttttaatgacaaataatagaaaaaaattttttaaactttctgaatctttagattcaaaatcccagtgcttgctcttattatcttaaagagcaagatttggttagggaaattttatttgattcacataattagtttataaattaactaaaattgctatataacagcatttgtatcaactttccttgataaatctacttgtattataaaatcattctacttttgaaaaaatttttgaagacatttatgaaaggagagaatttttagatatgtggaatacttaactccttgttagtttagctgcctttattagcaacaaagcttggcttgttatatagtatacatttcaaaatacttaacaacaaaaataagtttatagtttcatagagagcacaaatgagacaatgctcccctggagagtaaaaaccatgggacaaaatatagctgcaagaattatgtttgtgccaataatgtgcatatatgaatgacaatagcaattgaaaaaaatcttcttacaatgtaaatgtagttcattgtttggtggggctaaaggacatgtcatccttctaattagatgttttagaagttcccatagagccaaaaggagctgtatacagaatacactaggaaataagggaaataggtcttctacaagaagcaaaacttcatatttaagttcctgttcattgttgctgttgttccgaatcaattgaaagtagattttaaaaacctattttttttctatttagatttaattatttactgccatgatataaactggtcaacatttcagctatgatttatttattttttaaatttttatataatcttttttttcagaccagattttatccccctcacggtccaccctctgactgttccacatcccatactcactcccctcaaaccatgtctccatgacgatgtcccccacccaccccaccagacaaaatttaatgatgtgaaaaattatttttatctcccacttatactttatatatcttagttgttagaattactagtaattttatctgttgctggaggtgacattatatatgaacaagagcagcaccaatacctttcaaagcttttatagactcagttagagctatctcttttgcttcacttctgatgtgtgatgtggatgcttctcctacttagtagcacaacaaatttgagtgttcatatgcctatgttgtttagtgttattcttagatttttttttattgtcaggaattttgcaaacgtacccaccccactctctttcactgtgtgtgttctaaattcatgattgtatacagacagagaaggcagaggatggccagtatcctgccccaaaactttccccagtttctttcctgtagctggactagatggtcagccaggaaaccccgttgaccctcttaacttcagctcctacagatctgaggttataagcatatgcttggccatgaccaaatttttgcatagatgctagagatttgaaataaggtttgaacagttgttcaataaacactcttacctgctgatccatttctctagctcctatcatcagggtttatcttttttttaaatacatttttaattgaaatagaattatgtcacttcctctgctccctctcctccttgcagtccctctgagatactttctcttaaacctctcatatacctccccactctcaagttgatgacctattttctttgattatttttgttgcatcaatgtatatgaatgatagcctatatgataaatacaatatttgcagtctgttattgttgtttgtgtgtatatagtttcaagactgacccattctgcatttgataatcagtaaggtagctcctgccagggaaaggctcttttccccatcagtcattgcttgactgaagttctttctgtatagatggggccctgtgaaaatttctctcttctatgttatcatgtctatcacagtgccattattccagttttgtttatgcagccagttcatggagagactcttttaccacacatgtcctggtattctagatttaaaaatctttcttattccttctttcttaatgttccctgagacatagatttaggagatgtgatacagatgtatgcattactgctaggttccccatcattattccttgttctctgcactatgtccaattctggttttctgtgatgatctccatttgctctacagagagatttctttgatgtgggattatatctatatttatctatgaatacaaggatatgatttcaaatatacttagaatttatgaagttctagcaaactgacagttaagtaggagcttttctaaagagtccatgcactcactactttttgaaagcttactaggattctgtgctaggaatgatttctcttttcttgagtgggccttaagtccatctttatagcaattagttgccaccaacaagaagaaattttaaatatttatttttattatttttaattgtctgtatctgtttgtgtctgtgggccgtgcacatgtccacagaggcctgagatattaggttcaccagagatataagcagttgtcagtaacctcgcttggatggtggggatggaaatcagaatctgtgcaagaacagaatgcattcttaggtgctgagccatctcccagcctgtagaaagaacttttaaaaatgatttaattgtcaaaggaagtttcaaaagaacatccattagaaaaatgtatgtgaataatctagactatgcttgagtagtttgggtaaatagaatcagaagtgtgcacttgccttggttctagatgcttagttgcagaatatgaagacattgcacttttatttgccagtctgcctccaaacatttatttcagagagagaatatttttctttattccttgtactccaattcattatgcttaacagaaggtttccctgtagaaccaacttcctcattctttcctttattcttcacttggcccaaatgaaacaaaacaaaggatcctccctaagccacaatacattttccactttctgttatatagattacataatagaaaaagtttaaatgtgttttaatcagaaacagtggatatgtcttggtaggtagcttgttgtagcatgcaaacacctgcatgtttgtgtatgatctaaatgatcaaatgcaggcagataagttgaggacggccaatgtcctgctctgtatccttccacataggctctcaatagtttcttactgaacctggaattagactatcagattatcacataaaccactatgatcctcttatcttgagcaagtggtaataaagcaaaggggaaattgaaacaaatgtctcaactagaaagttgtacttaatggagtactactcagatattaaaaagaatgaatttatgaaattcctaggcaaatggatggacctggagggtatcatcctgagtgagggaacccaatcacaaaagaactcacatgatatgtactctctgataaggggatattagcccagaaacttagaatacccaagacacaagatacaatttgctaaacgcatgaaactcaagacaaacaaagaccaaagtgtggacactttgcctcttcttagaattgggaacaaaaaacccatggaaggagttacagagacaaagtttggagctgagaggaaaggatggaccatctagagactgccatacccagggatccatccataatccgcctccaaacgctgataccattgcacacactagcaagattttgctgaaaagaccctgatatagttgtctcttgtgaggctatgctggggcctagcaagcacagaattggatgcccacactcagctattggatggatcacagggcccccaatggaggagctagagaaagtacccaaggagctaaagggatctgcaaccctatagttggaacaatatgaactaaccagtaacctggagctcttgactctagctgcatatgtatcagaagatggcctagtcggccatcattggaaagagaggcccattggtcttgattcagtataggggaacgccacggccaagaagtgggagtagggcgaggtagggggtggggggaaggtatcggggactttttgggtagcattggaaatgtaaatgaagaaaatccataattaaaataaaatttaaaaaaagaaaaagaaaaagaatgaaactgggcatggagacaaagttacagcacttggtagctgtggtgtaaaacctcaaattcaaggtcagcctggaattcttggtgagaccttgtctccagaaaagaaagcatctgtaattgatgtcttttaagacattttctattcagcatcaaattgctgggcttataatccagatgtctcccactgttctcatctattattacactaacgaaataagaggtgaagctgggattcaatgtcatgtgtatccaataaaaactttagatgttttgaaaaaaaaaaaagaaaaagaaagttgtacataaactttatatgccccagtacagggaaatgctagggccaagaagcgggagtggatgggtaggggagcaggacggagggagggtatatggaactttcgggatagcatttgaaatgtatataaagaaaatatctaataaaaaataaataaaaagaatgaaatgtactgaagttcaacaaaaagaaagaaagaaagttgtgcttaaagagatgtacttaccacaatatttggcctaatagtcaataattttaagtgagagtggtataaatttttgagaatgtgtattaaactggaattatgaaagaacaaatgtagtttgttaataggattattagtgtaaataatgatagaaagtagtgatagggataaaattattgatgagcctgagtgccatatacagaatgattcagctcttccattataacacatgaagaaaacataggagtaataatgaattaatacaccaatgttgtaacaagcatagtataagtagttcctatatactcctttgaaatctgaatgattatatttcttagttaagacaacagtcgttggctaatttgcaatagaaatatggattattttattaattttataatatttatctatttatgcccttctataaattcattaatttacacttgtatatatagttttgattagtataattatgttaaatcttgaaatataacattttggcgaagacagtgttaaagatgaccttttgatagtatgagttcaatatgatgtcggtgaaaaagaaaatttcttctttcagggtggccaatattgtaattaggaagttttaagtaccagagatagttatatatatatgtttagtagcacgtacatctctttgtaacatggcatgttttcagaaaatctacagattatacaaacacagctgaaatggtaaacaagtgtagcataatattggaacactgaatatccagaaaaaaaacaggttttaaaattttaaatttttgtttataggaataaaaggaatctagtgtatatttatattttcctatttgtgctgacatttttgaaaatagattgcagagtaaaatactaaattaatagcattagatgagcttagaattctcaatgttctcttgcacaaagtgacagtaatcctttctgacaaaaagcgggctactgccagtgcttaatcctgttacagaattctctctatagtctgtagtatacattcttaaaaatggataagttcagaaatgctagatgggaaaaaaaggtgttcaccttaagcttagagaaccactcaagtgtcccagatattcacagcagatatttttgatattaaacatgttagttttagggcctaggttacatgtaataccatactgtgcattatagaattaaagtagtatgtcttatttatataatggatttttttactttaaaaaacagtttattcatcatatgtgtgtggagatcaaaggataactttttggaggcagtcctatccttttaccatgtgagtcctggggattgaactcctattgtcagggttgatggcatatgcctttacttgctgagccatcttatgagtctttgtatgaacttctgtataaggcaggctggtcttgggtccagattctagatttatcaatataaaaaatcccatttattaattttatttaaatttcaatttatttttgaaattaatttaaaaattttaaaaagctcagctttatttgttttattttatgtgtttgtgttttgcttgcatgtatgtccatgtagcatgtgtgttcctagtgcccatggaggtcagaaaaaggaatcagatcttagactagagtttgagactattttgagttgccatgtagaagctgggaattgaatcccaggtcatctggaaaagcaggcagtattctttgttaaagagccatctctccagcttattatgaaatttcttccatctggagatgattccttgtttatttttgagaaactcttgatatgtgtcacattactgagaattatctagaccatatagattaggcataaagaagggagagaggccgagtcaatgttcagcactaaaaagctagaatataaaaagttattttttccatttattgagctatggataccaaatgtcaatatataaacatctccacacttgagttatttcagacatctagctgtcatattgactccttaaatataattacaattatttcacagatgagaaaatgaagacagaaaagtatcagcaagttttctgaagtatcatgtcctctttaaaccattttttttttcaaaattgagcttactggactcaacctatcaacaaataattgctgctaactataaatatttaaattttatcctttctgctagaactccctgcttgtgtagaacaaatgttcatttgattgtgatatggagtattcatttatttattctttcccttttattgaaattagatttttctcatataatatatacctgttctactgcttccagtttcttcccacctcctttcccctccagacccactccctttctaactctcattagaaaatgcaagtcctaagagatagctacaaataacaaagtaaaatataataagataaaacaaaaaattagacaagggaaaccaaaagaagaaaaaagggctcaaaagaaggcagagaaatcagagtcacagtgatgctcatgctcagtagttccatagaaatactaaaccaagattagctgagtgtaagctgaaagcaagaaagcagtatgaggcatgctcgtttctctcagttgggctatgagtgtggcatagctgcatgagttcctgccttgacttcttggaaatgttagactctaaactgactatattgcttgttgtcagtatatttgatcacttattctctctctctctctctctctctctctctctctctctctctctctctctctctctctctgtctctcggctggcagttggtctttgtatttgcctctatctgctataggatgaagattctcttctctgatgatggctaaggaaggcactgatctagtagtagttattttatcattacttttcttctcttttttgtattattttttacaatccagtcattacctctcttccggttctccctcccgcagtccctcaacccattcaacccatttttccccctacctgtctccaagaggatgttgccccccaccaggggttcccacgccctggggcctcaagtctctcaaaggttaggagcctcttctcccactgaggccacatcatgtatgagcatgtcaggggacctgggaacagctcctatatgctgcctatctggtggctcaatgtcagagagaaatcaggggtctgggtaagttgagactgttggtcttccgatgggatctccctcctcttcagcttcttccagcctttctctaatttaaccacaggggtctccaacttcagtccattggttaggtgtaagtatctgcttcggtctcagtcagctgcttgttgagtatctcagaggatagtcatgctaggcttctgtctataagcacaccatagtatcagtaatagtgttaggccttgaagcctctccttgagatggatcccaatttaggcctgtcactggatctcctttccctagggctcttctccatttttgtccctgcagttcttctagacagggacacttttgggtcagagtttttgactgtgggatggcaaccccatccctccacttgatgccctgtctttctactgaaggtggactctacaagttccctctccccactgtagagcatttcatctaaggttcctccctttgagtccggacagtctctcacctcctaggtctggtactttctagagggtccccccactttccactccaccaggctgcatatttacattcattttgctggccctcggggtttccctcctgtccctcatactgatcatgttccccctttcccctgtcccttctctctcccaaacaggtccaatccctccctctgcctcccatgattactttgttctccctcctaagtgggattgaaacactttttcttgggcccttcagcttgttaactttctttagttctgttgattttattttgggaattctagtttgggtttagtttaattccatcaatttgcctgtaattctcatgatgttctaatacttaatagctgaatagtattccattgtgtaaatgaatcagaatttttgtattcatttctcctttctgggacatctaggttgtttccagcttctggctatcacagataaggccccaatgaccgtagtcgagtacatgcccctgtggtatgatggagcatgttttgggtatattcccaagagtggtattgctgggtctttaggtagatctatttccagtcttctgaggaacctccagatttatttcctgagttattgtatcagtttacaattccaccagcaatggaggagtgttcctctttctccacatcctcgccaacatgtgctgtcacttgagtttttgatctcagccattttgactggtgtaaggtggaatctcagggttgttttgatttacatttccctgatgactaaggactttgaacatttctttaagtgcttcttttcagccatttgagattcctctgttgtgaattccttgtttagctctatatcccattttttggttgggttgttcatttttggaggttagcttcttgagttctttatatattttggatattagccctccatcagatgtggggatagtgaagatctttacccaatatgtaggtttccaatttgccctattgactatgtactttgccttacagaagctttccagtttcatgaggtcccatttatcaattcttgatcttagagcctgagttattgaagttctgtttaggaaatctaccccacatgtgccaatgagttcacactactttcttttaaaagaccagtagcatttggttttaccattggtcttttgtttttggtgacccaagtagtatcaggtatgtgttccatattgtaatgtaagcctaaagtctaatcagacatctgttaattcctgctacaagttgccctagcataatttacaggcaggacatcattgtagattagagtttctggttagtttgttgtttacatttctcttttggtagcctgcagagtacctctagtaccaaagacactaaaacttaggggtgaaggttctatgtaggcaccaactcaacctctctttcttttgatgaattatgtgggtgttatcagcaaacagatcttggtgtcagattgtggataacaacctattctattgtctctgcaacagactagaatgtttggggatttccatggtatagattcatttatttactttgaattttattttattcttgataatattatacattgtgtactgaacatatttattttctttccaaaatccaccctctgccctccccacagttacatcttctttttattttattttgtataagtctgtaatgtccaatttgtgctccctgtatatacttggatgtgtgactttctactgaagcacggttaacttacaagtaaacctcattctgtacatggacagtacatacattgtaagtgtctttttacttcatgactgccactagtgaatagcaaacgctaactctaattcatgaattcataagtttctgtttcctaagcatcatctacaaaagccttgctgaggtgtcgaattgtttaagtacgcaaacttggctatagtattattatttctatgataatttcactggtagcttcaagttacctattttatatttcttaagctatttgcaaatcaataatatcttggtacaaaaaatgagtaggaaattctctatttttttagtgatgatttcccatatttgcaaggtgctttttgttttttttcttgtctcatccacattgtgtatactagcctgtatgcagagcagttagaaccttcagtagagtagacataaagaacatgaaatgaagccagactctaaagtataatactatcagatctatccataaattgaaaaaaattgtgaagtcaagaaataaaatcaacactttaaaattaaatttacactcgggtgtggtgctgtacgcctttaatcccagcactttggaggcagaggcaggcggatttctgagttcgaggccagtctggtctacaaagtgaattccatgacagccagggctacacagagaaacactgtcttgaaaaacaacaacaacaaaaataaataaataaataaataaataaataaataaataaataaatttacaaataccaataaagctagagttaaggtgctacagaactgtaattccagaactcagaagactgaggtatcaaaaccatgtttatatagtttagtctaaacaatccagtctttccggttaaaaagaataaatatttgtcatacaggtgagatatttgacaaggtatcagatacatgagcaaatgctgagctgtgggccaaatcacagtcgctaacagactctacatgattcacatgacttaattctagaatattgaataatgaataatctctctctctctctctctctctctctctctctctctctctctctctctctctgtgtctctctgtgtgtgtgtgtgtgtgtgtgtgtgtgtgtgtgtgtgtgtagtgaatattttatatcattcattaaactttatggatgccaagaatgcatgaataatgatacatgttgacatgccaataaggatggggaactctcacaagacttttcccttagagaaaaaactgctgagagagaaatactcttcttcagatattaccctactaattagttatttaatatcaagttgtggtccctaaaatgtatacatgcaatcaataataaatgaacacaacagattatatttataaatttctaatatatatatatatatatatatatacacacacatatgtgtatatctatctgtgtctacatatcatctatctatctatctatctatctatctatctatctatctatctatctatcatctatctatcaattatctatgtacctacatatcagttacacaatgagaagtgacatgaaacaatatatttcatgggactgtgactaattataagtaattgagaactgatagacagttgggaattatatcatatttaaataagttttatgatcaaaaacatcaaagcagatatcaataactttgggacagtttttcaataggggtggtccatataatgcctctctaataagatggactttgaccctaaataaagtggataagtagcctaaacagtaagcattttagccagaggaaatagcaagggttaagttttagaagctcccattttaatgttaaatcttgtgggagaccaaaatggtttgtctattgatgtttgtatactgattagcagatttcacaatagggcttatttataggactatttacaaatggcatctatgaaatacaaacattacatagtttaaatatagttctttttaaattttttattaggtattttcctcatttacatttccaatgctatcccaaaagtcccccataccctccccaccactcccctacccacccactcccacttcttggccctggcgttcacctgtactgaggcatataaagtttgcaccaccaatgggcctctctttttagttaactctagagcattttgagaaatgggattgacacatttattcatggactatctttgttttggttttttttttgaatctaaatatagaaattatgtttttgatctctatttttaggaaaatgattgtaccactttttgtataataaagccttattttaatgagtaaatgttcataagagctctaagtcaaaattgactcctaaatttgtcattcctgataggaatgataggtttgaaaactggactagattaagacactcttgttaatgggaaaatggtaacgcacaatctggcaacaaagttgaggcctcagcatcagtgcctgatagaatctaattcctagagataatggactaaagaaatagagcaacagaagacacttgtcttgactgaagttactttttgatgcaagctaaaaaaagttttaattattaggaaaatataacagtgggtcattttaaaatttctgctagtgaatatatggtatgaaacaatgtagcattctgtttgcagtgaatactccatttatataaatatgacacataatagattgtagaatttctaatagaagcgacaaatagaatataaatagaaacatttataaatatttcttaaaggtgaaggttttaagtatgttaatgtatagtagtaatagcttaagacgttaaactatgtaaatgtaaaatcatcaacatgggttcttttgtaataaatgaccagtttcaagttgtttaaccattcataaaagaaataatttgttttcataacagataaaaataatttgtttcttcattgttttatagtatatactttacacattaagaacttccatgtaaagcttgagttgtagcttgagagagttgtttactgaagctatatcaaagctcaaagacaaatctggggttttggcatgtgggttgaaagcagtcttgtttcacgtgctttatttttttcacatgcagaatcctggttgggaaaaaaaataaaacctcaaattgatacttcattatgtatctggatccattttcttgggttcaactgtttggagagttgattcatggagcttcctaaaaattagggaaaatgcctatgcactttaattatagcttaaactcagcttataagggtcaaatctttaactttctttactattatttagctttcttgacatattagatctattaatataacaataattaaaaacagcataaacagcttagatacattagtacttgttcagttgtattgtgaagtgcttactatttcttttttttttaagttggatatataattatttttaattaggtattttcctcgtttacattttcaatgctatcccaaaagtccgccatacccatccccccaatcccctacccacccactccccctttttggccctggggttcccctgtactggggcatatacagtttgcaaatccaatgggcctctctttgcagtgatggccaactaggccatcttttgatacatatgcagctggagtcaagagctccggggtattggttagttcataatgttgttccacctatagggttgcagttccctttagcttcttgggtaatttctctagctcgtccattgggggccgtgtgacccatccaatagctgactgggatcatccacttctgtgtttgctaggccccggcatagtctcacaagagacagctatatctgggtcctttcagcaaaatcttgctagtgtatgcaatggtgtcagcgtttgggagctgattattggatggatccctgcatatggcaatcactagatggtccatcctttcgtcacagcgccaaattttgtctctgtaactccttcaatgggtgttttgttcccatttctaagaaggggcaaagtgtccacactttggtcttcattcttcttgaatttcatgcgtttagcaaattgtatcttatatcttgggtatcctaagtttctgggctaatatccacttatcagtgagacatattgtgcgagttcctttgtgtttgggttacctcactcaggatgatgccctccaggtccatccatttgcctaggaatttcataaattcattttttaatagctgagtagtattccattgtgtaaatgtaccacattttgtgtatccattcctctgttgaagggcatctgggttctttccagcttctggctattataaataaggctgctatgaacatagtggagcatgtgtccttcttaccggttgggacatcttctggatatatgcccaggagaggtattgctggatcctccagtagtactatgtccaattttctgaggaaccgccagactgatttccagagtggttgtacaagcttgcaatcccaccaacaatggaggagtgttcctctttctccatatcctcgccagcatctgctgtcacctgaatttttgatcttagccattctgactggagtgaagtggaatctcagggttgttttgatttgtatttccctgatgattaaggatgttgaacattttttcaggtgctcctcagccattcggtattcctcaggtgagaattctttgttcagctctgagccccattttttaatggggttatttgattttctggagtccaccttcttgaattctttttatatattggatattagtcccctatccgatttgggataggtaaatattctttcccaatctgttggtggcctttttgtcttattgacagtgtcttttgccttgcagaagctttgcaattttatgaggtcccatttatcgattctcgatcttacagcacaagccattgctgttctactcaggaatttttcccctgtacccatatcttcaaggcttttccctactttctcctctataagtttcagtgtctctagttttatgtggagttccttaatccacttagatttgaccttagtacaaggagataggaatggatcatttcgcatttttctacatgataaccgccagttgtgccagcaccatttgttgaaaatgctgtcttttttccactggatggttttagctcccttgtcaaagatcaagtgaccataggtgtgtgggtttatctctgggtcttcaattctgttccattggtctacttgtctgtcactataccaataccttgcagtttttatcacaattgctctgtagtacagctttaggtcaggcatggtgattccaccagaggttcttttatccttgagaagagtttttgctatcctaggttttttgttattccagatgaatctgccgattgccctttctaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagacttgaaattcttatcatacacatctttcacttccttagttagagtcacgccaaggtattttatattatttgtgactattgagaagggtgttgtttccctaatttctttctcagcctgtttatcctttatgtacagaaaggccattgacttgtttgagttaattttatatccagctacttcattgaagctgtttatcgggcttaggagttctgtagtggaatttttagggtcacttatatatactatcatatcatctgcaaaaagtgatattttgacttcatcctttccaatttttatccccttgatctccttttgttgtctaattgctctggctaggacttcaagtacaatgttgaataggtagggcgagagtggacagccttgtctagtccctaattttagtgggattgcttccagaggaatttcttttctggtccagtctatttggagttctgtaggcttcttgtatgttcataggcatctctttctttagatttgggaagttttcttcaataattttgttgaagatgtttgctggtcctttgagttgaaaatcttcattctcatccactcctattatctgtaggtttggtcttctcattgtgtcctggatttcctggatgttttgagttagcatctttttgcattttccattttctttgattgctgtgccgatgttctccggaatcttctgcacctgagattctctcttccatctcttgtattctgttgctgatgcttgcatctatggttccagatttctttcctagggtttctatctccagtgttgcctcactttgggttttctttattgtgtctacttccctttttatgtcgtggatggttttattcaattccatcacctgtttggttgtgttttcctgcaattctttaagggatttttgtgtttcctctttaatgtcttctacctgtttggttatgttttcctgcaattctttaagggatttttgtgtttcctctttaatgtcttctacttgtttagcagtgttctcctgtatttctttaagtgagttatttaagtccttcttaatgtcctctaccatcatcatgagatatgcttttaaatcgaggtctagcttttcaggtgtgttggggtgccctggactgggcgaagtgggagtgctgtgttctgatcatggtatgtggtcctggtttctgttagtaagattcttacgtttacctttcgccatctggtaatctctggagttagtttttacagttgtctctgtttagagattgttcctctggtgattttgttaccctctatcagcaaaccaggcagacttgctctcttccctgagtttcagtggtcagatcagtctctgcaggcaaggtctcctctttcagggaggtgcacagttatctggtgtttggacctcctcctggccgaagatgaaggcccaaaacaggatctttcccagaagctgtgttgttttggcctgtcacagaagccgttgtttcagtagtccacactctcacctgtgtagactactttccgtggagtcccggaaccaaggtggctcctgtggaacgtgaggcagaagcctctcgggccgggtggacacctgtgctctgaccaggaaggtggctgtttgtctggagcagaaaatggtgccctctcgggccgggtggacacctgtgctctgaccaggaaggtggctgtttgtctggagcagaaaatggtgccgcctcaaaggctctgcagcccttgcctgtcccagaagccgccggcccccgtgttccgcactttcacctgcagactgctcgcggtggagtccgtgcttactatttctatcattaaattatttttatttctaaaattcttttatactttaagtcatcacatgaagctcactttacttaattaattttacttgctatgtaatttctataagcatatctagatatgctaaaaatgtgtttctgtaatcaaaatggtcataatgagttatttttggatatctaaatttctcctcttttcatttttattaatatacttcttagcaactttttattttcataagagtttattgctaaaaattaaaaccattcaaaagttgaaattttcagcctgttataactagataaaaacatgataagcataattttcttttcttaaagaaagaagctgattatgggatggatccctggctatgacagtctctagatggtccatcctttcctctcagctccaaactttgtctctgcaactccttccatgggtgttttgttcccaattctaagaagggtcaaagtgtccacattttggtctttgttccatcccataatcagcttccaaatgctgacaccattgcacacactagcaagattttgctgaaaagacccagatatagctgtttcctgtgaggctatgctggggcctagcaaacacagaagtggatgctcagtctgctattggatgggacacacacagtgcccccgatggaggagctagagaatgtacccaagagctaaagggatctgcaaccctatagttggaacaacaatatgaactaaccagtacccctgccccctcagagctcgtgtttctagctgcatatgtatcagaagatgggctagtcggccatcattggaaagagaagcccatcggtcttgcaaactttatatgcctcagtacaggggaacgccagggccaataagtgggagtggggggaggggaatggggagggagggtatgggggaacttttgggatagcattggaaatgtaaatgaagaaaatacctaattaaaaaaaaaagaaagaaagacgcctaattaaaatgcattctaatatttaaagggccagtgtaatgatttaatagttacagagtgcatgatgtcaagattaacaatctgagttgaatctccagaaaccacatgggggaggagagaatgacctactgaaaaatttcctaggatatacaaaacataaacacacacacacacacacacacacacacacagagagagagagagagagacagagagagacagagagacagagagacagagagacagagagacagagagacagagggagacagagagagaccaaataaatataataatggaacattaatttaatacatgtaatcagaggagaaaatattattgtttagtacctctactttccaaatttagacttctaaaggtactattttttgtgtagtataatcaaacacgtgttttctttgatgaattgatgtaatgtgacatagagtctaaggaatgtgtgacaaaaagttcttaccatcttttttttaatcacacataccaattcagaatacaaagactaaatgtgtatgaagtacctgttgacataaatacatttgtcagaattatttagttagtattttctgattgaattctgaatagaggtaacattctgtagaattattttttaaaaggatcaatacgaaaccattcaattcaaagcaaattgatcttggaaaggtttctcctattgtactccactctaatgtttggagaaaaatgtgatgtaaatacaagcatgaagagtaaaggatttttttcttcctttagtcatggcctgaaaagtttaatggtgttttagaagtgatattacacttcagaaaaagggtaatgcatctttaaaagctaaactacatcttctttacttttatcaaattctctataaatctttcatgacagtttatttaacaaagtgccattgaaactgtatagatgattgatgtgacccatgtaagatcaacatgaaatgtttgtaaatgtcagcaaaatgtgaccatctaaaagcatataaggagtttctatgaaagtgaaaaaccaacagaaaaaaaaatgtttatcttattctttgctttctggcatgcaattacaaattcatagaagtcaaattgtatttgattttccttggcactcatgcgatctgaggactaatttacttttgacatttaccctctcaaagctctggttcatactcattggataagttttctctatcatctatgtgaacataatacaggctcagaatttcttaaaaatgataattatttatgaaaccattagtaaaaccttgaaaagactctttatgtagaaatctaggatgtaccaacattgaaatgtcatcatagagcaggtattatccatatgtctatgcaaaaaacctctttgatctttatacatttgaaaacattaatgttgtaaaagcaaatacaatgggaaaagggaaggaaataataagataacaaataaatactttgttacaaaagtagagtagtggcatactctagagtctgaatgtttctttttaaaatttctctttgactttactttagaataaaataaatattatgtttagtgtagaacatattctgcgcttcagggttatattttgatatatgttttcacttattgaccctacagcagaatgtgtaaagtgaaatcaatgcagcttatgaatggacaataaagactaaagatacaaatttgaaacttgaaaatcagtaggaattcctactgaaatgaaaatattttcaatggaggaggggtacttatacaaacatcattcatctaaatactacactcttcattcttacttgcaaggaattttgaagaatctacaaagaatttcacaatgctaatacttagcaaatgctattttccatcccaatggatatgtatatttactcacaaagaatgtttttaaatggtgtcttgatgctttatgggtggaaaatatttgataattgtacagcgaggccataaataactagaacactatgttaaggctcccaactaaataagctcgtctcgggagtcatacttagttttcaggaggatatgacaagatgaaacaattcaagaagcatcttgagacaagaacatacttccttttatttatttatttttgcatctctagtatggcacagtggattgctatattagagtgatttgtcatctgagacagtttccatttaatttaagcttggacttacaccagtaggaaattactataatgaagtttgagaagataatgaattatagggactttggtataaattttcattttgaagcaattctagtggcaaatctatatatgacagctattcaatacagtatcctcttttcatattattaaagttttaaacgattttattttaaaaatgtgtatgtatgctgtttgtgagtactatcaaaatccaggagagggtgtcaaagtcctgttgttgccttacttggatccaggggaacagaactcaggtcctcaggaagggcagcaaatgctgctatctgctgagtcatccctctagctccttagtcattatagtttaaacaacatgtacatttcaatgtatttttaagaatgattatgcttttacccatagaataatattttagagaactttagagccattgtgagaatatagtaaatagggaaagataaatccttgtgtgattcttaaatataatatgaagcagagaaataactcatataagtatctgtatctgtctcagtcacctgcttgtagagcctctcaggacagtcatgccaggctcctgtttgtaagcacaacatagcctcagtaatagagtcaggcttggtgcccacccttgagatggatccccagttggggcagtcactggactgcctttccttcagtctcttctccattttcgtccctgcagttcctttaagcaggaacaactctcagtcaaaaaaaattgaaggtagctgggtggccccatctcttcactggggggccatgtttatctactggaggtggtctcttcaagttttctctccccaccattgggcatttcagcccaggtcattcctttgagtcctgggagcctctcacatcccaagaggtctctggaactttctagaggtttccccatatccccctgccccccgtgcagctgcatatttccactcattctcctggccctcagggctcttcttctgtctcccccatacctgatcctgccctccctttccccctcccctctcccccactacgttcctcccttttcctacctcccataattattttctacaaatgttaatactacaaaatgttatttaaaaattagtttgttcttattgtttgtatgaaaaaaacactagtgctttgctttagatttttcttttcgtcctgcatgtatgcattcatatatgtatgtatttgctttatactttgctatgacagctttaaattcagagagaacaaattgcacaatattggataatgccattattttccaataatcaaaagcaggaatgctgactttttattgtatgtggaattaacttccatgtaaagaaaagatagaagaacagacaggtccatagacactcccatcaaaaaaaaatggaagagttgaactattctttttctttaagaaccctaggtattcacaatcccaggcatcaaacttgtgtgatttctttagttttgctttgacaggagctacaatttacatgtgatatttaaatatttgggatagtcatgataatggtggtggcattcctacaatgtgataatcttatctacttaccatagcttatgtcagatactttgaagtataggtttccaactctaacatcactatctacaatctttcgaggactgaagagatatgttcaaaatactgtggaatgtcaagttgatggctataattttattttgccctactatgagtgttaatgtcacgtgcacgtgtatgtgtgtgagtgtgagatcatgcatttgggtgtgtgaatgtatatgcggagatgtgttagtctttggcttccactctgtttgaaccaaagtttcttgttaactactgtgtactctacgttgtttggctgacaagtttccagggattctattttctattcctggaccttatctcttagaaacagtggcaagattataaatacttgtgttaccaccttagctttttatgtgtgttctgatgatttgaactcaggtcctcacacttgcccagatggaacaatttaaacacatttctctcatagtcatcttttaagctatgagacataataaaactttttttttcttactcagaacatagaaccccatccttttatatctaatagaatgtttattttggtatattgaagactttgcagatggaattctacaagataatgtgtttattttgactaaatgttattgatataatgaccactgaaatcaaccctgaagagcctggcatactaattttagtttgttacttttctacaagatgttttcagagattcttcactatggtgtgctcaattccataagtgtgctttctatacatataaccatgtagagaagatgtgtagtaggctttgttgctgaattatgagtagtctaggtagacaaggtatctccacattgatagggcttagattctatgccttctttaaactcataattgtcctgttaatttttatgtgttttggggacttgcttcaaaagctttataggaaatttcagagaataatctaaaaagtataaccatgtagctggtgagggtcactctagacagtattttaatgtagaaaactttggataatgaagcaaaagagagcttaagtaaaacactgtgaaatataaaagccactggttttaatttggtattagagtagtgccatcacagtaatgttctacaccctctgctcttccctgaacagtgctaatcttcctttaattaattaattgtggtggagaaagttagttttcactttactcatacaatcattcttttgctcttatttcttgctgttctgacttccatatatgtccttccatggatcattcatttatttcattctagttgtattttttaaggtgttaggaactctgtcattttgatatcagttgaaaaggtgggcacacttccaatcacttttgtaacttcttgctaaaactatatacttttccattttcatgaagacatccacagagaattactctatttgataattccaaatgtgctattgccaaagggttatgtgccatcaacattaggggatagatcttagcatattaaagccttgtatccaaattttgaaatgcctatttgtacaatcattatggaaaacactatggggccccctctaaacctaacacataattcagtaattgtatattgatgaatggataaaacatatgtaataagtatgaacaataaaatagtatccagtctaacaaagaaaggaaagtctatcattaactatgagggttttatgttacataaaataaacaaagcatgaaaaataccacatgatttccctttcatgctgtgcaagcagttgtacttctagaaacagaagataaaatggtagttcctagtggctagtgagtattaggaatacagctaactactgttcccaggaccccagaaatattattagaaagaattacatatataaaaactgcaaacacatttgatcttaagtgttcttaccacaaaacagtatttgagataagcatatatgttaagtaacttgatttgaacattctatagtataaaatatatcaaactgttctgtggtataccctgtctttacacaattttatctgtcactataaaaagttcaacaactaaaagccacttgtaattagcctactaggctattctgataaacaaatatatatgtacaaattatatatgatgtgtttatcaagtttatgaattcttctagatgtataataaatgactatcaacagcaaatattagtaattcagtattatctctgtcaagctgaactgagagcattagtttttgcattttcctttaaccttcagacctaaaagtgcccctttctatcctgacagaggctcctagtcagttgcagatatcattgatattctggtgtggtactgttgatcttattttgattgaaacagggttctagacagcaaaattgatgagtgttttttatggtaagagtgttgcaaagaaaagtgataaagggcttcatatttaggcatgcctggggcaagaattatgaccttcgttaaactcgttatttagaaaatattaaacatatcatgcttcttttagcacaacataggttatcaacctaataacttaaagtccttcattaactacattttgatagatatatctctggtcattttcatttttttttctatctaagtagcgtatgatagagtttcatgtaggacaagacatttatctttcttattaggtgaggtcttttctatcataataacagcaagtcagttatgttatataatgatgtcatcatgtttatggagacaatttacatgggagatactttttatataaatcaagtttaaggacatttagttagatatggataatgtcagaaataaattaaaaattaatatggtatggaagaatactatatttaaggaaaatatacagcagatgtcaaagataaattacattttttgtaatgcaataatttagtcactagtaaagcacttggatttttttaattagatattttctttatataaatttcaaatttcaaatggtatcctgaactttccctataacctcccctgccctgctcccctacccacccactcctgcttcttggtcctggcattcccctgtactgagacatataaagtttgctagaccaacgggcctctcttcccagtgatggccgactaggccatgttctgctacatatgcagctagagacacgagctctgagggtactgattagttcatattgttgcagaccccttcagctccttgggtgctttgtctagcctctctattgggttccatcttatagatgactgtgagcatccacttctgtatttgccaggctttggcatagcctcatacaagacagctatactaggggcccttcatcaaaatcttgctggcatatgcaatagtgtctgggtttggtggctgattatggaatggatcctcaggtggggtagtctctggatagtccatcctttcttcttagctccaaactttgtctctgtaaaacctttcacggagtacttggcttttatctaagtattttttttaaagtagccaacagataagattttgtttatttagattaattaattaaagtatttaataccggaaatgtatttttttattaaaaagctatttcaaatattttcctttattatattatttaaaacatcaccaagaagttatatttagtcttcttgtattctagatattttaaatgtgttttttataatttacttaatttttttccatttttattaggtatttagctcatttacatttccaatgctataccaaaagtcccccatacccacccacccccactcccctacccacccactcccccttttggccctggcgtttccctgtactggggcatataaagttggggtgtccaatgggcctctctttccagtgatggccgactaggccatcttttgagacatatgcagctagagtcaagagctccggggtactggttagttcataatgttgttccacctatagggttgcagatccctttagctccttgggtactttctctagctcctccactgggagccctgtgatccatccattagctgactgtgagcatccacttctgtgtgtgctaggccccggcatagtctcacaagagacagctacatctgggtcctttcgataaaatcttgctagtgtatgcaatggtgtcagcgtttggatgctgattatggggtggatccctggatatggcagtctctagacggttttatgtgaagttccttgatccacttagatttgaccttagtacaaggagataagtatggatcgattcacattcttctacatgataacaaccagttgtgccagcaccaattgttgaaaatgctgtctttcttccactggatggttttagctcccttgtcgaagatcaagttaccataggtgtgtgggttcatttctgggtcttcaattctattccattggtctacttgtctgtcactataccagtaccatgcagtttttatcacaattgctctgtagtaaagctttaggtcaggcatggtgattccaccagaggtacttttatccttgagaagagtttttgctatcctaggttttttgttattccagatgaatttgcagattgatctttctaattcgttgaagaattgagttggaattttgatggggatagcattgaatctgtagattgcttttggcaagatagccatttgtacaatgttgatcctgccaatccatgagcatgggagatctttccatcttctgagatcttctttaatttctttcttcagagacttgaagtttttatcatacagatctttcacttccttagttagagtcacaccaagatattttatgttatttgtgactattgagaagagtgttgttttcctaatttctttctcagcctgtttattctttttgtagagaaaggccattaacttgtttgagttaattttatatccagctacttcaccgaagctgtttatcaggttaggagttctctgttggaatttttagggtcacttatatatactatcatatcatctgcaaaatgtgatattttgacttcatcttttccaatttgtatccccttgatctccttttgttgtcaaatttctctggctaggacttcaaatacaatgttgaataagtagggagagagtggacagccttgtctagtccctgattttagtgggattgcttccagcttctcaccatttactttgatgttggctactggtttgctgtacattgcttttatcatgtttaggtatgggccttgaattcctgatcttccaagacttttatcacgaatgggtgttggatcttgtcgaatgctttttccacatctaatgagatgatcatttggtttttgtctttgagtttgtttatataatggattacattgatgggttttcgtatattaaaccatccctgcatcactggaataaaacctacttggtcaggatggatgattgctttaatgtgttcttggattctgttagcgagaatattattgagtatttttcatcgatattcataagggaaattggtctgaagttctctatctttgttggatctttctgtggtttaggtatcagagtaattgtggcttcatagaatgagttgggtagagttccctctacttctattttttggaatagtttgtgcagaactggaattagatcttctttgaatgtctggtagaactctgtcataaacccacctggtcctgggctttttttggctgggagactattaatgactgcttctatttctttaggggatatgggactgtttagatcattaacttgatcctgatttaactttggtacctggtatctgtctagaaatttgtccattttgtccaggttttccagttttgttgagtatagccttttgtagaaggatctgatggtgttttggatatcttcaggatctgttgttatgtctcccttttaatttctgattttgttaattaggatgttgtccctgtgccctctactgtgtttagctaagggtttatctaccttgttgattttctcaaagaaccaactcctcatttggttcattctttgaatagttcttcttgtttccacttggttgatttcaccctgaggttgattatttcctgccatctactcctcttgggtgaattttcttcctttttttctagagaatttagatgtgttgtcaagctgctagtgtgtgctctctccagtttcttattcgaggcactcagagctatgagtttccctcttaaaaatgttttcattgtgtcccatatgtttgggtacgttgtggcttcatgttcattaaactctaaaaagtctttaatttctttctttattccttgcttgaccaaggtatcattgagaagagtgttgttcagtttccacgtgaatgttggctttcccttatttatgttgttattgaagatcagccttaggccatggtggtctgataggatgcatgggaccatttcaatatttttgtatctgttgaggcctgttttgtgaccaattatatggtcaattttggagaaggtcccgtgaggtgctgagaagaaggtatatccttttgttttaggataaaatgttctgtagatatctgtcagatctatttgtttcataacttctgttagtttcactgtgtccctgtttagcttctgtttccacgatctgtccattgatgaaagtagtgtgttgaagtctcccactattattgtgtgaggtgcaatgtgtgctttgagctttactaaagtttctttaatgaatgtggctgcccttgcatttggagcatagatattcagaattgagagttcctcttggaggattttacctttgatgagtatgaagtgtccctccttgtcttttttgataactttgggttggaagttgattttatccgatattagaatggctactccaacttgtttcttcagaccatttgcttggaaaattgttttccagcctttcaatctgaggtagtgtctgtctttccccctgagatgggtttcctgtaagcagcagaatgctgggtcctgtttgtgtagccagtctgttagtctatgtctttttattggggaattgagtccattgatattaagagatattaaggaaaattaattgttgcttccctttatttttgttgtttgagttggaattctgttcttgtggctgtcttctttttggtttgtttagggattactttcttgctttttctagggcgtgatttccgtccttttattgttttttttttctgttattatcctttgaagccctggattcgtggaaagataatgtgtgaatttggttttgtcgtggaatactttggtttctccatctaaggtaattgagagtttggttgggtatagtagcctgggctggcatttgtgttctcttaatgtctgtataacatctgggcaggctcttctggctttcatagtctctggtgaaaagtgtggtgtaattctaataggccttcctttatatgttacttgacctttctcccttactgcttttaatattctatctttatttagtgcatttgttgttttgattattatgtgttgggaggaatttcttttctggtccagtctatttggagttctgtaggcttcttgtatgttcatgggcatctctttctttaggtttaggaagttttcttctataattttgttgaagatatttgccggccttttaagttgaaaatcttcattcttatcaactcctattatccgtaggtttggtcttctcattgtgtcctggatttcctggatgttttgaattaagatctttctgcgttttgtattatctttgattgttgtgctgatgttctctatggaatcttctgcacctgagattctctcttacatctcttgtattctgttgctgatgctcgcatctatggttccagatttctttactaatttttctatctccagcgttgcctcactttgggtttactttattgtgtctacttccctttttaggtctagtatggttttgttcatttccatcacctgtttggatgtgttttcctgtttttctataaggacttctacctgtttggttgtgttttcctgtttttctttaaggacttgtaactctttagcagtgttctcctgtatttctttaagtgagttattaaagtccttcttgatgtcctcttccatcatcatgagatatgcttttaaatccgggtctagcttttcggttgtgtgttggggtgcccaggactaggtagggtgggagtgctgcgttctgatgatggtgagtggtcttgatttctgttagtaggattcttacatttgccttttgcatctagcattctctggagctagttgttatagttgtctttggttagatcttgttccttaggttatgttagccttatgttagcctccttatgttagcctctatcagcagacctgggagactagctctatccttagtttcagtggtcagagtactctctttaggcaagctctcctcttgcagggaaggtgcccagatatctggtgtttgaacctgactcctggcagaagttgtgttccactcaccagaggtcttaggatcccatggctgatcctgtgtgggtccttgcgggtgttcggagactccctgggccagggatcccggtgctgcagtgggccggaagggttatctaagtatttaaaataaacaaaacagactaaagccttagcaaggcccaacccttcaaatgaatgtaaccatttttacatatatgtgactaggaaaggcaccttttcaaagtatcctttaacttgagattcatattttagtatacacatttctgatatgatattttatatttttataatgtatttagcagaaacataaaacactgttattaattttcccaatctgatttctatttatagtaccttagacaaatgctatttattttttgacaatttattatattagtactatagttagattatttccttctcttctttcctctaactccttctctgtcccccttgttacacaaatgaatggtatctcattctttaattatatatatataatatatatatacatgcatatactataatgaatataattgaccgagtctattgttttgcctatatgtgttcagagatgaacttttgaaattggctaacttattagggaacccattcctagagaagacagattttccctctcttagcagcctttaattgcccattagtactgtccttttgggagtcctctttagtccatcatgttattgaaagtttattgagctcaatatccctgtcatatgtagaagacatctcaaagcagatatcctggtcttctggaccatattataatccttataccctctcttccatgatgttccataagccttagctctagggattgtatcagttgtatcagttgggcctagaaactctactcttacttgttttctgaatttgaccagttgttacattctgtaatgattggtctgctgcagcaaaaggaagcttcttgaggctgtgtgggagttacatttatctgtagttaaagtggcaagttttagaatgcaattctagtggtttaaggaagtggccatagtcgatttctctcctagtgtccatgaccacatcatttattcttagcggcctagttttacagcacgtggtatgaattaccttctgttgagcaggacttcagtccagttacatagctattggttcataccagaatataagtaccactattgcacttttgggggttatcttagcattctggtctattttgatgttcacagacactgcaacacagtagaactacagattgcctttctcttttggcagcttacatagtccttgtgacactgcaagctaggattcttcgagttcagatccaaataaattcttcaatggcttctgtctgaagtgtgtgctgttttcacgaagagaaattacagtttctaagagtcagctaaggaaaatggcaatactcatttgaggatctcttgggattccttgactgtgtttttccatgcatggaactctgggctttgttagatatctatggctcttggagggaacattgtcacttaagtggcacaagttcagacacacacacacacacacacacacacaatgtatgtaattttaaataaattcttctgtttatttaactaaataaactcttctgtttatttataaaaacagagctcttctccgtttttatctctgtagttcttttagacagaaacaattttgggtaagagtttttaactgtgagatgacaaccccatccttccacttgatgccctgtatttttactggaggtggactctacacattcgtttcctttgtaatgatatagtctctctttatagtactaataagggctaacatactacatgttagatcatttctaatgtcattagtgtccagaacagcaaatgcaataaataaagacagaatattaaaaacagtaagggaaaaatgtcaagaaacatatgaaggtaggcctattagaattactccagacttctcaccagagactatgaaagccagaagatcctggacagatgttatacagacactaggagaacacaaatgccagcccagtctactatacccagcaaaactctcaagtaccatagagcgtgaaaccaaagtattccatgacagaaccaaattcacacaatatctttccatgaatccagcccttcaaatgataataaaaggaaaacactaacacaaagatggaaactacaccctagaaaaagcaagaaagtaatccttaaacaaaaataaaataagagccacaagaacagatttccaactttaacaacaaaaatgacaagaaacaataattacttttctttgatttctctgaacatcaatggaatcaattccccaataaaaagacatagactaacagactggctacacaaacaggacccaatatttttctgcttacaggaaactcacctcagggataaagacagagtgaaaggctacaaagcaattttccaagaaaatggtccaaagaaacaagctggagtagccattctaatatcgaaaaaaattgacttccaacctaaagttatcaaaaaaagacaaggagggacccttcatactcatcaaaggtaaaatctaccaagaggaactctcaattctaaatatttatgctccaaatgcaagggcagccacattcagtaaagaaactttagtaaagctcaaagcacagattgcacctcacacaataatagtgggagacttcaacaacccactctcacgaaaggacagatcctggaaagagaaactaatcagagacacatggacactaacagaagttatgaaacaaatggatttaacagataactacagaacattttatccttaaaaaaaaaaaaggatatactttcgtctcagcacctcatggtacctcctccaaaattgaccacataatctctcacaaaacaggcctccagatatataaaaatattgaaattatcccatgcatcttatcagatcaccaaggaccaagcctcatcttcaataacaacataaataatagaaagccaactttcacgtggaaactgatcaacacactactcaatgatatcttccttggtcaaggaagaaataaagaaagaaattaaagactttttagagtttaatgaaaatgaagccacaacatacccaaacttatgggacacaatgaaagcaatcctaagaagaaaacacatagccctgtgtgcctccaaaagaaacaagagagagtatacattagctctctgacagcacatctagatcaaaaggaagcaaattcaccctagaggagtagacagcaggaaataaccaaactgggggctgaaatcaaccaagtggaaacaagaagaactgttcaaagaatcaaccaaaccaggagctggttctttgagaaaatcaacaaaattgataaatacttagccagactacctagagggcacagggacagtatcctaattaagaaaaccagaaatgaaaaaggagacctaagaacagaacctgaggaaatccaaaacatcatcagatcctactacaaaaggctatactcaaccaaactggaaaacctggatgaaattgacaactttctagacagatacctggtaccaaggttaaatcaggatcaggttaataatctaaacagttctatatcccctaaagaaatagaagcagtcattaatagtctcccaaccaaaaaaagtccaggaccagatgagtttagtgcagagttctatcacaccttcaaaaaagacataattcaaactttcctcaaactattccagaaaatagaaacagaaggtactctacccaattaattctatgaagccacaattactctgatatctaaaccacataaagttccaacaaagaaagagaatttcagaccattttcccttatgaatatcaatgcaaaaatactcaataaaatccttgcaaaccaaatccaagaatacatcaaaatgatcatccatcatgaccaagtaggcttcatcccagggatgcaggaatggtttaatattcagaaatccatcaatgtaatccactatataaacaaactcaaagacaaaaaccacatgatcatctcgttagatgctgagaaagcatttcacaaaatctaactataggtggaacaacaatatgaactaaccagtaccccggagctcttgtctctagctgcatatgtatcaaaagatggcctagtccgccatcactgcaaagagaggcccattggacttgcaaactttatatgccccagtacaggggaacgccagggccaataagtgggagtgggtgggtaggggggtggggggttgggtatgggggacctttgggatagcattgaaagtgtaaaagaggaaaatacctaattaaaaaaaataaataaaacagggtcttgtaaaaaaaaattaatgagctaatattaacatagttttgggaaatgtagtggtttgaatatgcttaaaccatgggaagcagcactattaggaagtgtggccttgttgggataggtacggctttgttggaggaagtgtgttgctgtatagcaagccttgaggtctagtgctcaaactctccccagtgcagaagagagcctcctcctgactgcatggggaagaaaggctccttctggctgccttcaggtcaagatgtagaactctcagtctcttcttcaacaacatgtctacctgtatcactgccatgcttcctatcatgatgataatggactgaagtctgaaaatgtaagccagacccaattaaatgttttcttttattaaaaaaaaagtcatggaaaaatcaggaattcaaggcccatgcctaaacataatataaacattctagagcaaactagtagccaacatcaaagtaaatggagagaagatggaagcaatcccactaaaatcagggactagacaaggctgcccactttcttcctacctattcaataaggtacttgaagtcctagccagagcaattcgacaacaaaaggagatcaggggatacaaattagaaaggaagaagtcaaaatatcactaattgtaaataatataatagtatatataagtgatcctaaaaattccaccagagaactcttaaacctgataaacagcttcagcgcagtagctagatataaaattaagtcaaacaaatcagtggcctttctctatacaaaagataagcaggatgagaaagaaattagggaaacaacatccttcacaatagtcacaaataatataaaataccttggtttgactttctctaaagaaatgaaagatctgtatgacaagaacttcaagtctctgaagaaagaaattgaagaagatctcagaagatggaatgatctcccatgctcatggattgattggcaggattaatatagtaaaaacggctatccttccaaaagcaatctacagattgaatgcaatccccatcaaaatttcatctccattcttcatggcctttcaaaccttgagttagaaagggcaatttgcaaattcatctggaataacaacctatgttagcaaaaaatattctcaacaataaaagaacctctagggaaattaccatgcctgacctcatgctgtactataaagcaattgtgataaaaactgcatggtactggtacagcaacagacaggtagataaataaaatagaatagaagtcccaaaaatgaacccacacacccatgttcactttatctttgacaacggagctaagactctccagtggaaaaaatacagcattttcaacaaatagtgttggcacaactggcagttatcatgtagaagaatgagaattgatccatacttatctccttgtacaaagctcaagtctaagtggatcaaatgactccacataaaaccagagacactgaaatttatagaggagaaagtggggaaaacccttgaagatatgggcacaggggaaaaattcctaaatagaacagcaatggcctgtgctgtaagattaagaattgataaatgggacatcataaaattgtaaagcttctgtagggcaaaagacactgttaataagacaaaaatgccaccaacaaattggaaaaggatctttaccaatcctaaatctgataggggactactatccaacatatacaaagaactcaagaagctgaactccagaaattcaaataaccccattaaaaaatgggctacaaagctaaagaagaattctcaactgaggaataacaaagggctgagaagcacttgaaaaaaatgttcaacatccttaatcatcagggaaatgtaaatcaaaaagcccctgtgattccacctcacaccagtcggaatggctaaaatcaaaaattcagtgacagcagatgctggcgaggatgtggagaaagaggaatgaacactcctccattgctggtgggattgcaagcttgtacaaccactctgaaactcagtgtggaagttcctcagaaaattggacatagtactaatggtagatccagcaatacctctcctggatatatacccagaagatggtccagctagtaagaaggacacatgctccactatgttcatagcagctctatttataatagccagaagctggaaagaatccagatgtccctcaacagaggaatggatacagaaaatgtggaacatttacacaatggagcactactcatctattaaaaaacaatgaatttatgaaattcttgggttaatggatggatctggaggatatcatcctgagtgacataacccaatcacataagaagtcacttgatatgcacttgctgataagtggatattagtccagaaacctagaatacccaagatacaacttccataacctaagaaaatcaagaaggaagaccaatgtgtggctacttcattcttccctatgaaaaaaatatccatggaaggagtagcagagacaaagtttggagctaagatgaaaggatggaccatccagggactgccccacccaggggtctatcccataatcagctaccaaacgcagacactattgcatatgccagcaaggttttgctgaaaggaccctgatatagctatcttgtgtgaggctattccagtgcctggcaaatacagaagtggatgctcacagtcatcgataggatggaacacagggccccccaatgtaggagctagagaaagtacccaagagatggaaggatctggaaccctataggaggaacaacaatatgaaataaccagtacccccagagctcatgcctctagctgccaatgtagcagaagatggcctagtcagccatcattgggaagagaggccccttggtctagcaaactttatatgccccagtacaggggaacaccagagctaagaagtggggtgaatgggtacaggagcagggcatggggatggtataggggacttttgggatagcatttgaaatgtaaatgaagaagatacctaataaaaattttaaaaaagaaatatatatgtatgtacaaaataactgactaaagactaaatactcaatttaatatggggaaaaatgtacccctgcttctgcttgcttgtagaaatgttagtttatatatgtacatacacatgaattcaatcattttatgaagctgagccccactaattttctatagcttattcacacatgaaaaactatcattcatatatgtgtttaaacttatgtatactgtgcagttaatcaacttggaaagatggagataatattttcattttaaccacttcataaatttgaagcttatcaataacttcttgtgtttactataactttacaactggccatgaatgagagacaagcagttaaattgctatctctgtgcatttgttgtaatattaagtaaaatcctaatctttgtcaagcagagtaagccaaattgagtctatcatagtacagtcacaatttttaaacatgcttggaattctgtgatgtgctaaagaaagaacatatggaaatgtctttctctaaggtaccagtgagtatggtatgtatattgcagtgtgcctactggcaccattgcaagttcagcaccctgggaaaggcaatgctttcaaacacgaataattgatgaattgtatgtaatatgcaaatgtgaatgcataaatctcctgaatgacagcttaatttatgtgcgcttttaagaatgtgggattagattttaattaaatatcttcaaaggcatcctgacttattctggttttgggcttctgtctttagaaagtagcatgtgaaggtttaaatcataatttttacatacactgtccatattttttgtacaatctggccattgttttatagtaaaataaaggtatttaaaggaaaagacatttgtatttaattatgtatacaatgatctttaattacaattgttgaaggttgtcatatatgatagatggatataggaaaaatatgtagtttgaaaatagattacttgcattttatgtataatttttcattttttagcaattactctaacttttatgtcaaattaaataatggtaattcctctaagtatttcttagtacacactgttagtatgataatcctgccttcaatgttcaaattattactttgctatgaattcaaatagtccctggagatagaacagtttccctggttctttcccttagatgtattttgtgaatatatgtagctctctgtgtatacaatggtatctcaaataacaaagtgtgtagataagaataaaaaattttaagtttaggattatgaaatttatagctactctgttaatcatcatatttattcaaatagtagatttaaagcaaatgaattttaattgactatataaaatatgtggcttattatttttaaaacattattcactctacctacagtatatgatagtcatatttcctataagtgtaatataaaaggatactttattattatgcataatgccaggcttatatacatttgttttttcctccatatttatttgctcttggttcaagattttaatgttggcctcaacaaagtaactatgtatatctcttttcttaaatatgtttctcctgtggtatatttttatagtggttctctgcatgaattcaggactcatctttcatccacttcaccaactcccaactctctacttactatgtgacttcacacaaaccatttaaatgtgccaatttctgggttatctgaattaaataatttaatatgaagtgttatgaagagtacctttttcttgaaccaaattgttctcattcatctctgttgtatgtgtttgttaagtgatttttcctggaagaaatgaataaaggtctgctttttccatattgaagacccatggcaggccagagaaacaattctactgaagtttagtgtttattaatattattttcagaagaatgggggaccctaaaactgctgaattacagaaatatctacttgagcatggatgatctgttataaaagtttcatcactggaggatcctgcacagttttcaagaagttcagctggtcagagagtttcttctcagaaaatattagtttatatgtatatgcataggggccttgtcagtcttgtaagcaccaggaacttcttgaactttgttagttttattcactttctgagtttcataagaacccctttcatccctctgcaaagaaattttaagtagagatgaaatagctaagccgccccttacctctctgtcttatatctttttcttctctctctctctctctctctctctctctctctctctctctctctctctctctctctctctctctcggttttttgagacagggtttctctgtatagccctggctgtcctggaactcactttgtagacaggctggcctcgaacttcgaaatctgcctccggagtgctgggattaaaggtgtgtgccaccacacccagctttctactttctctttgatcatgttccatgattcatagagcaggtgatggagatgtctgattgtttttccatatatggctgagcaatgggagaaaatgacacagcaacatttttttattttttcctgaggagcttgacttcttatacattgtttcagaacaccttccactggaaataagggtggcatcagtagtcatatatagacataaacagaaatgtttagaagtcagtttgatatgcatatcacattcattgcaaaaaaaagtatcctccatggacattcccagtgcttacagtaccaaatgagagttctctattgtagagtgggtcttcaattttactaaaaatctattaggtatagttataatagtcatgctactgtgcacaagtgtgcagaacttgcctgtcatattaatattatagcatgcatgtaccacagccaaggaggactcttaatgacaattttccccctaacaactcacatgacatcacatgagcaaacaaacccaaccaacaaggaaggagtttccagttcaactcagcttatagtcaaagtgttcagtgttttcagcagcagggtatgcagccaccagcagtgacaataacctttatgattcatatgtcaggattttaaggtatatctggcaggaccagatacttttttttttgtcaacttgacattaatttgtgttatcttgaaagtgggaacccttggttaagaaaatgttttctaagtttctgggctaatgtccatttatcagttagtacatatcatgtgagtacttttgtgattgtgttacctcactcaggatgatgccctccaggcccattcatttgcctaggaatttcataaattcattatttttaatagctgagtagtattccattgtgtaaatgtatcacattttctgtatccattcctctgttgagggaaatctgggttctttccagcttctggctattataaataaggctgctatgaacatagtggagcatgtgtccttcttaccagttgggacatcttctggatatatgcccaggagaagtattgcagaatcctccagcagtactatgtccaattttctgaggaactgccatactgatttccagagtggttatacaagcttgcaatcccaccagatacaatttgcaaaacacatgaaactcaagaatgaagaccaaaatgtggacactttgccccttcttagaactgggaacagaatacccatggaaggagttacagagacaaagtttggagctgagacaaaaggatggactatctagagactgccatacccagggatccatcccataatcagcctccaaatgctgacaccattgcataaactagcaagattttgctgaaaggacccagatatagctgactcttgtgaggctatgccagggcctagcaaacacagaagtggatgctcacagtcagctattggatggatcgcagggcccccaatggaggagctagagaaaatacccaaggacctgaagggatctgcaaccctataggtggaacaacaatataaactaaccagtacccccggagcttgtgtttctagctgcatacgtatcagaagatggcctagtcggccatcatcggaaaaagaggcccattggtcttgaaaactttatatgcctcagtaaaggggaatgccagggccaagaagtgggagtgggtgggtaggggagttggggggagggtatgggggacttttgggatagcattggaaatgtaaatgaagaaattacctaattaaaaaaaaaaagaaaatgtcttcatgaaattgtccagtaagcaaatcaagttctttctgaaatgacatcagaaactcagttgtatgttttctggctcatgccaaagaccatgtaagtaatgttacagctcacttaggatcccatgatatgttttgatttcagggaatagaatatattgggcgtcttcttcataccctttatggcaacctctatcaagaaggcatggtataccaactatagcaagtaggtgaagataaatagtcacactgggactcccctaagggtcctacattatcagccagatctgctatggttccatgtcccataactcatgacagagagcatgcatcagtcacttaaggcaggaagtgaattatcccatatcacattgaaaaaggtagctacatagaagttggtcctatgatcttgccatcatcacaaaaccttaaaatacaggtttcagtgtccattatggtgacagtgcgatgcacccattcaactccaattcattttgattccttaggtccctgtttagtatttaaaaaacagtctactatggatatgtaaataaaatctattaattcaaagtaggacactggcaacagaccaaagtaatggactcactcaagtctagctttatcaactactggttttattggtgttctttacaggtgactgagaggcacagaaaagcatactattttacgagtaccatgaaaactgcatcccttgagctcactgcatgacttgcaggcagcttctttggtgagatcctcctctgcctagcaattatttctgcttacatacatttaaagtagtagttagcaattttgtaagtttcagcagcttgctgagccttgcaagtttcctttgctctctgcttctcataagccttgcttccaaattggaggaaggaatatctgaatctagaaacaagaaatatttgaatctagaaacaagaaatagctataggttactatcacagcctcagttttgtttaaaggcctgctttcctacctactggcttcagaataatttcatttccatctgtatagttgtatgtctataaaacaagctcatggtaggttaccttgtactttatttatttatttatttatttatttattttacttcacacttaagtaagtgaaatttatagttcacttgcttggtttctttcaagtatgttgattaaaaaattattcctagtgttgaatccctagatctcatatctgtaaccttgtctaggcttgctacattacagagatgaaggataatacttcaagtgagatagccataaaccccccttcccttttcaatctatgtttatgctgcttgttatagttgggattgttttctccattctgaagagatacttttctgtttgtccgaacttaagtaagatcatttctctcctgcaaaataaattaagaagatagagttggtagggtgaaacaaaagagagctacaatcctggatatgtactggctaactttcagaaagtgagcttctttcatgcgtattttctcattttaaagactggatcataataatcatcttaaggaactatttagagaattaaaggatgattatgtaaacctagcattgtgtttgacacacagtaagcattaatctacccctatatttccttctctttaatcatgcagcagcagtaacaaaagccataataatggactatacagtggaattaaagcccatctttcattgagatctgaaagtggaggagaaatgaaagtttttttccagaagtagcatgggactaagtttcctaatttcttctctgaatgggccaggatatatagacatctaattttaacatataatattattttaaaggaaatgaaaagaactgaaatcaggatacatctgtttgctttttttttttcaaaagcatagaaagtgtctgaacataaactctcaagttgttcctgatttgatagcagaatacaaattccatttaactggatacattgaattagtcactttaatatttttttagctatggagagtttaattctgacaacagcctttgtctcttcaaaatggggaagcaagcatactgtattaaatgctataacagaaaatgtagtagaatcaaaggtgaaatcagtaagccctacacagcaatggacatgaggatcaacatggagaggaactcttatagagcaattggctcactatttacaaaaatgtacattaatataaatatttattagttgtattaattttaaaaatagccttttgtagatggaattcatatactcaaactattttagcttcagtaaattctacatattttacaagttgtacattttatatccattttagtgataatttatccaaattaattcaatgaccagtaataaacactatcataattatagtcacacttattaactgtatgtattccagaaaattacattatttatttgtaaagacaaaagaaacaaaaaacctttctccatggaataagtaattacaaagaagtaaaacttaaaagaatttatttttataaatttattttttcatattcatatttattgatttttttctaagcaacagaaatgctttaaaatatttttcaagtctccatcgatagagttagtaaacattctgatatattttatagaaaatactatagtgacaatcatgattagaaaatgtactgtattaaatgggataataaatattatatataagatgttttgaagatcagagttaatatagttaaccacaatgtgttatgcatttaaaggtttcttagtttgtgaggtaagatatcaaatagcttgtttaaaacattctccaatataaaaaaagtaaaatcatttgttgtattccaaaaatttagacaatcattatgtatcaaactcaaggaaataaatcagtagatgtacattatagattgcatcactttaccagttatattttagcctaaactaattttgctcttatgcttttattttcttcaaataaatagacttccttctattatcttctaaatttccactgcaccttgcttgtactttgaattttgaaagctacattgttgttgacagtacaaagctgcttttgttgatagaattttcgagactctctatgcctgttctttaaaattattttgaatttttacttaccatgaagccttaaaggaaatagactagaaaattactagaaaataaccgctttggacaacaagactatttactgtcattaatgtttatttaagaaaaatccagaaagtcacagtaccctttagagtgaacactaaccttgtcttccagggttgagtaccaaaagcatccacttgtgtttttattcattttgaaatatgcttcatgtctatatattttaatttgtgaactgattatattttgcatgttgcaaaatggagacagggttgttttttgttcttttcttccattttagaaggaatatcaagtattgctatcctttatttgcattttgggacattttaaaagtaattataaggaaaatgtgttatgtgtcactgcaaaaataaagcaagtatagggtaatttaatacagtgtcacaatgaagccatgaggataatttctgctactgggcttttcgcttcaggctattagagattttagaagtgtatacagtcattgctcttgtaacctggaatcaatttagtaagtagtactcaaaaatagaaacatgatagtcaggtagtctgatttgacctggataacagttccaagaaatgcatttttgggtagtagaaacagatgctatttaagtttgttttattttagtagaatcaggccaaacagatatcttagtcttattgagttattatctagatttcatcaagctatgttctagttagattactgtttagtaattcacagttctctgtggtttaaaagttagcccctttaattcagaatgtctagtctttaattcagaatgcctaggttaagacatgggaagttgacattttattttaaaagcttgacaggaaattctgctgtgtggtttgagaatttcccagttacttttctttgtatagcaatctgtctttatttcccacaatctgcaggttaaacctagcttcccagtgtgagaccactaattgagtggtgatatgttgtaaacttcagaacactatgcttcaaaacttttgaagagtattatagttctcctatgcaagtaggcagctcctttcaatagatgtgtgtgtggattcatcagtattattttctgtgactggatttaataaaccactagcaaaagacatgaaaatttacctagctatctgaaaaaagatcctgtgaatttctttatatcatgcaccctgtaattagaattttttcaattaattgcacattaaaattaaactatactctataacaagaaagccaatgtatcttcttgctacttgctatatgtaatgctttttaatatagatgctttagttgcacaaagccactgtataagacatttcttaatacagtagctgagtttcttaattgtgtttaggtgtagcacatttaccatctcaggaagctaaatctacttatttaagggagttttcagatgcaaagaacccccaatacctttatatatcatcacccatgcacaatgatgttagtaatactgactataatcaatattgaaataaaattaaaaatatttgattcaacaaaatatttgcctctgtatgaaaaagaaattaacctttattttggcagcaagcatttccaaaggaagcaaatgtttaatcactgtagccaaaataaatgttttcttttaggctcttaaggcagccaaatgttttcatagcattttaaaaatgtttccaccctttattttttacacagaaaatctctcttcttcccacctatcaccctatggaaatatttttgtggacgtatttggccatgaaaacagcaaaaaagttttaaaagtgttgcatttataagtcgtgaaaggatactctcaatgttaaaacaaaaaaatgagtcttgatggtgcaatttgaagaaaaatataagcaatagaactaagtcctattcttaattgtagatgatattttaaatggtaactttacttttaaaaacatttttattgtattaatgaataagatgcagttatactcaatgtcctctaatctgtattttacattttctttgcatataataatacttatataatgagtacatgacatttaacatcaaaatatcctcctctccctacacacacacatacatacacacctgtgcatacacacttacacacacatacacacacacaagcagtttggtattgcattttgttttggaacacaatcttactatgtagtacagagcagcctaaaactctctgtagtccttttgcttcaaactcttgcatatgagaattttagactgactgagacatagcacccctatattctatatactttaacttcttgttgtagtaagaacacttaatttcatgaatctttactcgtgtgtatgtggtatatgtgttttatgtctgatgcatgactgtatatccacccctgcctttgtatccaatgaatctgttggatgtcttttctatactattacgatccttaagacaggagctaagacgaaatgatggaccatccagagacttccccacccaggggtccatcccataatcagacactattgcatatgccagcaagattttgctgaaaggaccctgatatagctgtctcatgtgaggctattccagggcctgtcaaatacagaagtggatgctcacagtcatctattgtatgaaacacagggcccccaatgtaggagctagagagagcacccaaggagctgaaagggtctgcaaccctatacatggaacatcatcattgggaagagaggcgccccttggtcttgcaaactttatatgtcccagtacaggggaatgccagggccaagaagtgggagtgggtggttaagggagcagggcgtggggagggtataggggacttttgggatagcatttgaaatgtaaatgaagaaaatatctaataaaaaaaataataaaaaaagacagggtctttccttgaacctgaaacttaccattttggctaggttggctaatctaaagttctcatgttctacctgtctctgtcttcaaattttggagttagaggcacacaattggcttttcatatgttccaggaacataactagctttttatgtggtaatgataacttaaatatagatacttatgtttgcaaagggtttgcagtaccccacaccttctcatgaaatttcaaataggtattatgctaaccatgtatatatatatatgtatatatccagagagcttagttaatttatatagctaaaactatctcctattaaataactttccatttcctcttatccatagcctttgtaagtcaccattctactctactcagtgattatttctttggttattttgataactcatggaaatggaataatagagtaagtttctataatgtgcttaatgttcatgcaaggtgtttttattctagatcaaaggcaactcatatcataattttagttttattaatgacacattctcttatttgtgctttgttttaatatgaagtgaaacacaaatgaaacaaagatctttctaaaattgggttaggttttggcagtaatacatattttccagcagttgtatatggatccaaactttttttttaactatagcacagttacatccaaaactcatctaaagtcttccttgtctcagttttccatactaaagaataaagtatcctggaatgactgagttgaatttaagaatgacagaaaaaaagcaaatataattagcaattcaaatataaatgacattcttctcctctacttgcatttactgtttctaattattagttagaattaggctttcttaaggagctttacccaaactgcattgataagatgttgcaatagaatgtgaagcccattatgcaccataccaacatgcaagaaaaaaatcctgaaacagtgaagaccttcagtttaactcttctgtaattatgctactaacaattgttgcaatattattaatcatcattattaaagatatcgtgccaggtgattatgtttccctctttatctctcactttcaccttcacgattatacagtacctgtgtgcatgtacatttgcatatttgttcctttacaatttagatgtcagtacttctagtttgttgattaggaatctgatatctagaatttaaatgatttctgtagtaacacagttgatacactagaaaataatggattcaaaactttatcgtatactaaagattttgcaactactatgtattattttttcttaaaaattacataaagtaaaaccctttatgttagtaatacaagagattggtcaagagtattaactgaacatttcttcagttcctagatatcacttagactgttcaattggagtagaatagaaggaaacttgattgccttgataaattatttatcccaaattgggccttaaattctcatggtcaatctaagagatggatttggagactgagaaattagaaagtcaaacggtacaggcaacttacaaatgtggcctaaatggagagtgcaggatctgtttggtttggatgtgatcatttatctctgactatttagaacacactggaacttctgtggctactagtgagcatataagaagtggtcagtaaaatacacctaagataatccacatacatggaatagagtcagaaccaaagcaatcagttgtcagacagaggcatttgtttgaattttaatttgatcataagaaccactcttgatttttaatttcttttaaattagaagacttcctgtctgaggaaattttataagtaataaattatatggacactttataggaccaaaattatgtattcttaaatgttttcctttattatgaatttataatataattacatcatctctcccctccttttcatcccttctttctttcaaatttgcacactttatattcattaattgttgttaaatccatatatatatatgtgtgtgtgtgtatgtatatatgtatgtatatatatgtatgtatgtatgtatgtatattcctaaatatagtctgctcattctgtataatattacatgtatatacaattctagcactgattatttggtattggattaccaattggtatgctctaggaaactatttcttccactctccttagctgtctgtctgtagactttttgtgtagggttgaggctcaggaaacatcaaggcagagagggctaaaagactaagagtttgaattccttttaatcatcaatgggtgatgtaaataaatagattcagttatattcaaagaatttgaaataatgttaggaaaatgaaataaaattcttattttgttctttttcttctctcataaattatatcctgactgcaactgcaatttgccctccttacattccttctagcctgctgacctctcccctaccccagattccctcctcctctgttttccttcaacaaacaaacaaacaaacaaaaacaaagaaaaggaagaggaagaggaggaagaggaaaaataagaggaggaagaagaaaaaggagaggaagaggaggaggaggggggagggggaggggagggggaggaggaggaggaggaggaggaggaggaggaggaggaggaggaggaggagaaggagaaggagaaggaggaggaggaggagaaggagaaggagaaggagaaggagaaggagaaggagaaggagaaggagaagaaggagaaggagaaggagaaggagaaggagaaggagaaggagaaggagaaggagaaggagaaggagaaggagaaggagaaggagaaagaggagggtagctttctcacacctaacaaaatacaagcctaggcacaaaccctgagtagtaattcaaatatgtcaaataaaattataataaatatcacattgtaggtgagtgaagcatgcaagaaacatgttacttcagaactgatttgatactgcaattccttttattgaaaataaagtcagattttatagaggcattttctcaattaagatttccttttacagataactttaggttgaatatcaaggtgatctaagacagcagagttggtatagatgtttgcctatgagagcacaaggacttcaccttggatcttagaatctcagaacacacattcaaaatctagagacaattagtagtgtcttttttttttcccccgggacaaggtttttctgtgtagccctggctgtcctggccctcactctgcagaccaggctggtcatgaactcagaaatcctcctgcctctgcctcctgagtgcttggattaaaggtgagcaccaccacacccggctaatagtagtatcgtaatcactaggaagtttaagacagacacctccttggtcctcacagcccgtcaatgtagtctatttggcaagttctaggtcagtgagatattctttctcaaaagaaaatggttcatggaacttctggcctacacacacacacattagtaaatatatctaattagtaaattatatatatatatatatatacatatatatatacatatacatatacatatatatgtgtatatatatatacatatacatatacatatatatgtatatatatacatatgtaaaacatccacataagcatatggacacataaaaatgataataaaatgagacagtttaaaatgtttagatcatttgaaacattaactgccaacattgtgcattaattatgaatgtatatgcaggaagttcatttcttctgaattctacttctacttggatgccaaaaaatgaaattttggatcaaaaaatagccactttttaagtggaaatgaaagatttaattgcatagcatgtaaatgatttagcataggatttattgacatttgtgatatttaataatctgagaaggaaaatttatcatactttagaaagtaaataagtgaaagattctgaaatgacaagttacagctaaattcttcataaactatttcaagtggttacctaccccaagatacaaaagacaggaataattgacccctgtataggcaaataactccactatgatataaccaaaatatcctgtaatgggcctggcaggtggttcaccatgtgaggttacttggcgccaaccttgatgacttgagttcaatctctggtaaaaggagagaacatactttatgaagtgcacagtgtggtacaggcaacatctcccacttaataactgtaagttttaaaaatgttatagtattaagtcatgagaaaaataaatcattcagaataatatcttcagataaacaaatatagttgtccagaaaggttaaataatttctgaaagattgtagagataatatgttccaaatttgctataaaaatcttatatctgtgtgatcaattttataacttctaaatgtttttcatatactttgctacgtagtcatttttcatagctagattatgttaaaatgtgatgctttataatatatcagtaaacttttcactgcaatattttattataatttcataaaaatggaaattagtgaactctaaacaagcacttgttttcagaaaacaggaccgcatgatttgctggtgatagtaaatatttggtaatggatggagatggtgtatagccctgatatgtaatgctactggtttccatggtgtcaatactttaaccttagctaatttcaaaataccactaagaggttcttaatatttacattgggaagggatacacacaattagtggttgtaaatagatataacctgactcaagtatgttataaattcacaaaataaatgatgcataaccagctaaagtgatgagaataagagactggatgctctgctctcaaggaaatctatatcactctagccaaagctcagggaaaattgaagaagtggaaagaatcagtgagttggaagatggaaggggtgttttatgatcaggacaatataaatgcatacatgaaattatggcagccatgattacctacacacacacacacacacacacacacaaagttagacaaagtgcaagcttagatggagtagatattgtccaggcctcattcttacagaggagcttttaacagtggatagttagtagggaagaagaatcaatgttttggaagatgaggccaaatgtagcttccccatgctccagtggatagccccatactgattcacacatagggaacatttattggacttaataagttatcaaaattttttaaaaagtagttaagaagatggggtagtcatgtaggaagatagagagaaatttataggtgataaatatggtatagcaatgtcctatttcattgtacacatgcttgtagtcctcaaaaataaaggaatgtttgtatgtttctgtatatgtaaccattttcttcaagcactaaactgccactttgaattatagttgtttattcaaaggagtatatatagttttacactagtcagtaggaaaataatcaaaacaaaagaaaaggaacttcatgacaacacatttagctagcttgagacaaaatccccatgcttttgactttgatcttagatcctaagtaatacagcacatctcctaaatgaatgtatttacccacactctacactcctagtccctccttcaaggaataaaattgtacaaaagattgctgatttaggcagaatttttggaaaataaactatagtcttctagcataatgtttcagaggacagaggacggaaacatcttgtattcattgcaatttatgtggaacacaacttacttagactttctgtggtactcttagtcagaggtaattaaccaccaattttagagcaccaacaattgccaatgttaatgtttaattagcgaaagggaagcacctgtagtgtggaggaagaggctccaagattagactatacacattcaggttgcaacaaaaaagaaattaaatgagcgtacttatcttcgggggaatacagttactaaattattagatagcgtcaacttacaggaagtaaaattagtaagcaaccttttgcatatataattcattattggctttttaccaataagcttcaataagtgtttgttagctttcctgtccatttagcacaaagggaagttagttgttcttgggacaattaaatagatctatgacagatttagctgaatatgtcatcctttctacttgacatgttgcctctcaaaaaaaaaaaaaaacctggcccatatttttattttttcatatttccgagttcatctggggaagactattctgaacgctttctcacaacagtaactttcctgccattttaacatttataattatctttttgtgaaaagataaaaagatttaaaatgattgttcttggcagtgggcctaaggtgaaactctgttgtatttaatgtgtaaattataatgtgtgcagatgtgaagagggattttgtgaaatgctcatttaaccacaagaatttaaaggaaaatgtcagagagtttgtactctttcgcagtgaataatcattgcaaagcacctcataatatgttatatacaaagggtaaatgaatagtttaggttaaattcaaccaatatctttctagaagacaggaagataaagggaacagtagcttgtcagcaagaatttagcaaaaagcaaaccctttcctttctgattgttactttggaagatatttgaaataaataattttcatgtatctgaaggtaaattgagaattgtcttgctcatcaacgggcctcacatccccttcttttcaagctgaattcatttaatgctttcctgatcaaatgcatgtgtagtagaatcctagcatctaactaggaaactaaaagaagacatctttaagtttttgcatcttgtcaattaaaaataaatgttcctttcctaaatttagattgtaaaaatattcagtgtgcttctcttctgttgtaccgattaataacattgccacctgcttattctgctcctttaagctagttaggggacagtacttagcagtcattaaatttggcttatattatacatctagaactccaaaatgggagaagattattcagttaagagagctggctgctcttccagaggatccaggcttttattcctagtgcccacatggcaactcataaacatctgtaacaggaaaaataagggctatggtaccttcttctggcctctgtgggcactgcatgcatgtgatacacatttatgcatgcaggcaatacgcccatacacataaaatataataaatatttaaaaaaaaccaaaaggggattggcaaaagtgcttcaactagaaaagaactaagtatttggggaagaaaattcaatagttttcttatcttctctccctccctccttccctccctccttccttcttccttacctcagcctctccctgcatttctccattctctcattttctggtgaggtttcatttcttctaggcaataatttgggtaaagccacacaataagcaatgcttaaatagaaagatacaccatcagcaatacatttatcctctgtgtaagtagctgtactctactgattatatatattgtaataggtagggtattacaaactatccactttactatgatgatgagaggaattaattacattaaaattatgactgaaatgatgaaagtgctataaaaattcaggaaagcccagcagccctgaagatggaaagtgttattgtgaagatttttactgaggaggagggatcatttcaccatccatgttatacttttctaacatattttagggcctaaatgcaattttcattatagttatttaaacttactttttcacactttctgacttttactcaacacccttgccacccctcattatcccttctctttgataataaccattccaacctgtgtgaaataatatctcattctaactgtttttcctctgactattcaagatcggtaagaatatttttcatatacttattagagaatttcttattttctattaaaatttttttctgtatagaatcatatctactacagttgtcttcttgttgtttgattgtttgagttccatataaatcatattctatttatatgattcatagttttaaagaaatttatccaactctgtgggtaatacatatatatctcctgatatatgttttgagcatctttgttagtgtaaatatgtttatatatttcttggctttctttgtattggtaaaagtgtctgtatttatgaaagtacccataatactttgaattctgtagattcacaacacactttaaagtaaaataatgtgacactcatttttttttttggcttaagacttgttttctttaattcattgacattatgatggggatttccttgatcacaataggtactgtgaacattttaaaactgctttcaactaataggttttattctctgaatgtttcataaatgtaatcaatgtagtttactatatatattcccacttcctttcctatctcccattaatgccttctatctcatctcccacacatctacatattttttacttttttagcttaagaaataagaatttattgtgtagctccagagaagtccaaaactgaagtattggtcaggattacagttagattcctttagggtgctggaagggaagatcagttacaggtctttctccatgcctcatgggtggcaatattcaatagtacatagtgtttttcctttatgtgctgagcatgtccccaggtattctccttttacaaggatgccatccatattgaagtggggtccatactagtgattcgatcaccactgtaaagacgccatctctaagcacgggcacatgcacaggttttgagattcaggacagcagcatctgaattttgagggttaagcagtgggatctactacaataaagaaatttattatcaattattagtatcagagttaacaatgagctacttgaaaaacaccagagaggatcaatggaactgaacaaaaacattgattatgacataagtatgtccttgatgttaacaaagatggcgaggcaaacacatagggaaggatagtcgttttagggtttatggtaacataataattgcacaaaattgttttgttttataatttctatagattaatataatgtactttgatcatatccaccaccctattagcatctcctcctccaaagttgtcaacaaacagacaaaaaaaaaaaacagttgaaaaagaaacacaaaaccagaaactgcctactctttacctaactcacacatatatataagtttatgttaaatatagtaccatcataaatctaagcaataaagccataagtgttttagaagtaaacatagagtgaaatactagatttgacaaaggctttaaaaaaaatatttcatttatttacttttttacactccagattttattcccccttcctgtctaccctctgactgttccacatcccatacctcatccccacccctgtctctataaggatgtttccacccctccccatccaaccagacctctaaactccctagggcctccagtctcttgatggttaggtgcatcttctctgattgaacccagacccagcagtcctctgctgtatatgtgttgggggcctcgtatcagctggtgtatgctgcctggttggtggtctagtgtttgagactgctggtcctcctacagggtcaccttcctccttagcttcttccagcctttccctaattcagccacaggggtcagcagcttctgtccattggttggatgcaaatatctgcacctgactctttcagctgcttgttgggttttctggggtgcagtcatgatagttccctttttgtgaacgctccacagcctcagtgttagatcttgggaccaccccttgggctggattctaatttgggcctgttgttggaccttcttttcctcaggcttctctccatttctatccctgcagttctgtcagacaggaacaagtatggattacagttttgactgtgggatggcaactcccttcctcacttgatgccctgtcttcctactggaggtgggctctataagttccctctccctactgttgagcagttcatccaaggtccctccctttgagtcctgagagtctctcactgctcaggtctctggtacactctggagggtctccctaccctcttccctcccaagatttctgctcccattctttcttctgacccttagggattcagtccttttacctcaccaacatgtcttttacttctattgttaataactccctgtgtataaaagagctgcctatgtgctcataagtatacagccccccacccccatctactggccataaggaacctacctagcatggctgttccaagagtcaacttatagcagctaaggttaccagcataaaatgaagccagtcaaatcctcctaaggattggggaggttgctctcaaggtcctgcccttatcagtggagagtatgctgctaaaggaaagttacccaagaaaaactaaagtacttaagaaaaacaacttagattggaaagatacattttatttcatagtttaatacatctcagatcactgtagttttgtttggcaaggcataacatcataacaggagatgcccccccaatgataatcaggaaggagagagggaaatataagtgggttggggagggaaaggtaaaatgaacaacatactccattgttctgggggcacactaacaatggcataatttttccaagagtactctgcctcctctgtttcataacttcttaatagtgccagtggctggaaataaagacattataggctctttgaagggacaactaatgtacaaattataatgtgttctgtctctgatattgtcctgttagattcttgtgaaagtcttatgtcctggtgaggctctgtttcagagttctctgatagtagcctaaatatttggtatgcttgtggttgtggttgcatacatgacaggaagttctcacactggatcattggatatttctctgagttgggtattacttatatatcatgaccatgatgggcagaaacgttttggtttttgtttgtttgtttgttttgagacagggtttctctgtatatctctggctgtcctgaaactcactttgtagaccaggctggcctggaactcagaaatctgcctgcctctgcctcccaagtgctgggattaaaggtgtgcgccaccagcgtccagcagatgggcagaaacttaaaaacaagtttgttttgagaccaccactgaaactgacatcctcaggtcaatctctgggttataaatagacaaagccacagtggttttatggttgaatagatcatagtattccattgcagttgtggaatgtagtagtttgttttgagggatgtttcaagatctacaatatggttgaggtcaaggatctatagggaattttatgaaagtacatgtctctaaatttctagtaggcagaaatactgtcctcctacaggaaatataggcagaacaaaaataaagtgatgttaaggatcttctggagatagtgtttggtttgtctgacactagttcccaggccacagctgagacatgctttagctgaacttttgggtaacttgtggtaacctgcttaacccatgtcagtaagaagtccttgtgtactaaggtatcaatgtatagggctgttccttgatttctaggtaaatgatatgttttctggggtcaagattaaaggaggctattgtcaagctattactggagaaaagggctatttctgggttgtatgcctgatgcataatttgtaggtctatcacataaatactttcaaaatgatatttctaggccataggttccacagagatgttaaaacctcttatatgatctctaggattctgaagatagtctttgtctttgtatgcaggtgaaagtgctgttgtgtgagatgggtcaagagagttatttataattttatgcattgaacatctttaatgaagtaaaatggacatgttttagaggataaaatcatagtgttgaacaatggatacagataacctgatagcattttacttctatttcaatacataactcgaagaacttccttgttgaaatatagtacataatcatttgaaattaggctgtgttaatggtccttcaaaattatgcatacataaacataaaacatgtatggatggggagctggtctcacttctttcttttagtactgggcttttgtctggcttgaaactgcaagccctgtgcacgcttccacagtctctctgtgttaatttgtgcatggtcttgtatctggaagacactgtatcttggattcattcatctacactgatccttaaaatctttctacatattcagtatagatccttgagccttgtgaggaggggttttataaagccataccatttaggactgagtgctccaaagtctctctcatatatattgttcatttgtaggcctctgtgtcaattgcaatctactgcaagaaacttcttggatgtaaattgagtgatgcacttatctacaagtatagaaatataattgaattcctatccatgggcatcaatataaagaacttaaatgttttcactttcctaaacaactaatttaccttcttatgaacatcttaagctggacgtggtggcacatgcctttaatcccagaacttgagaggcagaggcaggcaaatttctgagttcaaggccagcctggtctacagagtgagttgcaggacagccaggactgcacagagaaaccctgtcttgaaacccccccaaaaaaacaaaaacaaaaaacaaaaacaaaaaaaaacaccttaggttggacattaacattatgctggctgctttctttgattaaatttcatatttgttaaatatctagatcattgggggattacacagagaatggaaattgctgaagagactttatatgctcagtatgtaagactatattatcattagttttaatagactctttagtgctcattttaacatatcctttggaataaccattaactatgccctatatgttgatatgggctaacaggcagaggaaaagcatgaaagtaaacaaaacttaaaatagcagtcagcacagtagattatatgaacgcttcccaaggtagcagagtttaaaaacattggcctctgaaactaaaatcactatggcattttgcatagtgaaagagttcttctatcaaatactataattaaccgagtaaatacggtagtccagctggcatgctgccacatacttgtgatgccagaactgatatttacactttatttttatatgtcataactaaaaaaattagctcttgtagagcagacaaaatcatgatgaaagaaatatttcatcacagttcttggaacactttgctagactgtattaaaaaacaatgaatcaacctgtcatatgtagttagagcttgatgaagcaatgaagtcttgacctagagtgtcagaggtaactgaaaagagaagttagaatagcaataaaatatgtaacagtgaactacaaatactggagattggcaaggaaagacaacaagagaagactggagagtggagtttggggatggatgtgtagctcatcaaatgtaattgttcaaactcttgctagatgttttccacagttatgtacttagtgatgcctttatttttccaaagctatctgaaaccgatttgatatacattgggggagtcatttctttaatttgaaaccttctgaagtttgctaaggaacattgattctattgatgttactagtagctattcaagcggaatccgaagtacctccaaaaatttccactatatcttttgtttttttatactaaaacgttattactattaagtaaatgtatgacaaaacgacaaactctttgaaggatattaggaccaggcctagaatatattttgtttaagtagagaacagtctggtaaatgaagtataaaataacttcacagttataccttatattaagtaattagtcaacccttgagtttttaatgacatctgatttcttcttcagctaggctaagaacaaatatttaacattagcaaggggatgaaacatctcaatagtaaatagtaactataagcaattcaattcattacacttataatatgaatgcataaacatgaatttgtcccaagaaccttgatattatatgcattagcccttcaaactgtagattatcctttctcttttcagtatctttatgctaaaagtatttttccaaaagtttccaatgctaaaatacaatatccatttacaagtccacatttaccttttgggtgtgctttaaaaataccacaaatataatgaacaaatagtaattgctccttgtattaatagctctcagagatacttaagctaccatgaaccaagaactgcttgatgtccagtttcacataaacaccattttataagttaccatagtgacccctttctagttctgtacttgaaccatttcatttacgataaatattaaatattcatttttcatggagtacttttttcttaattgttgaataggttgctgattccattgatatagactggaatagaatctagtggaatgattagacaactgattagtttgctgtcactgagaaaggatgaattcaggttgctgacagaatttgtttttcttcataaacacggaaaggtcaggtagagtttaactaccattggtgtctttgatacattgtaataaatgtcaaccccaaatattaattcatgatgcaattaaaattcttagtgttccagcaagaaatatcctgacttagttaaacatgcacataggtaatcgttaacagtgctttaataggcaggcggacatcttcagagacattgtcagtttttattttgaacatttactataagataaaacattacacattcatgacactgtgataaagttttttaaatatcaataattctaaaaagtgaagactgagtcttgcattactacagacagaccccttttaaggaatttagttgaagtgttctcacgtgctgctagtaaatatacccttaactgtcagtaagtaaatctttggctgtttttttaagtctgtcacagaatgtagccttttttttttttaaggaatagtacaaatagttgactgacaaagatgatctaaccttatttatcatgaaattaattactgctcataaaatttatattaaataatgtaaaggttcaaggcatcatagatttatagtgttttctttatttcaaacaatgaaaccacgtgctctcacattactctttgattcataaatggatagttgtatgaaataaaaaagtttgaaagggaaatttcataatctcagtaggtaaagaatcagcttcaatgaacattacactggagacagatatggcacagaatgtcatatgttgctcctagaagacttattgaactttcttggagagctgccaacttacaaagtttataaggtgatagtgactctagttcaatcacagaagtatgaagtgctgttattattcatgtgatttaaaaaaaaacttacacattaagttctcctaaacagttttatcaaatgatgaaaaaaaaatctgtattaggataaattacttaaaaagatagacctgagtaaaatcaggacactgaaataatttaaacgtacataatgtttagatgttataagtggcattaattctataaaacagaatctcatagtttagctaaataatgtaggaatatcattgctatgttgtgggcttatctgacatgtttcttagcaacttctttttatgtagtatataaggttgacataccagcagagctatttgtgtaggaactttaaaggagggggtgtttcattttacacagtacaaataaccttgtaattaaactgaaacaaataattgccaagaagcaattatcattcaattaaagagtaattacatggttatttgtgccctgtaacgtaaagcattactgagatcagtaatgcaatcaatattttagtggaaacaggatgttgcaatgatggacctttcaacctatgctgattaaattgtcatccaaataacagttttctagttaaatcgccacatgtttatttgtcttgattaatatgtaaatatcttcctgatgataataaagctttttaagataagaagcatcacaggatcatctatcaagatgtgtgatcttttccagcttttacagaattctgcatactctttcatcattttctcagaattatcttggaaatgaaacataggaagtttagaagtactaaagtgtcactctatattgtaattcagtctgaagttataaataatatcaatattcatattctattgaatatttaatagaattttacaaatgatacattaattttactaacctaatttcaataactttattctaaggaacttaaatcttacaaaaatattaaagttgatatctgcatgggatttctgttcatatacttttaaatatgtctataaagagaaagcacatcaccatcctcattaaatagtgaataaaaatttaaattatagtcaaagtatatatttctgtcactagaatatacatttttcaaagacacaacttgttctgtgttttcacattatccaaatagtgaaatcataacaaataacctttttatcagcttacattttaacctatgaataacactaccatagtcagtgaatacctagtacttatgtatttactggattactggacaagtgatatggttacatatatatgtgattgcaggagcagttagctggtagtcaggtctttaagcttcttgtgtctctcaaagcataataaagtaatatctcccatatactttttgacaatatatggtcagatttgaataaatcataggctcatgcttatataattgcagtagagtgcaggatctgaaatacaataatttctgatgaataaattcatagaaatggccctctgttcattttattaagtagaaaataacattctaagaatatttggaaactgtagaaacagggaaataaatattttccatctgtcaacaaatacgtttaagcaactatttcctgggcttcctgcatgctacgaaccataggaattcttaaagatttggtgatctatagcactagccatgcatatgtgctcatgaaactcatgctctagtttgagtgactcacattcaatcatgtcaaaaggataaactagaaaattaaaagcataaaagaatggaggatttaatcccctgtaatttatatgtgttaaatgtgacaaaagccatagattctccagtatatatccatccaattttagaagtcaaagtgcaacctttaaaccacgtgttttctcaatttgtttgaagaacactgtttcaaataggaagaacacagagacaaagagagacagagacagacacacacccccacaaacacacacacacacactgaaaaacagttaagctatatagcttttaaagtctttgttaacagttggctgtcatatggcttaactttagaccaatttcccttacaaatatcgatgcaaaaatactcaataaaattctcgctaacagaatccaagaacacatcaaaacaatcatccatcctgaccaagtaggttttattccagggatgcagggatggtttaatatacggaaatccatcaacgaaatccattatataaacaaactcaaagacaaaaaccacatgatcatttcgttagacgcagagaaagattttgacaaaatccaacacccattcatgataaaagtcttggaaagaccaggaattcaaggcccatacctaaacatcataaaagcaatctacagcaaaccagtagccaacatcaaagtaaatggtgagaagctggaagcaatcccactaaaatcagggactagacaaagctgcccactttctccctacctattcaacattgtacttgaagttctagccagagcaattcaacaacaaaaggagatcaaggggatacaaattggaaaggaagaagtcaaaatatcactttttgcagatgatatgatagtttatacaagtgaccctaaaatttccaacagagaactcctaaacctgataaacagcttcggtgaagtggctggatataaaattaactcaaacaagtcaatggcctttctccacacaaaggattaacaggctgagaaggaaattagggaaacaacacccttctcaatagtcacaaataatataaaataccttggagtgactctaactaaggaagtgaaagaactgtatgaaaagaacttcaagtctctgaaaaaagaaattgaagaagatctcagaagatggaaagatctcccatgctcatggattggcaggatcaatatagtaaaaatggctatcttgccaaaagcaatctactgattcaatgcaattcccatcaaaattccaattcaattcttcaacaaatcagaaagagcaatctgcaaattcatctggaataacaaaaaaaaaaaaccctaggatagcaaaaactcttctcaaggataaaagaacctctggtggaatcaccatgcctgacctaaagctgtactacagagcaattgtgattaaaaactgcattgtactggtatagcgacagacaagtagaccagtggaatagaattgaagacccagaaatgaacccacacacctatggtcacttgatctttgacaagggagctaaaaccattcagtggaaaaaagacagcattttcaacaaatggtgctggcacaactggcggttaacatgtagaagaatgcaaatgtatccattcctatctccttgtactaaggtcaaatctaagtgaatcaaggaactccacataaaatcagagacactgaaacttatagaggagaaagtggggaaaagccttgaagatatggcaccgggaaaaattcctgaatagaacagcaatggcttgtgctgtaagatcaagaattgacaaatgggacctcataaaattgcaaagcttctgtaagacaaaggacaccgtcaataagacaaaaaggcaaccaacagactggaaaaggatctttacctatcctaaatcagataggggacttatatctaatatatataaagagctgaagaaggtggactccagaaaattagataaccccattaaaaaatggggctcagatcaaaacaaagaattctcatctgaggaatactgaatggctgagaagcacctgaaaaaatgttcagcatccttaatcatgtagtaaatgcaaatcaaaacagccctgagattccatctcacaccagtcagaacggttaagatcaaaaattcaggtgacagcagatgctggcaaggatgtgagagaaagaggaacactcctttattgttggtgggattgcaagcttttacaaccactctggaaatcagtctggcggttcctcagaaaattggacatagtactgccagaggatccacaatacctctcctgggcagagatgcccctcaacaatggaatggatacagaaaatgtggtatatttacacaatggagtactactcagctattaaaaagaatgaatttatgaaattcctagacaaatgaattgacctggagggcatcatcctgagtgaggtaacccaatcacaaaagaactcacatggtatgtacttactgataagtggatattagcccagaaacttagactacccaagatacaagatacaaagcacatgaaactcaagaagatcgaagatcaaagtgtggacactttgtacattcttagaattgagaacaattctgccattggcaggtggatccctgtcatatccagggatccacccataatcagcatccaaacgctgacaccattgcatacactagcaagattttatcgaaaggacccagatgtagctgtctcttgtgagactatgccggggcctagcaaacacagaagtggatgctcacagtcagctaatggatggatcacagggctcccaatggaggagctagagaaagtacccaaggagctaaagggatctgcaaccctataggtggaacagcattatgaactaaccagtaccccggagctcttgactctagctgcatatgtatcaaaagatggcctaatcggccatcactggaaagagaggcccattggacttgcaaactttatatgccccagtacaggggaacgccagggccaaaaagggggagtgggtgggtaggggagtgggggtgggtgggtatgggggacttttggtatagcattggaaatgtaaatgagctaaatacctaataaaaaatggaaaaaacaaagaattgagaacaaaacacccatggaaggagttacagagacaaagttttgagctgagacaaaaggatggaccatctagagactgccatatccggggatccatcccataatcagcttccaaatgctgacaccattgcatacactagcaagattttgctgaaaggaccctgatatagctgtctcttgtgaggctatgctggggtctaacaaacacagaagtggatgctcacagtcagctattggatggatcacagggcccccaatggaggagctagagaaaatacccaaggagctaaagggatctgcaaccctatacgtggtacaacaatatgaactaaccagtaccccccccccccgaagatcgtgtctctagctgcatatgtatcagaagagaggcccattggtcttgcaaactttatatgcctcaatacagggccaagaagtgggagtgggtgggtaggggattgggggggagggtatgttagactttcggtatagaattggaaatgtaaatgaggaaaaatacccaataaaaaattaaaaaaatagaagcatactttagctgactgtgtgagtagtgatacaggaacaaagcactgactcaggaggaaaatacaaagaataagtgtgtgagtttaagtaggaggcttgagatctgacaaaaacaagacacaatgaaacatttagaatgtttagatatagtgactattatttaacaaaatattttatcttctcatttttcctttattttaaaattagatattttctttatttacatttcaaatgttatccactttcctggcttcccctcaggaaaaaaacaaaaacaaaaacaaaaaaaactatcccatcccccctccctttgctcaccaacccacccactccagcttcctggtcctggcattcccttacattggggcatccagccttcacagtaccaagggcctcttctcccattggtccctccatgtgtactcttcggttggtggttgagtccctgggagctcttggggtactagttggttcatatttttgttcctcctatgaagctgcaaaccccttcagctccttgggtcctttttctagctcctccattgtgtaccctgtgctcagtcagtccaatggttgcctgagagcatccacctctgtatttatcaggcattggtagagcctctcaagagacagctatatcaggatgctgttagcaagcacttgtgggcattcgaaatagtgtctgggtttggtgattgtatataggatggatccccaggtgggaacagtctctggatgcttcagtctctgctccacattttgtctctatatctcctcccataggtattttgatcccacttctaagaagggccaaagtatccacactttggtctttcttcttattgagcttcatgtggtctgtgaattgtatcttgggtattctgaacttctaggctaatatccacttatcagtgagtgcatactgtgtgtgttcttttgtgattgggttacttaaatctgatagagggctaatatccaatatatacaaagaactccagagaaagaaagaaagaaacaaatatttatttctcttcagagatataaacaaataattctcaactaaggaatacagaatggctgaaaagcacctaaagaaatgttcaacatccttaatcatcaaagaaatgcaaatcaaaacaaccctgagattctacctcacaccagtcagaactgctaaggtcaaaagctcaggtgacagcagatgctggcaaggatgtgaaaaaagaggaacactcctccattgctggtgggattgcaagctggtactctggaaatcagtttgatggttcctcagaaaattggacataggaggatccagcaattcctctcctgggcatataccggagatgctccaacatgtaataaagacacacactccactatgttcacagcagcctcatttataatagccagaatctggaaaaagcccaggtgtccctcaagaaaagagtggatacaaaaaatgtggtatatttacataatggagtacttctcagctattaaaaacaatgaatttatgaaattcttaggcaaatggatggaactagaaaataatttaccttcaagtgataaatatttttcaatgatcttgggcacctaaagcatatttgatgtaaaaaaaaaaaaactcatttccttttctgtacccttaaatgatctaagaagatataaaatagggccaaggtaaaaacatttttttgctagattgatacagaatattaatgtttaatggcagaaaataacactagcacaatttgtgaaaaatgagagtggtaatagtactactgtgtaaaaattttttcgacctgtccttattggacagcagagtttcttttatatcgatagagtgagtgcatcactactgctaagttgataggatgtagttcagcttctatgtctttgtgaacaagaagccaattttgtggaaatgttgcctatctaaatgaaccacagactttttttaatgctcactatatttaacatagtattttacaacttttgtattaagcaaaagtcctttctttttttttataaaatacttttctattaaaaggaaataatggcatcttattcaagattaaaagtagtatgtgaaatattgggcctgcaagatggctcaatggataaaggtacttgttgataaacctaagagcctaagtccaatctcaaggaccaacactgtaaatggagagaagtgcttctccctagttctctgacatcgttaaacatgatctgacatgcaatactgccacagaactaaaaataaatataataaaatatatagtaacttgagaataactttattctaatattttattattcatatgtatgcaattttgtcaacctccaaattatgattttagaatactatataagggcatgaaatggtaaaaaacagatacacacatttgtattttattactgaaactatcatttatttattccccacccctttgtactcatgattaaactcaggactctgtgcattcagagcaagctttctaccacccaaatataaatgacagtttctgaaaatatcttttttgaactttgcactagagctaagaatgtgtgaatgtaacagttttcataaatgctttaagtgttgattcaactagaatatatgggcagcacaagttgcatttgatgggttcaaaccaaagatgataaaacgttgggtggatatggagagaggaagagatggaggaagggtgaatatgacacattatacaaatttctcagtggtccaataagattgtgtgaagaaatatttgatctgagaaaaagacagcctacatggcaaattttctttgtgtggtcactccaaaataggcagaaaaaaatgtaacatactaggaatgagtttccattgtttctcatggctttccagcagctgtggaaatgctaatgaccactatggtttatttcattactcacagctctgtacccatctcctctgctatggcaagtggaggcttacactgtctgattttgttccatctgagttctgtgactcattaactcagaccttaatagcatatattgatgtcagggatcacatggctttaagaacaggatatagtttatagattcttcacaacaggtggtttgttttgcaaagtactggcttacaaatgaaatgaaaacctagaatagaatttgattcttggcaactttaatattagccatgactaagttgtaaaatttgttgtaaactgttggttttccttattaacctatgaaactgcatagtctctaatacaatgctttatttattcttgacaattacataagatacagaaagcaaatgtatcaagtaatagtatttgagctttatctttgttttccaacagttcaaggcctggcaggccccctaagcgttctttgggagtattgcaagataatgcccgacttctgccccatgcagtcccaggcctcttatcaccaggactgatcactccaacaggtaatgcaatccatcagtcttgtctcttcttactgccaagagtctgaaacaaactaatattgatataagtgtcttttccatccaagcttttcaagctctactagaggttacattattgaattttttggagtattcatgcaaacacaatttttattttaacttcaattactaaaattaaaaggatatgattttctaaatgtcatatcctaatgtgaaatctctttcaatgtgtttattgagggctgggagtaaagatgtggaatgaacaagttagcgttatcggaaagcttcttgtgaggtgcttaccttatgcatctcaccaatatttgtttattctgttgtgagtatctctgtatattgtcagatactataccagcttaagaacctggaaagaaaatacgcatcctctgatgagcagtaatatattagtaagtaaacctgtgggtggtaattgtcctgaataatttttttggaactgtgaagtaagtaatactacccatttcatagattatcatagaactctctcaatactctaaaagtgctcatggttatacaagagtcttgaaaaattatcttaatcgttctctagtaaaaaataagatctttaaaactattatatcaagaaaaaataatgaaaagtcattatctatcattaacacaaatttataaaatacacatcttattttttccttagaaaaggaacaaatatatgagtactcctcttggttgtcctagaattaaggacaaaagatataatagtcatattggagcatggcagcggccataatacaactagatacacggagtcacaagctctcaaaggtgcaagcaaataaattaatttgttaaattaggtaatgatcagaagattgattctttagatctatttgtattttgtaggcttagtgtcagacatgtggagaatgaagggatgacactccaggcacatagaagcactgaagggataagaaagtgcttattgtgacagggaaatagcaatgaaattaaagagactaaagcagagatttgaggtggaaaatgtgtaactgatgtgctttgaatagaaaatgaaggaaataaattgcagcttgtgaaactagcatttgatttactaatttaaaccgtaggaccagatacttccaaaatatatttcaaaactttctttttcttttcattttttttctttttgtatgtagctcatatgaaattgtgaaaatagttcaggcttcacatttctgtggcagagactcatgtgctctaatacatagaattttacttttgttgaatcactttatttattagagtaaccatttactgaagaactgagttaagattttaaaatgaatggctgtaaagggtacataaaaatgaagctaatagtagaaattctgagcagttggctctattagaagtgagaaatatggggtatccgaactaagacataatcagttctgtggaaaagaagttccaaagtgatttattaataagaatttgttgttagataattgattagacgtagatatggagccagtaaagtctaagataatttgtgttctgttttagtgtcatcagctatatatatacatatatatatatagattcaggttttggcgaaaggacaatactttaatgactttaaatatttatatgccaattcttatattacaaaggttgtcgtgtacatatagccacatgtagatatataatagtttctggactgtatattaatactcaacagataatctgtatctggacttctagaaaacatcatgaaatgttgttcaatgttgagtaaacagtagtagtttatctattttggggaaatctctaatgagtattatggtcctagtatgtatgaggcattggtgctaaatgtttcatatatacttcatttcatctttgtagtaatctcatagaaagtgccttcatttttcaagtgatatgtggctcggtgagtttaattgttttaagccataaagtgaatggtagagttatgtttaaacatagctgttatttttcattaatccatttgtgtattccagttacatctcaatatttaacagctcctattcccagtccttcctcataaaaagccccctctcccatttactttacatctcaatcaccatccctcctgtctcctctcctccccttcccactctcacacctgtctcccccatcaccttccatttctccctggctatcagcctaccttggcatattcaatcactgcaggactagttgcatcctctcccaaggataccagacaaaccaacccagatatgcaaaacatgaaatttactgataataaaatggaatcttaattctgtagcatttgcctttcctagtggaagagaaaatagtttgcatagttcaaaataagatataatctgcaaattgttcatacttgacttcataaaacattttttaacttcagcatatgaaataatatatgcatggttttgcctactttcagatattgtaatttttattatttttcctttaaatttgtataaagtagttactcagtaaaaatactagcaaaattaagaaatttctaagacatcattggtaggtttacttaaaaatagtccttgaacttagcttgccatgtagatcttaaagatgggcatgacataatttaagctttacttatataataggaggtaaatattttctattgtgtatgaatatctttggtttttgtgatttatacttttcctttaatttcaaagatgtttattcctctgggttaaattttcccccacaggaatgttgattaatttaaactttaacttgctcagattttatactcatttaggtaacaactacactgaggtgtctattactaataaaaataccttgttaccaaattgagtatttaaacagaaatttttgtgagtgggagagaatgtgtgtagagatattacagtacttagacttcagcttgacactaaaaaatatatctgtagtttccacatttgtgaactggcgacaaatatcctgatttgaggctacagagtaactttcttgccaccttaggctatttaaatagattctttctaaaactgtacttaagtaaaattattagcctttaattactaaagtctggtctttgttcataaacagaatcaaagatctattctttacaatgatgtcatatatttatttctataatataactatagctacataaacataaaagtatatatatatgtatatatatatagagagagagagagagagaaagaaagaaagaaagaaagaaagaaagaaagaaagaaagaaagaaagaaagaaagaaaaatatatgcttttatttcattgaacatatgtttatggaataatttcttctgtagtaaaacattacaagataatataacactaaaatacattttgagaattataattttctcaaattccacctagatatattccctagtgatctttgaatgaagatgttagatcatactttagtttcatgtaattgaacttatgatattatcatactgtatatattttatatgttttgttaatttttagtttttatccactttacatcctgatcacactcctcactcctcctttcccagttcccccttatacaaatccccagctatagctccctttcttttccttcagagaacagggagccctccttgtctactacccaactctgggacatctagtctcagcaggactaggcacctcctttcctactgaggcccaaccataaagtccaagtagagtaagggtatctaatctcatgtaacagaacctgagacaggccctgctccactttttaggggaaccacatgaagacctaactacaagtttgctacaaatatgtaggggacctatgttcagacactgcaagctccttagttagtggccctgtctctgtgagtgcacatggacccaggttagttgactctgcatcttcttgtggtgaccttgacccctttgacttgctcacttttatccccttctcttctacaagactccctgagctccctgtgatgtttgactgtggaactctgcatctgcctccatcttactcttctgtgatcaatatcttagtccccagacaagagtattcatacaagtaactttttttcttgtaatatacaagagtgaaaaagaaaaacaatctcttttgcatctcttgatctatgtaacttgcaatttactggaagatgtctactctcttctccacagattataaagtctttcaaaaggaccgatgtggaaacaggcctgagcgtgctttaaactagtagattacaaggaagtaataaaataattctgatgaaatcttgtagtattcactcctgaaatggtggtcaaatctttagtttgcttgattgttttccatcttggtatattgtgacaaagtattttttgaatatcacctgccatccaaatccccatgaaattaattccacaaaaaaacccccagacatttgaataatcaactcaaggcagaagaattatgactggttttgattgcatggtgtcattttcattttctaattacatcattgggatgaatattgctcatttttaatgatgcattgtatttttgcacttaagtttagaatctaagaatcagtcataaagatatgtctcatagtattctgaatactaaaagacaagtgtaaatagagtctagacaaactaagcccataattgtgatgtgatgactgatttttaaaacatattttgaaaaaattgtatatttatattagatttttcaataaatgatattataaaacattaaatactttcccttatctagctgcaatttctttatatgttctgtgtttgagaataactattggcctagcaagaggactacctccaattattaatttttattttttatttttggttttttgagacagagtttctctgtatagccctggttgtcctggaactcactaattaatttttaaatagtaattatattaattctttgacaatgttatatgatgtattttggacacagtagttccctacattaacctatatagatggactcccaccgatttacctatcaaagtttatgccccctcctccttttttttttccaaatgtatcaagtccatttatattaacctgggtatgagaaatgccctgaaatgtagttagcattccaagtgtcccatcattgcaattatcagacacagacaattcttctcctatcagcaatcaattgcttgaaactgcagctaggagtgggagtttgtgtatacttctcattcttcattctgtggtttttgtcttgctagagcttgtgcatctcttatgcatactgtctcaatcactgtaaattcatgtgtctatctgccttattttggcaggaaatagccccctggcagttatccactacttctaatcctatatgattgcacattttccagtttcttctttctctaagatccttgagctttgaggagaggggtgtgatgtagctggttcagaggtgattcatgattcgtctggtattccaaatgaaatagtattctaaaagtttaaattaggagaaacatgaaatgtttgtcttctgtggtttgggtgccctcactaaggatgtttgtttccagttatatccattttactgtaaattttctaatttcatttttcttaatagcttaaaatattcaatagtataaatatactatgttttattgtacattcattagtttgcagaatttaggttgtttctgttccatgaatattgtgaagagtgaagcaacaaccatggataatcaagtttctttgtagtaatgtgtagagtcttttgggaagatatccaaaggtaatataactggtaggtatattttctgccttatgaggaacagctaacaccaatgtgtgtgtgtgtgtgtgtgtgtgtgtgtgtgtgtgtgtgtgtgactgtgtgtgtcatcttgactgaagtaagatgaaatcctcaagatagtttttatttgaattttcctgatggctaaggatgttgaacattttaaaaatatttatcaattatttatataaactctttctagttctatgctccatttaaattgcattatttgttttgttgaattctttgtatattctagagcctaagcctctgtcagatatatagttggcagttattttttttccacattctacagtctatctcttcactagaatgagagtgtccttggatgtacggaagcatttcagtttcacagattcccatttgtcaattcttgattcagtgactgtgtgctcagggtcctttactggaccagtgaagtaaagagtactctttgttttaaggttgtgtgtttaattgtgaattttaatttactgtaggatgttggcaataggatgggtttctagtttttttctactcaataacaggcttaaatatccctgaatcatagtaatggataggctgttttctgttttgtttctcaattttcattttctctgtaatggttcaatggatttttaaaatgggtagcatagcattttaacctaaaataacaaatttgaagcttttggcaatatttttgcctatttgtggatagcacatagaacaaaaaacatagttttttttaaaagtatagtgaacaggaaattaaatacaacttacattatgttgttgtagatgatcatcaagattattataacaagattatgatgattatgtgctaacatataacaataatctctgtagtactttataaacatcctcacatctttatgttccattttaaacacagacaagcacatagataaattttatctttcaaaagaagtgttttaaattattgtttaatactcttcatgtaggagattggcattattgattattattattgattattatcactgtgttgctgaagatctagtccaggcctttgcacataattagaaggcaatctaccaatatgtccatcacatttctgcagttaacattgtcattatttgtaagtaatgagcaaagaaaatgaatttttatgaagctcattaacatgccctaaatcactgaaattataagacatagagtaactatttaaagcctagatttattctgttataaggttgatgccttttcaaataccttgaatgatctctttaaaaaaaatctttacttcaaaattttcaattataaaatctaagggtcatactaaaacaagttcctcttcctcttcctcctcctcctcctcctcctccttctcttctacttacatacaagtgatctaatatcctagaaacaatatagctaattaattgctgatgatcatatgttcattatactagaacattgtcatttgatttttgatgatcattgaattgggtcacagtgtttgatagcttctgtaaattagttgatgactaatactactgtatgtagatatattgttttttcatgatgaatttctgcttttctgaaatctatttattttacatagagaatattaaaatgtatattattgtatatgacagtatcttgtatgaaatacttcagtatagatgtttaatggattaatatgattaagttaatgaaaaatacaaacattgccaaaatccagttctcccaatatcatcctatagaaccattgcttctccctgtattaaaatgatccctgatgcctacacactgtcattgtgctggacatttcactgtctatgatttccatctagatgatactgtagccacatcctaagtgagagagcacataaaaaatcatagtcatgtgccaagtcaatgggaatataaaaagatgttcttatctctgagtaccaacttttaactacttcccccttccatatacaacttatacgaagtgaaatacacaattctactttttctgttattctttcggtatctgtttttaaattttggagtttttttttcctgtcaataagcaggatgtttaaaatgataacaaaattcctgtcatacgaaacatctgagataagacaagcttccttgttagtactttgatttattgggcataaagaatgactgcactgaaataactcagtataataaaacatgccacttggtttgttaaattatattgtacatagatgttatacaaaatacactgttagttatgcaatgaattttgcagaacaaaatatattttatcatttcatatcaaaagggcaaaaggtaataatatataacatgtatggctatagtctgcatattagaagaatctttaacataaaagcagctttgatacttagaaaatccctcttggggtggcagaagcagcatagcttctgggacagggtcacttgtgggcctatatcttcagtcatgaggcagatctgagctccagacctctgtgcattttccccaccagaggggagtttgcctctagggaaggctcctaccgcaggaccaggtgagagtgccatcttgtatcccaggtctttcagagaccaggctggcaaggatagtgggtggcagaagcaacatggcttctgggacagggtccctttcatgccttcatcttcagccaggaggcagagctgagctccagacctctgtgcaccttccctgcaagaggacagcttgcctgcagagagtgctctgaccactgggactcaagagagagttggactcccaggagtgctgacagaggctaacagaatcacaggaggaacaagctccaaccagagacagctataacaactaacaccagagattaccagatggcaaaaggcaaacataaccatcttactaacagaaaccaagaccactcagcatcttcagaacccagtgctcccaacacagcgagtcctggatacctcaacacaccctaaaagcaagatctggatttaaaatcatatctcatgatgctggtagaggattttagaaggacattaaaaactcacttacaggagaacgcggcaaaacagatagaagcccttaaagaggaagcacaaaaatcccttaaagaattacaggaaaacaaaaccaaacaggtgatggaattgaacaaaaccattcaagatctacaaagggaagtagacacaataaagaaaacccaaagtgaggcaacactggagatagaaaccctaggaaagaaatctggaaccatagatgcaagcatcagcaacagaatacaagagatggaagagagaatctcaggtgcagaagattccatagagaacatcggcacaacaatcaaagaaaatgcaaaatgcaaaaagatcctaactcaaaacatccaggaaatctaggacacaatgagaagaccaaacctatggataataggagtagatgagaatgaagattttcaacttaaagggccagcaaatatcttcaaccaaattatagaagaaaacttcccaaacctaaagcaagagatgcccatgaacatacacgaatcctacagaattacaaatggactggaccagaaaagaaattcctcctgacacataataatcagaacaccaaatgcactaaataaagatagaatattaaagcagtaaggaaaaaaggtcaagtaacatataaaggcaggcctattagaattacaccagacttctcaccagagactatgaaaaccagaagatcctggagagatgttatacagaccgtaagagaacacaagtgccagcccaggctactataccctgcaaatctctcaattaccatagatggagagaccaaagtattccatgacaaaaccaaattcacacattatctttccacgaatccagcccttcaaaggataataaagggaaaataccaacacaaggacagaaactacaccctagaaagagcaagaaagtaatccttcaacaaaactaaaagaagaaagccccaagaacagaatcccaactctaacaacaaaaaataacaggaagcaacaattacttttccttaatatctctttgtatcaatggactcatttccccaattaaaagacatagactaacagactggctacacaaacaggacccaaaattttgctgcttacaggaaacccacatcagggaaaaaaacaaacactacaacaaagtgaaaggctacaaaacaattttccaagcaaatggtccaaagaaacaagctggagtagccattctaatatcgaataaaatcgacttccaaccaaaagttatcaaaaaaagacaaggagtggcacttcatactcatcaaaggttaaatcttccaagatgaactctcaattctgaatatctatgctccaaatggatatcaatgcagccacattcattaaagaaacttaagctcaaagcatacattgcacctcacacaataatagtgggagacttcaataccccattctcatcactggacagatcctgcaaacaaactaaacagagacaaagtactactggaagatccaacaatacctttcctgggcgtatacccacacgatgttacaacttgtaataaggacacatgctccactatgttcatagcagccttatttataatagccagcagctggaaagaacccagatgtccctctacagaggaatgaatacagaaaatgtggtacatttacacaatggagtactatgcagttattaaaaacaatgaatttatgagattcttaggcaaacggatggatctggagtatatcatcctgagttatgtaacctgatcacaaaagaacacacatgatttgcattcactgataagcagatattaacccagagtactcatgataaaatttgcaaaacaaataaaactcaagaagaaggaagactaaagtgtggataccttgttccttctagaatggggaacaaaataaccatggagggagttacagagacaacgtttggagctgagacagaagaaagaccatccagagactgccccacctgaggatctatcctataaacaaccaccaaacccagacactattgcatatgccagcaagatttagctgacaggaccctgatatagctatctcttgagaggctatgccagtgcctggcaaatacagaagtggatgctcacagtcatctattggatggaacacagggcccctaattaatgagctagaaaagtagccaaggagctaaaggggtctgcaaccctataggaggaacaacaatatgaactaacaagtaccccccagagctgtgtctctagttgcatatatagcagaggatggcctattcggccatcaatgggaggagaggcccttggtcttgtgaagatcatatgccccagtacaggggaatgccagggccaagaagagggagtgtttgggttggggagcagggtcgggggaggatataggggacttcctggatagtatttaaaatgtaaatgaagaaaatatctgataaaagtgggtaggggattggggggtggatgtgggggacctttggatagcattgaaaatgtaaacgaggaaaatacctaataaaaaaatttaaaagcaaaaaaaaaaaagaagaaaaggaatgaaaaaatccctcttaaaaatcagaaaacactgtatatcctgtcttttttatttatccaaagaaagaggtataggtgtgttattgtcatggtaatgataaaatgtttgaaatgccctttttcataaagtgtatattttgaataatattttgaactcatttaaattcatatccagtatgggcaaattcttaagagttcttatgatataaatacttattgatcaaaaattgatgtttttataaaatattcaaaatgatgctcaaatgctgacattaagtattttatgactgagctggcagattgcttcccattcaagtatgagtatctcaggtccatccttaaatagggatttaaaaaaagccaagtatggtgatctattcctggaattccagcattggtatagtagagtgaagagaatcctttgattttctagctagctttaagggagagaccatgtctcaagcaatagggtcaaaagtggttgagcaagacatccaacattgaactgtggcttggcttccacctgtgagtgtgaactgaagttcaaacacattaacaagtacacattcatacacacaaatgccattgatgcatgcttcttttttttctgagagtattctttttaattgagtattctctcaatttgtatttgattgtgccacattagtgtttatttcattaatctagattagtaaattttgcctcttgcattataatataaaataaaagagttctactagaattcaccatgtagccctagctagccccaaacacaaagcaaattttatacctcagccaaacaaggacaagaatgataagaacgcaccacctttttcagctatgtttacttagtttttgtcttattgcagattaaaatcagtgcctatagcattcttagcaaggcatctgccatggagcaacattccataccccacccctctggatttattattacaagaatctttaaatggcaattatgctctagcttataccttctctttctcttcacaatagatcctcaacagtgattttaccattttatagtttcatagataagaattatatttacaccatttctacccatttctcccatgccaactcctcccatgtcccccgttccctattgaactcttagtttttattgctacatatatatatatatatatatatatatatatatatatatatatatggaatgaagtcagaagtttgagtgtgtgtgtgtgctctcatgtccatgtgcacgaacacatgcatgtgcctgtgtttaaaacgtactactttggatttaacaacttatcaggaggcttattcctggaaaacactgaatctctcctctctctctctctctctctctctctctctccctccctccctccctccccctctctctcttctcttcttccttcttcttcttcttcttcttcttcttcttcttcttcttcttcttcttcttcttcttcttcttctcctcctcctcctcctcctcctcctcctcctccttctctctctctctctccctctctctctccctctctctctccccctctttctcatgcaccattgatacctcatagctgctcatatagagggtgattttgtgaaattttctccattcatatatgaatcagaaaagtgggatacatgctccgagagtgcatcttctaaacaagacagggaatgtatcatgaaatgtacacaatgtgatttgattacctacaagacctgcacaataggaaaagcagttgacatgccaaaatgactgatatataaatgtatgtataaacatatataagtatatatatctatatctacatataaaagcatgtatacagatataagcatctatacctatatctatatctgtgtaatgtttgttacctgtgcaactcaaggattaacagaaaatttatatgaaagaaaatccagagccatagatgcagttctataaattggtttgagtaaaaatagtaaatacaactgaaataagctatgtaaaatagtgctgagtagtaaatttaagtcaggtaaggaaggaggagaaggtttccatagattggcaatactatgagagaaagcagtttgtaataacattttgaactagatggaaatttgaaattgtgattgcctatatatgattatttgaaaaagattgagtatgttgtttctgtctttttgacaaaaatatgcaagaacaagcaaagtgaagaaaaaatatattttggttcatggtttcagggactttaatccatgattctttggtatcattgtatccgagacaatgaatgctgaggcagaatatcctggtggaacatttctacttcaacatggagcaggtcaatgtgggaaaggacctgagactagatacaacattcaaaggcacatacctcaggatctccttatgtttttgctatttctacaatacatttcatctataatttttcttctcacaattcagcatatgtgggaaaacaattctacaagtgccttgactgctttgccatttaaatatttgtactctcagtaatctcagaccatcactttcacattctgccttccaccagggcctttgagcaagcaaatagttcattaaactgctttgccattttgtaacaaatatcttctttaatacactttcaaataaattacttaactttcaagtaaattaaaatggccatatttcaatttgttgacagtttcatgcatgcacaaaatttcttgtgtttactctctgttatcttcttcttgctccctgtctatgtttcctctgcagtataaggctctttcgaacatttcatgtcttttgttttgtggttaagatgaaccaaagccatctgtatggcaatagattttaaaactattctttaagggaatcaacttttcattttaaatatatagcttgagactctttgtccttctatttgtggtgacatttatgctcttaaatgtgtatagcattttagagatctttatgaactttggtgactattaccacatgaaatttgaaaaggtagactaaacaatctagccaatatttggatgcagaaaaaccagagacctagaaagaagttaactgtaaaggtcttatcaaaaatgtatggtcaagtagaaccaaaataaatatgtgacttttctgacttcatagtaaatgttctttcaatagcagcatgttaaaagatttttgtattgacaaatgagtacctgtatatatgagagagaaaaatgattatacaactaagtacatggttccaaacatattaattttccattttcttcctggctttgctcatatgtgaaatgaagatgacaaaaatcagtttcttagatttgttgtattgagtgagattatctttttaaatagcatattggatggcttataaaagatagccattttttattcctattattaaatacttgtgaagccttactaatagtaataaatttatagtatacatactttgtgatagttgattcttttcatgtctctatcttatttgatttcaaaagtttagaaaacacataatttatttaaattgtgaataaatatcaaatcatagttttagggagtttatttctctctagctcataatgttttcaatgaattttattgttagttataataaaccaaatagaatagatctttgaatatcttcatttgagtacagaataatttctgtagagtttacattttcttttcatatgtttatgaatatgtgcattggagggcttgcacatgccatgatgtgtatgcagaagtcagaggacatattgtgcaagtcagctccctccttccatcatgtcttatccagggatcattctcaaatatttatgcttggtgtcaacctttccctgctgactcatatcaatgccccatcatttcacttattttcatgagaattatgaagaattcatttgaattaccttttcctgctatggattagttatctaccttgttcaagttagtttttgaatacttcctcattagcctttatgtatttttgtagaaaataatgtagggtctgcaaatctgtatagtgaccagtctataatgggcaaactacaaaatataaaatgccaggaagtttacaaagataagacattaaatattaaggaacctgatcaattataattcaactattatatgctaatagaattttttcacatagctcacatgagaggcattatcacactccgatccatctttttatcaacatttgtatacatagaaagttgtccaattgtcagttatgaaaaatgacaatgtgtgtcttaatcctttatatgggcacatttaagaaactcacatcttttagtaaatatccaaattgtggttactgatctaagaagtaaattcctggattgatagctgactgttagttggaatacagcaagagttatttatatatatttttagcatagcgctgattcactttgtctcaaaattataaactccaaattagataaatatttcctctatgttatagtttttagtataatgatagctataatttttttgcttctatggcagactttgaaaggatgtgggtcttcactacataaaaatgcaataaattaacagaaactactgtgttagagaaataatagtccatatgtttacgaatgctgatgggatgcctggttggcatccaaggatgttaaggctaaacaaagtttccatctaataatgaatatcatttctcactttttgtccttatgagctgagggactgaaatattcatgaccaaatgcttacctgtgaaaaaagctgtgtgttgcaaaactgtgggtgctaatataatgattacagtgtttggttaaacccataaatcagaaacattgtgtgcaaagcaaattttctgacttgctttaaaattagtgttcactaaagcttaaactagttttgtttttctatgatattgaattttgaaattagagaaaatgcatgctatatgatagttttggaaaagtgttctgtatcacacagttttgctctctatgatgttgtttctctacatctatactgaagtgatagttgctttactcctgtcttctttaatatgttcattgtggtccaagtctgaatgtctcctactgttatatcccatttctaaaatagcacaatttctttaaaatgtattgaacatgttactattaaacaaaaatgagtataaaaataatgtgcaatctactgatgccttatgaaaaggaactagaaatcagttaactgtgaactttttttttaatagagaaaaaagttttccttggactaacatttgtatacattagtttcataaatgggaaatagaaactcctgattttaatttaataattgttataaaaggtaaatgaccaaaataaacttgattgatgttttatttaataaaacaataacatgatagttaattttgatgatcaattcaactggacggagatgccctagagacactcctcttactgaatgtgaggatggtttcagaaagttgcacctaaagagaaaaagcacaccctgagtcagggtggtcccagctcctaaactagtatctcagactgaattaaaggagggagacagctgagcattagaagtctttgttttcagatccctgacaatatgcccagctgtaacatgttcctattgccatgatgaattttaactttaaacttttaaactaagaagtttaatgccaccctaagctacatgaatcttgactcaaaaaaaaaaaaaaaaaaaaacccacatagtacaaacaagtcagatactggcatgattattgctatcagtcagacatactgcattagaaagcagaaatatgcggagtgggcagtttagtgaagacaagacaggtgaagaaaatccagaagtaaaagttaaaaatattaacaaaacaaaggagaaccctcagccttgccattgaaacaataggaaaaaaaaaaaaaaaaaaaaaggcctgaaggcagtaactccacccaccaaaagattcaacttgttaaaatgcaaatccatttgaaaggactgagcttgagctgagaaagcccaggtggataatatctgcagaaagatgggtgttttcacatttagattacaaggaaccctgaagacaccaaaacattagccacattaagttggcagaagagtttgatagcattgtctatgtagttgcactcacaaaggcatggttatttgtgccaaaatgccagaaagctgatgaggtcagaaaatttgtgtatggtaagattcgctgcaactgggctagagaggccattgtgtgaaacttgctttgtgatgcaagtttcacacagaacaatagtggctatatactgaagaaccttaaagtcagccaaagagacatgttattggtactgcaggcaacaggattgaaaagacaaggccttccccaccatagtgaaataaaattctaaaatttgtacataaattcttcttttatgctgtttttcactatttgatcacagtaaagattattaaataatgcagataatattaacaaaattatattataggcccaagaatgtaaatcattatgttatatattcacaagattcatatgaagtacatttatatttctgagtttatagaacaaatcaaattatggacctatgtgtatagatataatattgtttttttctaagaatttattttcataaatcttgtttatgggctttacaatttataaagagttcgatagcattgtctatgtagtttcactcacaaaggcatggttatttgtggcaaaatgccagaaagctgatgaggccagaaaattgttctaacaacagaacttgaactattatcccaaaaatgatgtacaagctgagcgtgggggcacacacctttaatcccagcacttcggaggcagaggcaggcagatttctgagttcgaggccagcctggtctatgatgtgagttccaggacagccaggactatacagagaaactttgtctcgaaaaaccaaaaccaaaccaagccaaaacaaaaaacacaagaaaacaaaaaacaaaacaacaacaataacaacaaaaccaacaacaacaacaacaaaaaagatgtacaaagaacttttttgtgcttatgagaaaatcaatatctgaacattttatgagtatattttataaaaacttcattatgagttcaattattgcaccattatttcattacaaaattttgggactagaaacataactaagagcacttgaagcacttgtttgtgacctggttttagttccccatgcccacaatgagtggctcagaactgcatgtaatatgcttcactggggtggtgctcaagtgcatataatatacccacatgggtggctaacagctgcatgtaattcctgtttcatcggaaccaataaccctttcttgcttttgagtatacctgtgcatatacagagcacataaattcattcaagcacatacacacaaataaaaacaaattttaggacaatttgttactcttctgtattatctaccgtatctattctttatgtttttgtttgtttgtttgtttgtttgtgtgtttgcttcttgatcacacaagaaaggtagaaaaaaaaaagaatccgatattcctgaagcattaataacgtattaaatttatcttagtgattcaatcaccttcattaaataacactgatacaatagagtttaatatgatcatcatttatcattacagtgtaactcaaggctagggttttaagctgatttagaaccttctttttggtaaatggattttcttcccactctcagtctattctgagaaagtctatgcataatgtttctgttagccccccatctccgtttgttttaaatttaattttattgtaattcattttttacactccatattccattttccgctcctccccatccaccctctaactgttccacattccacacctccttcccaccccaccttgtctccacgtggatacccacacccacaaccccacctgacctctaaacaccctggggcctccagtctcttgaggattaggtgcatcatctctgaatgaacagagaccctgcatttctctactgtatgtgtgttgggggcctcatatcagctggtgtatgctgcctgtttggtggtccagtgtttgagagatctcaggggtccagattaattgagactactcatcctcctacagggttgcccatctcctcagcttcttttagcttttccctaattaaacaacaggggtcagctgcttctgtccattggttgggcacaaatatctgcatctgactctctcagctaattgttgggtctttcagagggcagtcatgataggtcccttcttgtgagtgctccatagcctcagtaatagttttaggccttgggacctcccactttgagcctgtggctggaccttcttttcctcaggctcctttccatttccatccctgtaattctttcagacaggaataattatgggtcagagttgtgactgtgggatagcaatcccatccctcatttgatgtccagtcttcctgctgaaggtggggatctataaattccccctccctattgtctgcaatttcatctaaggtccccctccctatgagtcctggaagtctctcacctcctaggtctctggtgcattctggggtgtcccccccaacctcctatttcctgagatagcctgtttccattttttttctgctgaccctcagggcttcagtccttttccctcacccaataccagatcaggttcccctctaaccccccactgccccccaccccacccacattccctcccaagtccctccctccctccccacttgtgattgctttgttctctctcccatctctggtttaaattagaaataagacattcattatgaaaaaaagagatgtacatattgcataataatttgttgtataataaataaaagttgattaaacatgaattgtgagagaaaagaataaaaatataatcatatattttataggttatccattgaaagactatttctactttgtcttattaaattgagcaaagtaaactttgtattttactagcatatttttcctaattgtgttttcaaaatttgcatgtaaaatgggtgaatcattttgtaaaatttgaataaaatgggatgaaaaatattaaaacaaacattgcatatgtacatgaatttgtcaatgaattcataaaacatttttaaatgggctgatataatggtatagaaagtatttgttatctttacctatttgcattagaacattttctataaacagttaaattaatttggtaatactttttgcgtagtttgagtagctatacttttaagtcaaactatttgctaaattacaccagtagcagtccatcccaagtctgctaatattcagtgtttagtttgatgagcagatcctcttgtatctcaggtcttcttactgcctactttacaaattatggatcattgggcaaatgttaccggacttctattttctgttgtctactcattgcagtttataaatcaatagaaaaaaattgatttataaactttaacttactttaatgattagttctgcttggatttatccttgctgtgtgtgtgactgtcaccttccaaaactatttacttagaactattggacctaaagtgtgcagaaaattttgtgccttagacctacagaatgtgtgtgcttgttttacttaagaagttagaataatgacaatttctcacatgctccaaaccaattatttttttctgctgtccaattaatttttgtcaaatctctattatgtgaagtataagttccacattggagataatatatatatgtatatgtatatgtatatttgttatatatctacataacatatatgtataaacaaaatatgatacatgtatatgaaataaaattactaaatatatacaatgctcatttccttagtaattgaaattatatatatatatatatatatatatatatatataatacatcttgataataaatagagatgtatttacaaaagtccttttgtgcattaaaatgtggatttgaatttaattatttttctcttttttactttgcttcagccttgccatttgttgtgttgctttgctccatatatgttagaatgacaacatttcaattaagtttaaaataaatgaagcttattataaatggtaccatttagaaggatacttagtaatttctttaaaaatgcacagttagtgtagttttagtccattttctatatatgttgcaatcagttggtaaaagaagagagcacaccattaccattgattagactgggaggtaacttgggataagagatgcagattatcggacattacatcatacctggtaaggaaagaacaaagatgcattaggaagtgcctattcctgctctcaccaatactcagtaattcagcacacacatgcaggatgctgatcttctccttcctgcacacagtcagtgctcagtagagtgcaattaacttggccacaacaattgctgagcaggtgacttgattacactgaaatcaggcagaaaatgtcctcttctggccactcaagtgaatcagtaaaattatggagcagcaaaactaattcactgccttgggccatcataaatgccacttcctgtaagtcaagctttcacttagtgtgaaatcgttttgttttattgtctttcacataatgcttatttgagctaatccacttaggatatgtgaattggtgagtgtgtttggatagtttaagatactcaaacttttcatctactagtatttaaatattgcatcattagtttttgagcgctctttcatacatgaactctgtatttaaattatttatgcccctcctgccccctttacctccttccatacctactgacttttcttaaaattcaagagctactcttttttaaaataattattaaatgataatatgtgtgtgtgtgtgtagggatttgtttttgtgtttctatatgtaagctactcagtctatttaatgttgcacatatctgcatacatatacatatacatatacatatacatatacatatacatatacatatacatatacatatacatatataatgtttctagggctgactacttaagactgggtaactcatcaggaagctaatccttcagaatacctggctctccctctctcagcagccattaaattacctgaatctcatcatctatgagcaataccctgtgagtttctcccatgcacactgacatgtgacttggtgttgtgattgtgcaggccatttatatgtgcttatattgtaattatttcgtgggttcaaggtagcactatcagcagatagcatgatcctcagcctcttactatctttctgtttcttctacagtgtccccaaaaccttatatttagggtttgttttgtagaaatatcaattgggttggacaatatttggacatttgttctctgaattttgatttaatgttactttctgtagatatctctgctgcaaaagtaacttccttgattagtggtaagagctacacctatctgtgagtataagtgtacttgttgagaatacaattaagaatgatactggtttctgaaagagtcagtggtaggctttcctctgggtcaatggcctttctagacagaggtgggtttacagtggctggcatgatttccctttgttgtgtgagccttagtctaattagactgctgttgattatccctattgaacctttgtgggtatattcccaggcagatcactgttgtgattaataaggaactaaagggggtctgcaaccctataggaggaacaacaatatgaactaaccagtaccccccagagcttgtgtctctagttgaatatgtagcagagtttggcctagtaggtcatcaatgggaggagaggcccttggttttgcaaagatcacatgccccagtacaggggaatgccagggccaggaagcgggagtgggtgggttggggagcagggttgggggagggtataggggacttttgggatagcatttgaaatgtaaatgaagaaaatatctaataaaaataaaaataaaaaaataagctttaaagcagagtaggactattgattgtttttctccactggcaacttgaataatacctttacatactatgagaaataatcttcatgaaagactgtgaattagttacagcatgaattttccaaaatgtgttttatctgcagcaatagggtcttacccttgaattctgggggacaaccagggacagcaacactactactgtttgggaagcctcttatacttccattcccaatgacttgaagggggtttcttattcttagtactaggggttttggttagcatatatctccaatgggtaatataattaccccacaaggcatgattttattagagaagtaaatacagaggaacagtgagggaagaagaaaaacatcattaatgatgtttggaaaatccatttgaaaatatatttttaacgtttaactcttacacatttgtaaaatgtgtttaattgtataaacatcttgatgtagtactgaaatattataaaatttgaaattcatttgggaaacatcccaaatttgttaccgtacaaattgctagttggtacaaagtagttcctgtgatgtaaaattgattcacaatgggtaataaaagtttaaataagttcaaatgtaataaaatttttcttctattgcatttgtcttaatagaaatttagacacctagactctataaaatgaaacataactttggttaaatagagattttttttttaagtgagacataactttctgcttatattagctgttctttttttttatttctggataaaatctccatgtattctagactagatttaatatgattaacaaagtaattttatttttattagcagaatgagagatttttatttactagaacagatgatacattgaaaccatctttctcaaattttggaacagtgagggataagatttttgttcaggtttgtaacatatatttgttgatattaagagtgtacattagaatcttaatgtacatgataatgtctcttagttgtctcttgaatgagacaaagtattcaggccatgaattttaaagtatttcacaaagaatttgtagtagtccaattatataccaatttctgcttattgaatactcaaatattcctgtattagttgacaatttgtaatcattaaagtattacaatttcatatatatatatatattctaaattatgtatatgcatgtatgtactttattgaaaattctattaaataggctaaaattctattttaaaataatggcattaagaaatttaaaacactgattataaaaaatatattgtgctctaaacctggttatatcaagtgagaaaagatagcattacaatctttatcagactatagtgattttgtgctatgttgttccaaagtagaagcattcatatcactgaatctcaaatataaaaatacatcattaaagtaaaagaatatgtaaatataaaatacaagatttttgtttctggctgtcaagctaaagaaatgtgatctacattattgtaatccagttttgtaagtataatttaattttgtcagtatataaaagtttaatttccattctctgttaaaaatataagagaaaatctatgtagtgaaaatttgcacaaaatttactatactactaataaagtacagatttgttaaatggtctccaattaaattttgctctaccaaaaaaaaaaaaaaaaaaaagacagaacgaaggaaaaaaagaaagaaaaaagaaaatttcaaatggttctgtatagggtacaacttatattttagtaaatctacatttgactttgctgacatagggttaagaatagttcattggagtaaaatttatttgcatattaagatgttcagttactttcagatttcactttttaaggttaatatctgtgagtaactttttggtcaaagagtgcattaagcagatatagttatcaaccccaaattacctacttttaataagttactagatttatgctgataatataatcatcttccttatctaataacaaatatgaggctcattttcctggttcctaaatgtgagtatttataaaagataattgtattaatctttgtcttgatgattagagtgtttggatactaaattatattgcctctaaataccaaattgaatgctcaataaagatataatttaagtgttaagtttttgtaatatctttatcttattcatttttgaagacacgagcatacacacacacacacacacacacatatgtattcctctgggatttttgtacaatgtcttttgatcatattcaccccttccctcaactcttcccatatacatccctccttttctccctacctaatttgtattgtttttgagacaagttattacaatgtagctctgtaatccttgagctcattatatatactaggctagtcttaatctcacagagatagacctgcttctgcccctcaagtgctgggattcaaagcatgtgccactgtgtctgacatgtatcttcttttgtaaacccatcaatacaaatatatactgtccaaatactcttgggtgtgtgatcttccactgaagcttggtcagcttaccgacgactacactcttagagacaatagtctgtcctcccagcagctaacgacttactgctaatatctacatggcttctgtttgtttcatgtttcaagctcccatctctgtgctgaaccttggtctggcttgggcttacacgggtcttgttcatcctgatgtgagtttatgtattcaactgccctgctgtgaatagaagacactgtgtcccgatagccatatatttcctagttcttacatttctacccctcctccacaattatccatgaagaatatatattgcaccccttccttttgtacccagggaggcacaaaggattattgtgtagaataaatgatctttttctgcagtttaacttagcaattaaaattctattaaatgacaagtacaggaacagtcttttatttttctttttcatatttttcaatgttatgatgaacctatatgaggttgtaccagtgaaatatcattgaccttacaggaggtaaaaatcgttcttcccagacattttcatgagtaaatgttagtctgtgattatagctgtatgctgtcaattcatcagagtcctaaggagaattcaatgattcacaaatagtcagtgatggacatcttgatcaaatgcttcgattttgcaaacattgcactaaaacttagaacaccgtggtggaaactactgagcataatatataaaatggtatagtttttatacaactgctaaactcggttgcttaaagatacattttacatgggaaatatgacttacagaaagctctcaaaatgaaaaggaaaggaccaaggggagaagtgtggtttcagtgtcccctcagtagcaataaatgaaagatttgttcctcattaaatgatttcttgatgtttctcaatagattttcagctaaacacttgttaatcccaaagctctgacaagcgcggccagcagaattaggccaaccactgctacaaatagctagtgtacatgaaacagtaatcattgctttccagtctattattagattaacttcatagggattgcttttttctcctgtgagttgaggcataaatgacatgctttaccctccaataaatctaatagcagagtggctatgacatgatgttcatagccctgctcccatgacagattatttttgattgcttcaggagtttctagcagcttgaaaccattagaatttaaggcatcattgaaatgttacagtgtatctaactcatacagaatattgctgattctgaattatatagtcacagctttttgtcctatggtattgactgtcactctgtgactaactttggaaaccgagtagaaataatcaattgagttgacaaaaattatacataagaatgatgtctctataaggatttctagcatttataattaactgtgggtagggggcagctgtcatctatatgttgcatgtaacaactttgctttcttcttttaaattacattataaatggatgctaagagataccaaaccttacacaaaagtagctgtaaatacatttttctgcaacaaagtaattctattgtttcaacagataagttgcttgtgcttttgtgcatttggtttacatttccttttattttaaaatatttttatgataggttaaataaaacatgtttgctacttttatgtcacttcagtatgacttaaaataatcgttcggtagaaaatgtgttttctctttgttgtgaaaccttgagaactaacagaactggttccaattgattcttgaacataatttaattttaggtgtatctttttgtgttgagattaaggtgacgctttttcctattaacttctttgtgttattgtaaatagtgtagattgtatgtcttattcctccaatatatatccttcagtatatcttgtttcagagattatacaatcaccttatttgctaaaacacataatatttttttaactttattttctacttattcactttacattctactaactgggctcctcctggtcacccctctcagagtccttaccccattttcctctctacttttcctctgggtgggtgggtcacactgggtatctccccactttggcacttcacgtctttcacactgaggaaacttcctctcccactgaggccagacaaggcagccaagctagaacatatcccacagacaggaaacatgttttggatagcccacactccagttttttgggaggaccacatgaagaccaagctgcacctctgctacatatgagcagggaggcctagggtccagcctgtgtatgttctttgattggtccttcagttttggagagccccaagggaccaggttatttgacgctgttggtctaactgtggagtttctatctcctctgaaccttcaatccttcctcctatttttctataagagtccccgagctccatccactatttggctgtgggcatctgcatctgtttcagtcagctgctgtgtgtagcctatcaaaggacaatattctcctctctgtaagcataacagcgtatcatttaataatgttagggatcagtgcttgtccatgggatgggtctcagttgggccagttattggctggccattccctcactttactccattcccaatgcctgaatttcttgtagagaggataaattttgggttaaaagttttgtaggtgggttggtatccctatcattccactggggttcctgtctggctacaagaggttgcctcttcaggttccatatccccaaagattgattcttggatacctcccttatcccaggcctctgtattgtcctggaaatgcactccttccgcccctgtcagatgcaggtttctattcattttcatgccatcttgccacctaatcttaatggatctaaattgatctatgactgtatttttgtgtttaatatatctaaaaatgacttttcacattatttcatatcccagacctttcaactcaatacttttctgacttaaaaataaagcaatgcattctatatagcaatcttcttcatttcagatatacttatctggaagaaatggtagtgctaagttgcatctaaaaatttgaaagcatcataccaaccactggtattcacccattcctttggtagttataaactagcactctatgtactctttttttccctatgtcaccaaaatataaaacactataacatatttaatgatatgtttctttccactgtataaggcagtgacattattgcaaagcaccctaggcattacaactaatgagggggctaaagatgtgccttttaaaaaagaaatattgaaatgcaaaaaaacttagaattgctttaatcagaaatttggggtacttaaaaaaattgtaagtaacaatgcaattcattctaagaaaatgcacagtatgcttgagtatagctgcatatagaatagaatgtactataatttgattgagaaagggtttcatgaatttttatcaagatatcttagacaaaaaaatctacaactaatgtcaatctaatgtaatctagcaattgtcaattctttattgtttataagagtcacttacagtgtgtacatggtagtagtgacagaaaataaagatagtaaaggacaatagcaatgttcccccaacataatatttattattttactaatgtatattttttaactaaccaaataactatcagtttttgcacagtgtagtttataagcaaggtccaagcagtagctacagtttgggcacataattcaacttaaaaatgtacataataagaggtaaagcattgtatttagatatttagtatgtataagtaggttggaaatcttaatatgtagacatttagtgagtatatgtaggtaggaaattttaacatacaaatacgtatgtcaagcagtcaaatgaattggatatctttgatttgatacaggctaatataaggccagatatgttaaacaactgattcttatttctgcatcacttaagtttccctggtggtgatattttcccctaaacatcagttacaaactttaaacatttttaacaagtaaaatgattcatgcatatatacatgttagtactttgacaaagataccctagtgattcttcagggcaggtttggacattgtacttttttaaaaaataaaactcatttattgtgctgttaattcagtacagaacattgttcaagctgatagtatactctgtcaatgaactacatctctaaatatatgtgtggggttttattttctattgaggctactttagaaaaactttaatgctactgcattatgtagttagtagagatgttgggtatattagtgagaacttagaatagttgatttgctatgaagtataacacgataattgtcctactcataggctgtgtatagctaaaatcatcaccatcatcaccatgaacaccagaaccaccaccatctccatcacttcgcaaacaaaaacaagtctttcataaaaactgcattatattaattatagtttctccctcattagaaatgtgatttctgtcttattcttagttttacatgcttaattcaatttactagaaagttgttacatatgaatgtactgaaaatagaaacaatgtgtcaaatagagtttgttaatacaagtttatacagaagtgttatatagcatgtagtaacatgtgttttattaattcagttacaagtgtttgtaaattacaacttgggagagagctgtaccagagaaagctattaagttagtttctattataacgttttaagtttgacaatatatcttttctcacctgtaatgccgtcatgatatgatagaaaaatgttaattttgtttttatttaattgattgtcatttctgattttctggtaaatctttttcacattctctaagaaatatattttagtcatgtttgcccttttttttcttaagttgttctacactgtacgagaaaatgtgaattgtatgcactttgatgatgcaaattattgtagctggtgcaattcttatcatgatttgaatttatttattttcctgtcagttactactttgatagtgatgtacgctacattataggactggaacatatataaatgagagatatatgattttgtgggcatcagagatttttttctgatctatgaaatatgtttaattatctcaaaaatattattcatccactgttttgatctcaagtggttaataacttaaaataaatccacacaccggaagcatatatcttatgtggactgaagcatacttctaaaaacagcagtgctatcccaaatcacatgcatgctgaaacactttattgtttatgggtttgggttttgtatatattaaatgtaaatgtaatgattataatatatatatatatatatatatatatatattcttcattatgtaagaaataaatttcaaggctcacatatgttctcaggaattaatattctcaatatttacaacagtaagtcactagggaattccaaatgctctcagttggccaagcagcccccatctgaagaaactatttccttatgtctatcaccctatcatttactttagtaaaacataaagcatagtttgtaccattgaggggaaaatggtaattgaatttaagtaataaatgtgcaatttagcaagacttagggtttttgggtttttctgtttgttttgtttttactattttatgcctattatttttaaaattacttgagtattaaaaaaagctgtaaaattgtgctgggtgtcagcacattgcatcttcaaacaatctttcatcttcacttccctttgcttgaatagtaaaaaactttgtaaattaggacctaaaattaattgaataaacttcaatggaatgtttttatgtttttatatgcattttaaaaagtgcattgtaaacttttcagtgctagagacagtggctaacatgtccatccctattgattttagtgcagtgcaaggaaaaataatgctgatgttgtgtgaagcatcatttattttctgtttttaaactcaatatgtttactaatttaatatacactttaatgccagtatctatgatatctaaattagatttgactagagtgatttcccagccaatatagcaaccatgatttgtgcagtagctattttgtttcagtctcctaaaataccttatgtgataatgaataataaaaaaaaaggagaggcatttaccagtttaatggcattctttctctaagtctagcatgcctttacttgcttgaataatagaattttcatagttctagaaattaggggtttttcaagtaccatgtggctttagtgttcaacagaaagccatacccagcagtggaggacaaggtgacagaagcctacaatagctctccttacttttacatacaaggaaatctctcaagagggaaatataatgaagggaaagctaactctcatttatggccttgaaagaaaattgtcgcttgttctggagttagaataggcagtttttctatagttcaaatatgataacctactcatattgtataatataaactctttaacatgtgtttactataggacaaaaatgttctgctaggtactgtctgtatgcttgatacttaaccctatcaggtgtttatgacctaatgaactgaggttcagagaaataacacttctagtgaaaaaacttgccaagtctatgtttcttaaccaataggggtgagttgcttaaaattttattgcacaagttttacccatcacctgagaatgacaatcacaatcagtgcctaaaagttactgggagaatagattagataatagatttctattaagttttctagggtcattaagattttataggtaaaaactacagggaatatattatgagacctggttcaaagaagtacagtgatcaagaaactacacacaatgttgtctgtgggctcaagaaaaaggaaaactgagctccagtgagctaactcagtttcatttccaggagcttaaatgtagtgtaactcaggatatggtcaaagctagcaacaaaagggtcagaagcctgaacatcctcaaaagcttgggtgccttaaggtagaaagtgaatattctaacttaaacagaagcacactcacctgcgctctgacattttgctctatctggtccttcatcaagttggataaagatcatcaccatgggtaaaggtggaacctcttatctaatcatcatgctaatcacctctgtaaagatctttataaatcaacccaaaataaatgttttgccagtttatctggctggccctgaatataatcatgcaaattcctaatattagccattacaacatttgagtgtggtttgaaaatatcttttcagcaagtcatgcaattgatggatattctgaatataagccatcactttaatatgtacttccttaattttccttatgttttaatatctgggaagaagatattattttattacttttcctcacataaaattgaccatataatcatatttattgtagtgctccctgactggttgtttgaattttcaagagacacttcccttaatttattgaatttatattcttctttttgtcttatcccccattccaagttgaccaatgccaatgtaattacatatttccttgaaagaaacagttgctatgttggaaagaattcagggtagtttccactgtaattttttttaatttaaggatttttcttttggagagttttacaagtgggaactgtatttacataatttccacccctatcactcctccctccaactcttcctatgctcacattcacgaaatcttctttaataattgtgtgtgggttgtgcaacatagtgtgtccttttatgtgctttagtgttccttgtatatatgtgttatgagattattatgagtaatttatagtttttaaaaaaaggattaggaaaggtggatagagtaaaatctttttcattatagcaagacagtaagatagtcatatgaatattgttgatgctcactaacaaaaatgtcctatacttcatatgtgaagctgcctattcagttatgtaatacatacacatccactatattcatactgcatgaatcaaatagatttctctgtgtatagagagatattttatgtatatttatgaataatacacaactcaacatatatgtttgatggggttgtatacacagttccttgttttgtctaatttctgttctaagtctttgtaaaagtgctgtattttcttgagacttcaagtgggtttctttgctgtcatcttccatctttggctcacctctgttaaatactctttaagtatattacatatttattattggtatcataagacaaacagtactattgatattatattataacccacatgaagtcccaaaatatgtaaataaaaattttccatttccatctttttattaagttaaacaaatttgtaccagtttacaattaactgtgtcaaataatcttccatatgtattatgccaatacatacctgttatggaagacagggatatttagaaatactcagccaacctaagataattgatgaaaacttatgtggtttcctactttctttccttaaatgtggcacagtatccaagccagtgttgtattgacatagttttctatttgctatcagttataaatgctgagattacctgagtgattgttttctcagaaagccataatgtaatctcaaacctaatacttcaacaaccatgcactaattaaaactccaattatatttttgctcaaacaaaacgacttaataaacattatcacaaactgtttacccttcccaaaaacaatttatgctcactaatacaatttcccattaaaactgctgccaggtaaattaaaaactcttgaaatagtaagtaagtgggaaattaattcaacagtttaatctagacctaataacagttgcaagctcagaaaaagattgctacagcggggagttaattaacagcttattccccatttgataaaagtaatccactctaattccagtgtaatttacctcaatgtaatataaaaccacaagctgcttctggtgctagtaattattagctttgtcctgtggccacattgacaataaaagtcagcagtatcttaataatatgaggctgtctgttaaatgcccacacttaaagatataatatgaaatcttccaacagcagcaaccatgcatattgccatccaagcaggggatgcaggttagatttaaactgcacttaattgctctatctcattctagaaaacaggtgtgacaggtgacaagtaagcattccatgggcttcatatggggaagcagagggaagatagatgttacacccaacagctatcatctcttcctatttagaatattgtacaaaaccatgtcttttctctcccttccttgctatacaattgaccacatacatagtcagatacacaaacctcattatgcaacctgcatggatatgaacttttttgggggagaggtatgaacttttatatattacatacaatctgaagtatgaagtttaagttccttaacataataaacatataaatccttctatgttttagctatagtaaaccacccaaatccttctcatgaactttaaaataaagtaagatgactcagttttctgttaaagaccatttcattgcttgtcttggtttcctgttgagttttgatattctttatgaaatgttattatatatgactgtgcactttgtcatcaattcataaaatacctgcatgtttgaaattcattttgcatttaattttttctttccagtttcatcactaaaatttaaattttggggaaacccttcatgatccttatttttcagatgagataaagaccgaaaattatgaacatagaattagaacctagtttgcacaaactcaatggtcctttttgtcatgcactcaaaagtatgacttgaagtatggtactatttatatacttactaagccaaaagctacaataactataaacaaattaaaacatatatggtttaccaagccacagcatgtggcaaatgggtgctgggtaaaaattcactttgaagagaacaagaaagtgaaattgtaaaatcagtttggtattagaatgtccttttcaaatttgaatttagatttgattctgtattatatctgaaaatagtggcactcttaaaaaaaagaggatggttgggatcgaacttatagggagatttttctggaagttctaaaagtggttaaatttgaatagggaggtggcagttaggagtgtctacacatttagaggttgatgatctcacgttgagaagataaagtttgaacagtgacaaaagaaaaggtgatatgttcattgataaatctttcctttccattttaaagaatatcttttctaatgtatattatgtttatgttgtgattaaactacacaaatacaggtaaactttatttgtgatgagttttacagtcatcctcttgattttacagcatagccccttattcatatttcaaataacttgttagttctgaatttagtcattcgatgagtacatgcttaaacagcaagctcttcatgatgagaggatcagtaataacttctccttatcttcaaagaacatattttatcatatcccaagcaggacataaaggagagtataatgaaatagtataaaataggacattaagtagggagcaagagtggttggtgattctgggagaagatttcttataagaaataaatgagcttccccacccagggatacataccataatcagccaccaaacgcagacactattgcatatgccccacttggggatccatcccataaacaaccaccaaacacagacactattgcatatgccagcaagattttgctgacatgaccctgatatagctgtctctcatgtgaggctatgccagtgcctggcaaatatagaggtggatgctcacagtcatctattggatggaacacagggcccccagtggaggagctggagaaagtactcaaggagctgaaggggtctgtaaccctataggaggaacagcaatatgaactaaccagtacccccagagctcatgtctctagctgcatatatagcagaagatggcttattcggctatcatttggaagagaggcccttggtcttgcaaagattatatgccccagtacaggggaatgccagggccaggaaacaggagtgggtaggttggggagcagggcagggggagggtataggggacttttggtatagcatttgaaatgtaaatgaagaaaacatctaataaaaatttaaaaaagaaagaaaaagaagtagatgggttttaaaaaaaaacatggtataaaacaacagttaacgggaaaaaagctgtgggttttcaaagagatggaggggatatgtggatggacttgaggaagaaaatggaaggaggaagtgatataagtataatctcaaaaataaatgaaataaattcattttatatctgcactaattttaaaagagtaaatgtaaaacttttctaaaacagaagtaaaaatgagcataaaaaatggaaattattattgtctaaaggtctgtgatttctgaagaatgataccccagactcaaactgtatgcagcagcaaagagcaattattctgcagagaacctgcatgcaggagtctaccatacatcaggatggaagacagaggtgtggactttgcagggtcagtttaaagcctgttagagtagtagtgagtgacttttaccttttttcctttgatcggttggttctagctccaggtttatctagctgcttttgtgattggttaaggctctgagagatttggagaacttttgctaattaaaactatacttggctcaagctaggtggtagggtggcttctacagctccttatgattggctcaggccaggtgttggggcagctttctgattagctacccctgaggggtaggtttgtcttttttttctttttttctggaattgactgctttgcacatttccacttctgtcaatcagaaacttaggcctagacttccaaactgccattttgtagcctgtcactgagtcagcctggctctggctaactcagtcctctcggttttccttcagctcatatgttctgaatgttcatacaactcatgaaggttagaaaaaggtattgttctcctagaactgaagttataggtggttgtgagcaattatgtggattctgggaattaaaccaagaacctgtgaaggaacaataaacacccttattccctgagcaattttttccacccactttaaatttgcttctaatttgtaccctcacttatttttatttatgtacaaaatatttaattttcctttgtgggcgttaaatgttatattcatatacattgttcacttttacaaatgtaaaaggagaggcccttggtcttgcgaagatcatatgcctcagtacaggggaatgccagggccaggaagcaggagtgggtgggttggggatcagggtgggggagggtatagggggctttggggatagcatttgaaatgtaaatggagaaaatatctaataaaaataaagtcaatataaaaattgtatgtgttttagatataaaaataaaatcatgtttaattaaatgaattttcttgttaggttaaggaatatattttaatatgcttttataacagaagataagtaaagttagattgagttctcaaacataatgttgaaaacaattaagtacttacatagtaaacagtgcatgttgtaactgttgtgtcctgagttcacaggaaacccagaggagcccaagaattgcaaagtctgctacagctcacaaaagagtctttttcttttcaaattcctctaaaattttcttatagttactttgtgaaagtgaattatttggaggaacacaacaaggaaaatatctcatatctgttaagaaatactgctcatttttgttgttgttgttgttacaggcacaaaaatacaaacatgtttcaaggccaaaattttaatcaaacattcaaaatcattatttcctccctcctatttatttctactcagtgagaatctgaccctttagctgtttctaaatgaaagtatcaaatatatgtttagaattctattagtttccagaaattttgaggaaaaaaaaaacaatctactttgaaatactaaggaatatatggtgttgattagtggaggaaatcaagaggtgggagagactgacatttccctctacaatgtctttgagagtggaaaatagaagcacaatcaatcccatgttaataaaaatctcataatataacaatataccacattgttatttgtttactaatattttatgattaatacttcacacttgttagtgtatctggatgcaattcaggtaagcaaaattttaatggaaggagggggtgcttttatggaaatgtgggtcattggtttgctgatgtgccatgttgaatactttagtgtaaagaattgttttcattataaacataattttagagagtttaaaaatataacctataaagatagatgccaactttaaactctttctataatagatttggcacttgagagcaattttttctttacaaattttaatgaccaaaaaaattgatctggcttgcttttgagttaccgagaattggaacaaattgttaattatgttcagctgcaatttgaagacttagaaaacccccaaacaatgactatgatttcaataacagttggcaagtgattagttcagagtttagttgggttgtgtgtgccatttaacagaagaggcataagatagaagatttaaccttgaagtattctctacctaattttcaaatgaaatttctgtggtgttcctagtcttttcagaaatttcctggaaattcttaataatataattgttcattataaaaaaatcagtaaaaaagaatataaaaattatatatagaaaggagtgactagcaattgaaataataaaagtcatcacattacaagagggataaaaaactattcatagaaacggatgtaaagtaaatgcattgcattatgaaactgcactgtatttgactgtggggtagctaaaaacacaggccataacaacagattgtatgaagttgagagtaaatatttccatggatatagattactgtttcccttctacacgattgatagccaaaaaataatctatctttaccgttgcataaaatcacgtggtgcatacatggtatattcatacatctacatgaacaagagcactgtataccttcaatatgtcatatatgaacacatctctctacctacccagttttatgtttccttcacttccttaattttctttctgttacccatccctcaaaaactaagcaaaaccaaatccaagcaaaaaattacaataaacacacaaacaaaacaccacaaaaccagaaagcagaataaataatcagaagatcaatttacaaatgcccaaacaaagcaaaatgaaactaaaagtctacagaaatactgtttctttgttttgaacaactactcctcagcacgaggccagcactgaagtgcagttaatatacacattgacacttataggagaaaactagttgtttttttccccttaatagcagatatcaattgcagatagcttcttggtttgtggtgggagcccacaatcacataaccatttcagtgctgcaaatccatctttcttaaacctgtggagggcttgtgcgaccttccacagtctctttgagttcatagattcatcagtacttttgtatctaaaggacaatgtttccttgtagtcaaccaatccctctggtttttatgatctttccacatcctgttcttgagctttgaggggagtactttaatgaagatatcacatatggtaccgacagagtatttcaaagtatcttagtacattgtggagttttggttctctggtttcaatcccagctgctgtaagaataaacttctctgatgagttttgaacatgaccacaatccatgagtatagcagtatgcaatgaaaagtcattttattgctatgtagcctcatgttcaagttcttggctactttagaaatgttaaactagaaaagaaaagaaaagaaaagaaaggaaaggaaaggaaaagaaaagaaaaggaaagaaaagaaaagaaaaggaaaggaaaggaaaggaaaaaaaagaaaggaaaagaaaagaaatgttaaacttaggttccatcttatgcagtaggctttatctccaaacagaaagtagtttgtcacaggcttgtatctggaagaaaatgagtattatctttcttcaccagtagtgttcacagtacattccagtaccatagttgctagtcagtagaggtgaaacttgtagttaggcatcaacttgatgacatatgttagtgctctctccaaaaatagggctttaccatcaagttgcagagagtaatctgtagcctttggctattgtgatgtgtaggggttttcatggggctttattggccaatgattcaacaagatttaacacatttatgtcactggacaatttatatggtgctataatatgtctagttgtggcattaactagtccattatttggtgactacatttaattctctttcatgtgtatatatatatatacacacatatgtatatatatgcacattacatacatatatgtgtgtgtatgtatatatatatatatatatatatatatatatatatatatatatatatatataatttgaggaagcttttatatagcttacatatagcttaaaatgtcccttagtgttagttgtcactctccccatatcttctctcttaccattcttttctatcaccctccctatttaatccccactctcctgtcttcccctctcctatttctccattataatattctgtttccccttctttgggacacccgctctttctctagtaccttactatgtacctaacttctgtgttcaaatgggttgtagcatgccaatagataggagttatcatgcacatataagaaaaaacatatagtatttgtctctttgcatctagattacttcatttagggtgatttttttctaattttatcaatttatctgtaaatttaatttttcctaataactaaataatatcccattatgtaaatgtaccattttttcttaatctattcctcagctgatggacatctaggctgtttctaatttctgggtatcatgaatagaatagtaatgaagagagatgtgtgagaatgtctgtatcaagatatagaatcatttgggaatatgccttagagtggtatatcacaataagagaaagaaactaggccagaaatctgtaccagaagatgggctatcactatgacagacatgacaatgttgctttgggaaagttgtgtaaatgtctggaatttgggggtttgaaaatccattgattgctcaaatggtcttaatggggtgttttgtgggagcttagcaataagaatgttaacagaaatgaagacaataggagacctggcttgtgaagtttacgagggatgcaaaaagggaaacagggccattcatgtgatattttgaactaagaatctgtggtttctggtgaacaggggttaaagaatcagctgttattcccaagagaatggcacctcaaaaatgaaacttttttttttttttttttttttttttttactgtgacagttgatgctgggtaagctgggtcagagaaatcaactgtgaatgagatatttatgtattattgaggtgaaaactaggtgatacccttctggattaacatatagaatttgtggtcctgaagggcattacatctccattgagaagctaaacatagttgtgactcagatctcctatgaaagcaatgaaaaccttaggatccaaggggtcatggaaaacagatgaggcctggcattgtgataagctaagaaaagttgttggtgaggggacattctcaatcacaatagcaagtctaaatttaaagggctcatagagagatttggaccatggcaccatgtgaaacgttggggtctcttaagacaggccaacagttactagtgataatgtagcaactgcatgttggagaggccagggccatgggatgtctgccaaggacagtagcacatgtggatcaaagcaggattcctcatagcagacaacctgtgtgtgtactgtggagggcagagcttgagaaggagagcagtgcaaacattttagtggccaaaatattgtgattgctagataccagacagtgatttattttcacctctggatctgggctttgagtttctttgacggtgtttgttccctggttctttctttcgaatagggaaaatatttaatttggttttgcttttgcggtaacctatagaaaacttagactttaagtttacattttttaaattgttgaaaaatgtaaagactgtgggatttttaaaagttggaatatgatttatattgtgatactcctatcaaaatggcatcttagagacaatcatgaaaggaaatgctacgttcaatagctatatatttgtatgtcaagttgactaggagtgaattgtgctgattagttttgccgacacaaattagagccgcgtggaaagaaactctactgaaagattgcttctctgatattgtcctgtggacatgtctgtggggtatttccctgactaatgtatgatataggaaggcctacctcactgtgtggcatctaatgactaaccagttagtactgggtagtgaaagaaagcaaaccgagtaagccatgaaggacaagccagtaggcagtcattatcccatgagttcggtttcagttcttgtcatcatgtttctgcttggagttcctgtcctcacatcagtgttgaactgtaacctggaagtgtaagatgaaatgaacccttttctcctcaagttgattctgttcaatgatgctgtatcccagtaatagaaaactaggacacagcacttgttctgctttccctaatagtctctgttacatatttccaatcagcagattctccttccctgacccaatgccatgaaggaaacatatcttattcttattatgtgatcctcttaccttttctagaagcaaaacctctaaaagttttggacttttatgaaaattgtttttcccgtaaaaaaattaactttaatagtaacatacagaatgtttggccacctgccatttataaattttctaagttgatcatagctttcagtgcttggttccgttcttaggcttctacttcatcaagttatgattctatcttttcaagctacttctgttttcagcattgactttgaggattcaccatgttactttaattctccgatgaatctaagtaaaatcctaatttttaagcttcctaagcttttccttgttattgaaaagggaatgatgaattttagattcctaagtaatccttcattatgattttgatttgcatttccttaacatttaataatataaaaatgtttgaacttacttgctgaccattgaccttcatccattggattgaagtttatttagatcctttgctcatttcttatattaaactgtttgaattttcagtattttattttcatgactgcaccatcacactaggtttatatctcagtttgctaaatttattcctaaataatttggttttgatggtactataaatggattgttcccctacattaattttcagttatccctttgaagatcacagaaatattacaattatttttgtgttgattttttttttgttgtgtaacattttaagttgatgtaaaaaaatctgtttcctattcattggtattttgtttggaatttctattttagaaatctagatttctaaaatatgattttctgtgcctttcttataatatttatggttttgataaaataataataacatcatagaatgagttaaaaattattcctcctctttggggagaaaatattgatgggcatgtgctcattagcatgaaaatggagagttgaagagcccaggtagatgcatctataaactgactcctatgcctaaggctcatggattagtgtagaagtggagggaaaattgtaggagccagaggatcagagagtttgctgtgatactatgtgtcttgggaatgccagaagctgtacatatattctcaccagcatgtttgcttaatttttaaaaaaattttattaaactaattgaatttattttaaaatatacaactcagtaatggcactttcttaagtcatcaaaataaattacagtacttaaatacctcttaaatatacatgatatcttctgaagctaaaagtaatatgcactcaaccagtttttctttttcgtcaataaattactttatttatttaaatcctaaattccccccccccagtcctcctcagtgttctttcctgcatccccccttcccttcattctctgagagggtgcccctcccccagatatcccccttatctaaagtatcaagtctctacaggattaagtgcatcctctctcactgaggaagactaggcagtcctctgttacatatgtgcccaggcctcggaccagcccatgtatactctttggttggtagtttagtctatggaagttcccaggagtccaggttagttgaaactgttagtctttctatagggttgccatcccctccagttaaaggactaaaatgaattctcatttgtagacaacttctcacttctttttttgtttattagataatttcttcatttacatttcaaatgctatcccaaaagtccactatacactccccctgccctactccccaaactacaaactcccacttcctggccctggagttcccctatactggggcaaataatcttcacaagacaaaggtcctctcctcccaatgatggtcaactaggccatcttctgctacacaagcaactagagacactaactctggagatgctggttagttcttattgttgttcctcctatagtgttgcagacccatttagttccttgggtactttctgtagctccttcattggggtccctgtgttccatctaatagatgactgtgagcatccacttctgtattttccaggcgctggcatagcttcacaagagacagctatatcagggtcctgtcatcaaaatcttgctggcatatgcaatagtgtctgggtttggtggttgtttatgggatggatccccaagtggggcagtctcaggatggtcctttccttggtctcagctccgaaatttgtctctgtaactcattccatgggtattttcttccacattctaagaaggattgaagtatccacactatggtcttcattcttgagtttcacgtgttttgcaaattatatgttggatagtctaagtttctgggctaatattcatttatcagtgagtgcatatcatgtgtgttcttttttgattaggttacctcactcaggatgatatcccctggatgcaatcttttgcctaagaaattcataaattcattcttgttaattgctgagtagtactccattgtggaaatgtaccaaattttttgtatccattcttctgttggttgagggacatctgggttcttttcaggttctggctattataaatgaattttatatgaacatagtggactatgtttccttatgacaagttggaacatcttctgggtatatgcccaggagaggaattggtggatatttcgctagtactatgtccaattttctgaggaacggccagactgatttccagagtggttgtaccagcttgcaatcccaccaacaatgaaggagtgttgctccttatccacatcctagccagcatctgctgtcacctgaatttttgatcttagccattctgactggtatgaggtggaatctcagggttgttttgatttgcagttccttgatgattaaggatgttgaacattttttcaggtgcttctctgccattcgaaattcctcagttgtgaattctttgtttagctctaagccctatttttaatggggttatttgattttctggagtccaccttcttgaattctttttttttccattttttattaggtatttagctcatttacatttccaatgctataccaaaattcccccatatccacccaccctaactcccctggccacccactccccctttttggccctggtgttcccctgtactggggcatataaagtttgcaagtccaatgggcctctctttccagtgatggccaactaggccatcttttgatatatatgcagctagagtcaagagctccggggtactggttagttcataatgttgttccacctatagggttgcagatccctttagctccttggctactttctctagctcctccattgggagccctatgatccatccattagctgactgtgagcatccacttctgtgtttgctaggccccggcatagtctcacaagagacagctacatcttggtcctttcaataaaatcttgctagtgtatgcaatggtgtcagcgtttggatgctgattatggggtggatccctggatatggcagtctctacatggtccattctttcatctccaaactttgtctctgtaactccttccatgggtgttttgttcccaaatctaaggaggggcatagtgtccacacttcagtcttcattcttcttgagtttcatgtgtttagcaaattatatcttatatcttgggtatcctaggtttggggctaatatccacttatcagtgagtacatattgtgtgagtttctttgtgaatgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagcttctggctattataaataaggctgctatgaacatagtggagcatgtgtccttcttaccagttggggcatcttctggatatatgcccaggagaggtattgctggatcctccggtagtactatgtccagttttctgaggaaccgccagactgatttccagagtggttgtacaagcctgcactcccaccaacaatggaggagtgttcctctttctccacatccatgccagcatctgctgtcacctgaatttttgatcttagccattctgattggtgtgaggtggaatctcagggttgttttgatttgcatttccctgatgattaaggatgttgaacattttttcaggtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctgggtcttgaattctattccattggtctacttgtctgtctctataccagtaccgtgcagtttttatcacaattgctctgtagtaaagctttaggtctggcatggtgattccgccagaagttcttttatccttgagaagactttttgctatcctaggttttttgttattccagacaaatttgcaaattgatccttccaattcgttgaagaattgagttggaattttggtggggattgcattgaatctgtagattgcttttggcaagatagccatttttacaatgttgatcctgccaatccatgagcatgggagatctttccatcttctgagatcttccttaatttctttcttcagagatttgaagtttttatcatacagatctttcacttccttagttagagtcacgccaagatattttatattatttgtgactattgagaagggtgttgtttccctaatttctttctcagcctgtttattctttgtatagagaaaggccattgacttgtttgagtttattttctatccagctacttcaccgaagctgtttatcaggtttaggagttctctggtagaatttttagggtcacttatatatactatcatatcatctgcaaaaagtgatattttgacttcctcttttccaatttgtatccccttgatcttcttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccaaaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattgaggatttttgcatcgatattcataagagaaattggtctgaagttctctatctttgttgggtctttctgtggtttaggtatcagagtaatagtggcttcataaaatgagttgggtagagtaccttctacttctattttgtgaaatagtttgtgcagaactggaattagatcttctttgaaggtctgatagaactctgcactaaacccatctggtcctgggctttttttggttgggagactattaataactgcttctatttctttaggtgatatgggactgtttagatgatcaacttgatcctgattcaactttggtacctggtatctgtccagaaatttgtccatttcgtccaggttttccagttttgttgagtatagccttttgtagaaggatctgatggtgttttggatttcttcaggatctattgttatgtctcccttttcatttctgattttgttaattaggattttgtccctgtgccctttagtgagtctagctaagggtttatctatcttgttgattttctcaaagaaccaacttctcgtttggttaattctttgaatagttcttcttgtttccacttggttgatttcacccctgagtttgattatttcctgccgtctactcctcttgggtgaatttgcttcctttttttctagggcttttagatgtgttgtcaagctgctagtatgtgctgtctcccgtttcttcttggaggcactcagagctatgagtttccctcttagaaatgctttcattgtgtcccataggtttgggtacgttgtggcttcattttcattaaactctaaaaagtctttaatttctttctttattccttccttgaccaaggtatcattgagaagagtgttattcagtttccacgtgaatgttggctttccattatttatgttgttattgaagatcagtcttaggccatggtggtctgataggatacatgggacaatttcaatatttttgtatctattgaggcctgttttgtgaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctgtttccacgatctgtcctttgaagaaagtggtgtgttgaagtctctcactattattgtgtgaggtgcaatgtatgctttgagctttactaaagtgtctctaatgaatgtggctgcccttgcatttggtgcgtagatattcagaattgagagttcctcttggaggattttacctttgatgagtatgaagtgtccctccttgtcttttttgataactttgggttggaagttgattttatccgatattaaaatggctactccagcttgtttcttcagtccatttgcttggaaaattgttttccagcctttcactctgaggtagtgtctgtctttttccctgagatgggtttcctgtaagcagcagaatgttgggtcctgtttgtgtagccagtctgttagtctatgtctttttattggggaattgagtccattgatattaagagatattaaggaaaagtaattgttgcttccttttatttttgttgttagagttggcattctgttcttgtggctgtcttctttttggtttgttgaatgattactttcttggttgttctagggcgtgatttccgtccttgtattgcttcttttctgttattatcctttgaagggctggattcgtggaaagatattgtgtgaatttggttttgtcatggaatactttggtttctccatctatggtaattgagagtttggccgggtatagtagcctgggctggcatttgtgttctcttagtgtctgtataacatctgtccaggctcttctggctttcatagtctctggtgaaaagtctggtgtaattctgataggccttcctttatatgttacttgacctttctcccttactgcttttaatattctatctttatttagtgcatttgttgttctgattattatgtgtcgggaggaatttcttttctggtccagtctatttggagttctgtaggcttcttgtatgatcatgggcatctctttttttatgtttgggaagttttcttctattattttgttgaagatattagctggccctttaagttgaaaatcttcattctcatcaattcctattatccgtaggtttggtcttctcattgtgtcctgcattacctggatgttttgagttaggatccttttgcattttgtattttctttgactgttgtgtcgatgttctctatggaatcttctgcacctgagattctctcttccatttcttgtattctgttgctgatgctcgcatctatggttccagatctctttcctagggtttctatctccagcgttgcctcgctttgggttttctttattgtgtctacttccccttttagttctagtatggttttgttcatttccatcacctgtttggatgtgttttcctgtttttctttaatgatttctatctgtttggctgtgttttcctgcttttctttaagggcctgtaactctttagcagtgctctcctgtaattctttaagtgacttatgaaagtccttcttgatgtcctctatcatcatcatgagaaatgtttttaaatctctgtctagattttcggttgtgttggggtgcccaggactaggtggggtgggagtgctgcgttctgatgatggtgagtggtcttgatttctgttagtaggattcttacgtttgcctttcgccatctggttatctctgaagctagctgttttagttgtcactgttaagagcttgttcttcaggtgactctgttagcctctataagcagacctggagggtagcactctccttagtttcagtgggcagagtgttctctgcaggcaagctctcttcttgcagggaaggtacccagatatctggtgttcgaaccagactcctggcagaagttgtgttccactcactagaggtcttaggatctcgagtggaatcctgtgtgggcccttgcgggtgtcaggcgactctgctggcaaggtagcccgaggctcgagtggagtggaaggggtttgtgccccagatcaagcccgggtagcctgcttccctatgtaccgcagtctcaggttccgagcgattggattgggtcaggcgctgtgttccactcaccagaggtcttaggatcccgtggggagtcccgtgtggacccttgcgggtgttgggcaagactctgctggcaaggtagcccagggctcgtgtcgagcggaagggacttgtgccccagatcaggcctgggtagcctgcttccctatgtaccgcagtctcaggttccgcgcgattggattggggcaggcgctgtgttccactcaccagaggtcttaggatcccgtggggagtcccgtgtgggcccttgcgggtgttgggcaagactctcgaattctttatatatattggatattagtcccctgtctgttttaggattggtaaagattgtttcccaatctgttggtggccttttgtcttattgacaatgtcttctgccttacagaagctttgcaattttatgaggtcccatttgctgattcttgatcttacagcacaagccattgctattgtgttcaggaaatttccccctgtaaccaaatctttgaggttttcccccactttctcctctataagtttcagtgtctctggttttatgtgaagtactttgatccacttaaacttcagctttgtgcaaggaaataagaatggatcagtttgcattcgtctacatgataagtgccagttgtgccagcaccatttgttgaaaatgctgtcttttttccattggatggttttagctcccttgtcaaagattaagtgaccataggtgttgtaggttcatttctgggtcttcaattctagtccattggttgacttgtctgttgctgtaccagtaccatgcagtttttatcacaattgctctgtagtacagcttgaggttaggcatggtgattccaccagaggttcttttatccttgagaagagtttttgctatcctaggttttttgttattccagaagaatttgcaaattgccctttctaattctgtgaagaatggagttggaattttgatggggattgcatcaattctgtagatagattgctttcagcaggattgccattttttactatattgatcctgcccatccatgagcatgagggatctttccatcctctgagatcttctttgatttatttcttcagagacttgaagttcttatcattcagatctttcacttccttagttagagtcacaccatggtattttatattccttgtgactactgtgaagggtgttgtttctctaatttctttctcatcctgtttttcctttgtgtagagaaaggccactgatttgtttgagttaattttatatccagctacttcactgaagctgtttatcaggtttaggagttgtctggtggaatttttagggtcacttatatatactatcatattatctgcaaatagtgatattttgacttcttcctttacaatttgtatccctttgatctccttttgttgtctaattgctctggctaggactttgagtactatattgaataggtagggagaaagtaggcagccttatgtagtccctgatttaagtgggattggttggagttcctctccatttagtttgatgttggctactggtttgctgtatattgcttttattatgtttaggtatgggccttgaattcctgatctttccatgacttttataatgaacgggtgttggattttgtcaaatgctttctcagcatcaaacaagatggtcatgtggtttttgtctttgaatttgtttatatagtgtgttactttgatggatttccatatattaaatggtccctgaatccctgggatgaagcctacttggtcatccttttgttgtgttcttggatttggtttgcgaggattttattgagtatttttgcattgatattcataagggaaattggtctgaagttctttctttgttgggtctttatgtggtttaggtaccagagtaattgtggcttcatagaatgaactgggtagagtacattctgtctgtctctattttgtggaagagtttgaggagaattggaattaggtcttctttgaagttctggtagaactgtgcactaaacccatctggtcctgagctatttttgtttggaagactattaatgactgcttcaatttctttagggtatatgggactatttaggtcattaatctgatcctgaattaacattggtacttggtatctgtctagacatttgtccatttcacccaggttttccagttttgttgagcatagccttttgtagtaggatctgatgatgttttggatttcttcaggatctattgttatgtatcctttttcatttctgattttgttaattaggatgctgttctgagcccaccagttagtctggctaagggtttaatctatcttgttgattttttcaaagaaccagctcctggtttgtttgattctatgaatagttcttttgtttccactgagtttgattatttcctggattctacttctcctgggtgaatttgcttccttttattctagagcttttaggtgtgctgtcaagctgctagtgtatgctctctctagtttctttttggaggcactcagagctatgagttttccccttagggatgctttcattgtgtcccataattttggtatgttgtggtttcatttttattaaactctaaaaagtctttaatttttttctttcttttttccttagccaagttatcattgagtagagtgttcttcaggttctacttgcatgtggactttctatcattattattattattattattattattattattattattattattattaattgaagaagagccttagtctgtgatgatctgataggatgagtgggattatttcaatcttcttgtatctgttgaggcttcttttgtgaccaattatatggtcattgttgtaaacagtactgtgtgtttctgagaaaaaggtatattcttttgttttaggataaaatggtctatatacacatgttaaatccatttggttcataacttgttttagtttcactgtgtctctgtaattttttccccatgatccacccattgatgagagtgcagtcttgacatctcccactataattgtatgaggtacaatgtgtgctttgagctttaacaaagttacttttatgaatgtgaatgcccttacatttggagcatagatgctcataattgtgatttcctcttggtagattttatctttgatgagtatgaagtgtccctctgtacctttttcgataacttcaggttgaaagttgatcttattctatattagaatggcttctcctacttttttccttgggaccatttgtttgaaaaattgttttccagccttttactctgagtaagtgtctatctttttcactgaggtaggtttcctgtatgcagcaaaagtttggaacctctttaccatagccagtctatgtctttttgttgtggaattgagttcattgatattaagagatatttaggaaaagtgattgttgcttcctgttatttttgttgttagaggtggaattatgttaatgtggatatcttttttttttggtttgttaaaagaatattattttcttgttatttctagggtgtagtttccctccttgtggtggagttttcccttttatcatttgaatggctggatttgtggaaagatattgtgtaaatttggtcttgtcatagatttatttttttctccatctatggtaattgagagtttttctgtatatagtagtctgggctggcatttgtgttttcttagagtctgtatgacatctgcccaggatcttctggctttcatagtctctggcgagaaatctcttgtaattctaataggtctgcctttatatgttacttgaccttttccccttactgcttttaatattctttctttgttttgtgaatttggtgttttgattattatatgatagagaaatttattttctggtccaatctatttggagttctgtaggcttcttatatgttcatgggcatctctttcttttggttagggaagttttcttctattcctttgttgaagatatttgctagccctttaagttggggatctttgctctcatctatatctattatccttatgtttgttcttcttgtttcctggttttactggatgttttggtttaggctttttgctttttatattttctttgactgatgtgtcaaagttttccatggtatcttctgcacctgagattctctcttctatctcttgtattctgttggtgatgctcgcatctatgacttctgatctctttcctaggttttctgtcttcagagttgtttccctttgtgatttctttattgtttctacttccatttttcgatcttggatgattttgttcaattccttcaactgcttgtttgtgttttcctgtaattctttatgggattatttttgtttcctctttaagggcttctacttgtttacctgtgttctcctgtatttctttaagggagttatttatgtctttcttaaagtcctctatcagcatcatgagatgtaattttaaatccaaatcttgctttttctggtgtgtttgtgtatccaggaattgctgttgtgggagaactgtgttctgatgataccatgtagccttggtttcggttggtaagtttcttgtgcttgccttttgccttgtgggtattagttggccttgctgtttttggtttgagcttgtcccttctgtgggcctgtaagcctgtatcagcactccctggagaccagctcttccttggcaggaactgggcacaaagggctgtggaacatccccagctccttcgtgcagatggaggtcagaaggcctgtctcagctgctctactgctcctgagctctgtgagctcttggctggtcctgcttcagacagtcattagaacaaatgacctaatctatgctttctttgtggtacaaagtctagttttctttttagactaaagtctttctagtatttttaaacatcttatttttccttattgctggaaatttttaattacctttctttttcctctttgtctgcatatttcctgccattcttctgtgctgactattttgtctgctacttttctgttttattgcttatatactttttgctttctttattatttcagtctacttaaataagtatcttctttcagcaagtttacttgacaatatagcatattgtttggggtcagcaagaataatgatatctcaatggagtatactaccaattatctggtgactgactctttagatggaaagtactggaaatatcatatcaaattttctattttgaccatccaggcagaatttcatattttttcataaaaatgttttaatcactgagttatttcaattctgttttttactaagaataaagtactatcattgatggcttctcaccagatggtgtgatcccttgatacctcatataaatataatatatatgcattcataccaataattcaggacctgtggcataaatcagtctcctggcctgttacaacagatggagaaaaatctttccattttcatactttgttcgaattcccaagacattattgagcttattctgcataactcccaaatagcacatgaagtaaaagttcagaatatatttttggtataaactaatgttaccattactgacaaatcactatgcacatatagaaatgtaaaagattagctagctgtatgatatagtttattattttattaagaggaaaaactataggacaagaataacaattatttaaagaatgaaatgtctgtatttagtcaaatgagaaaccagatctgtgagaaaataattttttatctttttcaatgtttatttcatactgacacaaatagttaagtgaatatcagtcactattaagatataattattttaaagtttattgtcatagctcaaacttgatagtgttctgaaaatattttttaaaagatttattttcaattttatgtatgtatgatgatctctataataatatgtgcatgtgtctagaacaaaggccagaaaaggaccttggcttctttgaactagaactgtaatctattggatatagttacttggaacagtactcaggccctcgtcaagaccatgtaactgaaaatcatgagacacttcacctttgtcttaaacaaataagctttttttaagtgaaaaatagaattcatttgcaaccttgacttaaaaatttcaaaattgcattggaaaaatagaaaagaggaatatgattttgatatgattttaaaatcatgatgaaagaaagcaccctataatgaaagcaccttaaaccatataatggtttaataattatggctgttgtcttgggtacagcttatagtaactcagcacaaatgtctcctgcttaaaaggagagcagtttacaacactgtttattgacattgtcttgatctttgtacaatatcttttctaccatcttcagaatgaactataattaagaggatgatctcaagaagttctaagacttcaacagggggaattccatatatgataagcttcatgttgtttatccaagttctgacctaacctttggccaaaaatctcaaggtatttttttttaatttttctgtttcttacaatattgtacccttcattcagataaaggcctctctgtaagagtaataaaataaagtctatgaaatatatttcaatgaaagttctatcattgcctattgccacccactcctaatagcacattctgaaaaactatcataaagcaaagcataaatctatacacttgaaaaaaatgaaccgtaccgtttacagaatgtgaactgaagtctcatgaaggaattgaaccatgattttgtatttctattttttattatgtattttccttaattacatttccaattctatcccaaaagtcccccatacactcccccccccactcccctacccacccattcccactttttagccctggtgttcccctgtactgaggcatataaagtttgtgtgtccaatgggcctctctttccagtgatggccgactaggccatcatttgatacatatacagctagagtcaagagccctggggtattggttagttcataatgttgctgcacctacagggttgcagatctctttagctccttggatactttctctagctcctccagtgggggccctgtgatccatctaatcgctgactgtgagcatccacttatgtgtttgtttcttatgtaatgtagtgaataaaatttcaacttgttctgtaacaaacttagttgaagaaaatcttacatgatcaaattaccttcttttcttcttatttctcactctgctattacatagtttttttaatatgtgagagagctagagttatgacagataaagttatttgtatatgattgatagaaaagaaaaaataaaaccacattaacatatctatatcactatggtatctttataagaattgaacatcataattcaaatattactattactgctattactactactactactactatatatagtatatttcattattcagtatatgtaaaagtttcctttgtgatctgcattaaaactcatagcagaactatatgctctaaattatcaattagtttacgaactggaacaatgggagcttacataagttcatacatacaaacagtgtcttttaaaatttgatattacatgaacacaatacatgtgttaaaaatttggcccccaaattttacagtaattaaaggtgtggtgctattgtgatgagagggatataatttcttaagagatttggagaatatggtcacttttcttttactccctggtcaacactttaagtgcttttgctacatcatatgattctgccttgatgggtactttaacagaggtccaagcaatggtaatagtcatcatggactgggaacctccaaaaccatggcaaaagtcctttcttttgataagtttctgggatattttgttacattaatcataagctgactgatgcaatgatgaacctagtattttagagcaaaaattactgccatttcaccctttactctgacctctaagcacactgatgttatagagaacacatatccatctatatgtctaaaattctttagaataaaaattgtttctacaaacattgacacaagtttgtttttacaaaatgccagtgaaaactatatggactctcataagtcatatttaaatatctatgtggtaaccatatgttattagaaaatttatactttacacataaaatatatttaagatattattatagttaaaggcttgatttgtcaatgcaagttaacgactttttttacttaaaaaaaatcaaggtaaggcgaatactccttccttttaaatttctcccttaccttcttaatttgttgacttttgtggctacttcaatttacatgtacataacaaaatattcaatgtcagctcctccatatgagaaaaaacttgtatcatttggctttggggactacaatttctcaattaggatgataatttcaaactctattcatttacttgtggatttcatttcttaggctattgtaaaaactttaagctaccatagtggctggcttggcaatatgtgcccactgctgaaaaaaatggcacagatgctatgggagtaacactttatgcttggatataaagcctgctgcacagactaaactcattccttgtaccattaactgggcacaaatccttccatagtacctaaaggagaaacaactactattattccactaaatgtgcatagtaataaaataaccaacaggttcatatgtttgtatacatagattaatgcctctcaaaactatcatcagagaaaccacattttctcacagtaaatggcaatgaataagaaagattcacaattttttgacatgtagagaataataaaccatcgagtactaacttttacatgggacatttatgatgctttgtatatacttggctcagggagtggcactattagaaggtatggccttattagagtaggtatggccttgttggagtaggtgtttcactgtgggcatggtcccatgcccacactcactctagctgcttggaagtcagtattctgctaccagctttctgatgaagatgaagatgaagctgaagatgaagatgtagaattctcagctctgcctgcattgtgcttgatttgatgctgccatgctcttaccttgatgataatggaccgaaactctgaacctgtaagccagccccagttgtcttggtcatggtgtcagcagtaaaaccctaactaaaacaaacatgtgtatcctacatggtttagtattcatcatggaagaattgacagtaagactgcacaagccagaggcagtatatgtcttcagtgaaactgtatttgttgaaaatgacagaactgttgaagccatgaactcagcagttgacactgcttttacaagatctatacatgatcaaatcagataaaatgtctatatgggtgaagaagaggcacaatcaagttataattcttgctgaggaacaattagcagttggttgctgttagaaaagggagagtcagtttcttcaacatgaagacacagacccatcttccagtaaatattcctacacccatgtaaacattgacactataagtagatttagtgggtttgtcaatgaaaaaaaaagtgcctggagttgtgttggaaagcttaaggagaaggtattagaactgacaagatttaacgtgaggagttaggagtgaatatgattaaaatatgttgcgtgatattttgagaaaattagtaaacatatcaaaaatagaacctgtagagttgaaagagaaaatagtagagggtatgggaaaagaaacagaaggaaatggatgtgtattcgattttatcagcacacattataaacatatatgaactattcaaacagcattttaaaattgagggtagtgtatcctgaaactgacttatgtgtcaatactgtagcttatagtgcaaatcattacattaaattctggatgctcctcgacttactgttataaaagagacaggtagctaatatttctttgtcccacatttaagatctgtgatatatgatgactttttgttacttttcttctattgggggactgtatgttaaagatgccctcatatataatttttgagataaatatattttaatgagtcactgaaaatattctatacaattttgagtaactagtgaattaatttgcatatttaactcacaatttaataagcaaaaaatatttttgtactactctacattagaagataatctcatacataaatataatatatttgatcatattcatccactttctttaaaagcaagattactgtgtgtagcatgtcattttataaaacccaggcttggtccagctagactctgggaccagcagtcaccagcccgctcctcctagccacacccctctcccacaaatgctggctttgcctctccagagctacaagattgctctcttgccagctaaccaccgtgtggccagctctgccagtgtctgtcctagtctggctcagctccctaccagaccactttaatgccgcgaatggaaaataccagatacttttatactttagaactgaccagataactcaaaggctggataaagactatcctaccccatcttccttggcctctgcaagctgtggaggccacaaaactaccagtgccctgagaaacctacatgtctgccacttcaccaccacctgcctaatctgaccctaatcctctctcctgtcctgcccagaaaaccctgcctccatatcttcaaccagtgattaccttctactgtcattattaactaatcaacaattagggaaaataattaggaaaagaatcagggaaactccccctataactttcaagttacactggtgcattcatgtgttgaaatttgaaactataaaactatttcaaagaaatcagaattcaattgtaatacataagcaagaacaaactatcttttttttaagactgtagaggtagaaatgtaaaacaaattaacattaatccagtatgtatatttaagtaatgttttttaatcacaaaatttatcttaattttaaaattaagcaataagtaaaatcaaagaaaatttatttggttttatctatgtagctcctgaactacagtttagttggttggttggttggttggtttattttttcattttgttttatacatattgtaagaaagaatttcttctctgtgtagccctggctttcattgaactcattatgcaaaccaggccacttttgagctcagagataggcatgcctctgcctcttgggtgcttggagtaaaggcatggaagttttgtaatcacatcatctattggaaaacatgagaaacctgaagtatgttggttccttttcctttaactgattactctatttaggccacaaacagtatttggcagtaaaggtaaaataattacagtttgttagaacttaatccatatggtaagtagaaaaactgtctttaagtggcctatagagaaaaggcaaaataggatggcatcttctttttcttttcttttcttttcttttcttttcttttcttttcttttcttttcttttcatttcttttcatttcttttcatttcttttttcctcttctcttctctttttcttttcttttctattttttattttttagattagagggatttatttgaaagcagtccatgacctttagctctttacaaatgaagtggttttgtctggctcctgctccagctacaagtctggatttttcagcgttttgatttagggccatatttatgaagcagcctttggccctgctggcttactctcttgctctcacagtgtctcttcgggatcctaaaggcaaggtcagctcacactcgtgggtttcagtctctgggttgttacctaggccacaggagttcttactgcatcacagtggccattgtgcaagggctcctgtagcttgtattccttgaagtggggttcttttcagtggttgctaggatacatcttcagaatctgctcaccctgtaagcccagctcttggaggtggaggttggaagatcaacagctcaagatcatcatcagcaatatatccagttggaggccatcctgggctacaagacacttcttagactagtgtttcagtctctgggagcccccagtggtccaagttagttgactctgctggtctttctgtggagtccctaacctcttactgaccttcaattctttactcaactctctcttctataagactccctgagcttcatctaatgtttgagtgtgggtctctgcatctgtttccattggctgctgtatggagcctcttagttatgctagggtactaggcaaaggcatcttctttacaatcagacaattactgagactctcagttctatttggttcgaacacttacagcattggaatgagctatttatcctatattgagaatatttttcaactcttcttttttttttctctctctagggaatgtgataagcaccattttctagtgtctttatactttccactgtgggggaaaactcttcagaaaatctttagtctttctatattttgtttcccctcacaaagatttttatgttgaaagatagaaaaacaccctagacagtctcctgaaatattggtctgttttctccttgaaactagaatgccaaacatattgtaaatcctttgagtctcaaaagaattctaatctgagccttgtgtcctcaggatatttaaactttgatttatttcagagaagagttaacacagttctcttatcattttctctactatgccttctgtttatgattgagaaggtctttactaagggttagaattggggacaggaaagtgggaaccatgaaagtgtagtaaatggcagtaaataatcttttgacaaggacagaaagtaagggaaaggtgagaaagaggatgttctaatctattgttttcaaagacaagtagatttgagttgattaccaattctggatagctgtcacttttcaatccagagagttcttaggttttttttttttaatttttaaattttttttattgacaacccattatatagagatcagtgaaacatagtaaccattgatatatattttaataaaattgtgatattcaagataatatttcttttgacattttctatttccttttgataacttttgataatccacattttcaatacaattgagctttgtggtgatgattttgtttagagaatatctaccaaataacaacctttgataaatgatttaacatagccatggaatctttctcactcatagaaagtgtgcatccaaataatgggtattagatcgaggcctttgtaaatgtaaatatcagtgactccagtcttggttttctgtgaattaaattttatgttttattttacatttgtataaatatataatggtatcatattaaaatgtttgaataaaatgaaaaactcctgtttataactaacattgcactctcagatcacagggtaataagtgttttactaaactgttaactgccaaagtaatacatagctataaaactttcaagaagaaagccaattcatttcaatcacgatatcacctaaaactgaagtattatataaaagctaaacaatgccaaatggatttggctgagatcaaaagccaaccctatttcttttctttcatcttcagtgttccatttcctaggagtatgaccttagtcaaacatctattaaagttagcttttgatctcaacccccctttcgtttttttttaagtctatctttaaatttttcttcttgagacaatcattctattgtgttttaatgttccagtagtgtgtgagtaaataggattctctgatatatgtgatagaagactggttaaatgggacaatcatttttgtgtcagagacaagaatcaaaggaagcattcttcagatgctattaactgtggggaaaattccctgcaggtcagtgaaaacatgctaactggtcattttgctagctctttaggtctttgaagaaaatgccttgtaatttgataacatgtagctgctcatttgtaaaagtaattttcttcccaccacttagagccactctgtggtttgtgaggagcagatagttctttaagcttgtatattaaaaagctgaaaattttgcttaaaaacactttaatatattttagaaaaataatacattttattgcttgtgccattgaataaatatggcataaagcaatcttcatgtttgaataaaaatactagaaagattacaacaaatgataattaattgaatttaaaaataaattgcatgtgtgcatttgtaagtacattttagccactgtatgtctacatgctaaatactgagaactttatcttcttttggagtactttgttttatagactagtaatttattaatattctaacaatgctatacccttgaaaaagtattctagatccttttcaaagcaaaaaaaaaaatagtaacaattagtaagtattcaataatagttgtcacaacctttgatttctgtgaggtaaagaaagcataaatgcaatcataataaaattcagaagagtaatagatatccatatatttgtgtagagtactctataaaaatgaaagaataaaatattgtttcaagttgttagaataaagcaaaatttcaagttaagatctaaagtgatactttaaagattggttagattaaaattacatctcaagttaaaagtgacaaatgcacagaaataggaagatgagtcctagctaatgtgggcaaaagggttcattctatctagagtagtgaatgtgcgatagaaataagtaggaattctacattaaaatgggcacagtaagatttcatgaggttatcaataccacatttttaatttagaaaatcattgcatagaatgttaggaagagctagatacctttgaggaatgttaaaacatttatttgtgagaatgtcactaattaaagtatatagcctgtactgaagaaaaattggagacttaaagataattcagaaagttttttttccaatagtctggttgaaaaataatatagatattttagaataaaatgcctcttatatagtcagtgtgttctgttttacccttgtgttagttgattgtgaagtaaaggtacttctgatcagctttggaaagataatcagtgtagttattggtagccacaacaatggaaactaaaaatcaaaatgtatcttgtatgtaactttgttgttttatgtacccctgttaaagttcctatatattagaatcaattgctgtaaagcagacagaatgaaaaaaatattttagaaaatatatttgcatcatctgtgacatataacagttgttttaaaaatgtaaactataattatgcattaaaaatctcaataataactggttaaaaatcataatttgacagagctatatattttttattactggcatcttcaacagaaggaatgaagctataactcactttgaaattatacatttgacttcagacagcccattatttatgccaactgtttgaaactgttactataatctttctggaagcgcattctttaaacaacatcaaagacccaacacaaaatggcaaaaggcacaaatcaaatgaaagaaaagaaactaacaaaacaaagtttaattataattctttccactaacatatgggttatgtatgtaaatgtattgatgtgaaatagttttagaatttgcaatccacaaaagactgaattccttatctcaacttcaaaacagcatagtatttcttacagtgtattaagccatttcatcctcatctatgtcccagctgtgtattgtttgatcatttcttgctgtggaagttttgaggtcaaatatattatcaccaaaatgtttgtaattctgactggaaaaatggggttaagaaaagatgaatttctttatggcttttctttcacttgatcgcttttttttcccattttttattaggtatttagctcatttacatttccaatgctataccaaaagtcccccatacccacccacccccaatcccctacccacccactccacctttttggccctagagttcccccgtactggggcatataaagtttgcgtgtccaatgggcctctctttccagtgatggccgactaggccatcttttgatacatatgcagctagagtcaagagctccggggtactggttagttcataatattgttccacctaagggttgcagatccctttagctccttgggtactttctctagctcctccattgggagccctgtgatccatccaatagctgactgtgagcatccacttctgtgtttgctaggccccggcatagtctcacaagagacagctacatctggatcctttcgataaaatcttgctagtgtatgcaatggtgtcagcgtttgggtgctgattatggggtggattcctggatatggcaatcactagatggtccatcctttcatctcagctccaaactttgtctctgtaactccttccatgggtgttttgttcccaattctaaggaggggcatagtgtccacacttcagtcttcattttcccttagccacctgaagctattggtcacaagaagaaaaactggtttttatctctttctgaatttattgttaataagactgacagaattgtgggaagccaaagaatgtgccacattataaatcacctagtcatgtactaactgcacatagtgtccttactgcatgtgtatgtgtgagtgtatgattatggttctttggtctattctttgggctaatcatagtctttacacatatttttctattattctcaagaagaaattcatgtcattagatactttggggcaacaagggaagaggtcagtaatttttgcaccttgtcattatactagggcacaagaaattggtgggtgcctatagttcaaacacatactattgttgccctagttgatgagaatattctccagaaattttagtaaaaaataatcactgtgctttcatatttttagaggcaatgactcagtgtcccaaaccccatctattctagaaataatactgctctggtaatagtagtaactctagttaaaaggtaataaataggtgttagggtggtttggtacctgggcatgggggaacatcccccttttcagaggtgatctgaaagggtggtgtggagaaggttcatgtgagaggatgctaggaggagagggggcttcctattgagatgtaaacttaataaataaattaattaatgaaaaaagaaagaaaagggatgctaatatgatacagacttctaggtcatcataataaaacgtcaaagcaattttttttctggtcacagaaactcagtgtaaagttttaatacaagagtagcattattagtttgttatatttagctgttaaagtaactgaatgagtttcaaaggtcctcatggattctaattcatgtggcaaagtaaaataggctttaaaagcttctcttgtatccatgaaagactcaaataccagattaatatttgtattgtatctgtttgcttttccatagcactcatgtgcaattgatcatgtggctgtttctggtatcttcctgtgcatcactatattatttgatgtggatatagttgacaaatccatatttatactttatctatgtaatatatgtgtgcatggcacatacttacattctccaaaatctgtttttttctcttttagttagaatataagtatttagaacacaaagtgttataatgtttaatgaaaatagcaaaatatcaaagtagttgttttttgttttttggctttcaacatttttgagaacaaatgtcacgaagagtgaagacccaactacatgtttgattctctggtacttatctgatatgtctcaggaaagagtggttcctaaaagatattagaggaaggaagccaattgcctttctggagtgtggtgcattactgatttttcatattttcctagtagcagtttgataccctttgacaaacacaaatcacatttgaattatctttagctgctacatggttaaaactgcagtttaattgtagacaagttatattttgaatatgagggtaatttcccattcattttgtttctatcaggaaatagacagctttcctcttattttgctttctaaataagaatgtattttactttaatttgctttggaaggtaatctttatatttaacaaaagaagaactgatctcccaaaaatgaagtagattgatgtgtatttagccagatgaatggtgtgtagacaatgaaatttcacagaaattacctctgattgtgaatggtaatataataaaacattttatcttaatattatacctgaaataaaaattgttaaatgatatcctaaacattgtactccctgaaatctatatggcaaaatacaggtaaataattaaatatgcttctcttttgagaacgatctaggcatgagatgtatacgcatgcttaatttgaatttgtctaggtcttctcttttcttccttcatttcccttgctatggctagtttgccctcttccacttgtccctggaagtcataactgctacaaacaaacacttgattatgcaaatgtattcattatttgaattaatgactgttattattgttctttacatgcaaaaatatcagtaaatgaattagtcaagtatgtttgctttcagctttcttccgataatgttatctttttctagcaagtttatccttataaaatgtttcagggtcatataactgattgctttgttgttataatccagtacactgccagtatatattaatttcagtttaaacattagatgtaaaacataaatacccttaagcaattttcaaaaagccaagatttgtacttagtatcaatgctaatgatcctttgtttctattttattgttattagtatttgattataggtgattgctgatggaaccaaatacaccttttattcttttaaatatacagtttacccattttaaattattcataccagtgtattaagtgtattcaaacagttgtgcagtcattaaacagaaacattggagacattcccatgttgtctttatataagaaccaagctaattttctctgtttgcttcctaattttgcattaatactgaagttagcattctaatttgttttggaaagttcttcaaatatatatgtctctgtttgtgtctataataacgaatttaagccctgactaataggaaatgtaagtgtgttaccaggtatgcttgtccctttgaagcaaggctgcaatgaccatttggagatctgttcaggagtgtgaagttactgtgttactgttttgggtttctcagcattacaggttgtttttcagtttttctaagctaattcttttttttaatagttattttcttcatttacatttcaaatgctaattcttagaaccagttattcacattccaatgacataaattgcaagagttttgtcatatctactctctatataacgtacattctcaaacagacttacaatggatctactagaactagaacttacagtaaaaaggtcataaacctatggagattgcgacagtaaggttatcagaaatgatctttatgtgacttgtaacaccatggaagaatgttcaaatgaattaccttagaatttgtataacataatagaaagtattctatctactgttcataagtcaatatttatcatttttttcttaaaatatcctttggtgttatgagcaaagtaattgacaacttttttgtgattaattatagatagctggaatgttttccatttaaaattatatcagaacttacaagtgtaaatgattattattcaaagaaacattcaaatgcaaaaaacaaaagtacccaagaagttgaatttgcatccaagtcagaagcctcattatacctttctcaaattagtctccttatagtgttattatatttagagcagttgtattctatgtttaaggtgataagcattgcatctaaaacactgaatatctgcagtaagaaacagagaaactaaaaatagcagctagcagtagatatgctgtgggacttgagaggctgaggcaagaagattgctgtaaagggaatttagcctagattataggatgaaaccctgtgtcaaaagccccacaaaaagtaaaggaagcaaagaagatacatgtcttaattgtcatttttctctctggctcaattctgaaattaaaattcactgtcttatatatcttccaagcttttcattttaaaaagcaagttaaatattaacataaactgattgcatccagttttaatatctagcatacctggatgtaaacccaaactgagatactagttactctttaagattccaggattcaggatctgtgcctcattttcctcatttgatcaatgtcaactgtaaggttattatgcatataaagttaaaaagtagaaaccatttaaacaagtacctgtttcagtaatgccatacacagttttctcttatgtacctagtatgggcgagtttggtctttggataactttatttcctttccaaccctccccacttttggaaaaaaggaataatacaatttgtgttgtagaattaatatttatttgtttataataattattatttttaaatttatttttattaggtattttcttcatttacatttccaatgctatcccaaaagtcccccataccctcccccccccaatcccctacccacccactcccacttcttggccctggcgttcccctgtactggggcatataaagtttgcaagaccaatgggcctctcttcctaatgatagccgactaggccaaacacagcttataaatgttgtttaaaaaaatagtcttgctatgttgttactttcttacttataattattgaggagcagatgaaatggtatttgagaagatttttagtttttttagattgttcaatgcctattactttgtttagacaaatctgtataagagaaatacatagttgcttagcaactgaaaattttgttaggcacataaagccacagtaatttgttcaaaatttcagccagccttgtaagttgtgttttggttgcactctaaaatgctttgccaatggttaattgtcatttccctctctggctccattctgacatcaaaattcacagtcgtattgtacatcttccaatctctcaattacaaaggttaagttaaatattaacatagactgattttatccactcttaatatctatcttcaactcacctaagtctacaataaagtttctttgtgtgtgtgtgtttgatatctagtgactatactatttcatggctaaatctaagatctatctgatattgagcgaacatgtagtttgtcaagctttccctcattcaaaaaatctgcattattttttaatattttgtttattactccatggtgatcagaagagtcactgtaatgttgatttatatttccttatcaatgccttctttccactgtcattattggccgttttatttagttacttgcctatacttatttttaccatttttgacaatttcatacatgagtattatacttgcatcattttcacacttccctctccctactctaatttgtttcttgtacctacactctgaatttcatgaatttcatatatatatgtagtttttataattaattattttttatttacatcccaaatgttatccatccttctggtccccgctctcagaatttttcaccacatctcccattctctttgcctctgagagggtgctgcatcctcagcatctcccttccctgggacacccagtctgtacaggattaggcacatactctcacattgataccaggcaaggcagttttctgctacacatatgcctcgggccttggaccagcctatttatgctctttggttggtgacttagtcactgggaacatgcaggagtccagattagttgatactgtttgtctccctatggggttgccatcatcttcagtttcttcagttcttcccttaacttttccttagggatccctaaccttagtccaatggttggctgtatctgcatctgtcccagtcagttgctggtagagcttctcagaagccagcatgctaggcacctttctgcaagcacaacatagcatggtttggtgcctgcccatgggatggatctcaagtagggttgatcactagtaggccatcccttcagtctctgatccatttttgtccctgtatttcttttagacaggaacaattctgggtcaaatttatataaatacgtacatatacttaggctttgccacttgagattatataatctgtcataggacccttactagtgaagtgttattcctttctgtagattgccatctaagtttgaggctttgtgaatttttctctattcacattttcaggtcaagtatcgttattgttcaggtctgttttaggcaagcatattgagatttcttgggtacagctttccctgtaatgcaaacatatactattttgtagtagaggaccagtcctcctggctcttattctatctcctcttctattatactccctgaacattaagattaggcattgtattgtaagtatatcaagttggtttgggcaactcatagtcaattgatttttgttagtttttttttgtatttatattttatcagttttacatttctgtaattgcttctaattttcaattcttacaggtttccatttattgcattctgatgttttaaggtaaaagtggtagattctttttagtatttttgtgttttttttgtgggcttttttgcatagagttcagagaattaccatcttgtaacaaagaacctgaatactatatctatctagaagatttacattttcataactgacttatagggaatttcaaaggtgttttagtacatcatacttgaccaaaagcaactttaattgcaaagaacaaataagtcattgcatggtacttgaaaggtagattgaaattatatgaactgttttacatttgggaggtatattattggcagaaaagctttcaaagtgttatgaagtgatggtcacactataaacaactaggaaactaaaattttcttccttcttttcaagtcacatcaagaatctatcgtaattatcttttttggtagttttgcccttataattttaaaatcatttttcataaaacatattttgataaagttcttttcttacccaattcctcttagaactcccccacatccctaatcacccaaactcgagctttctatctcacagcaaaacataaatacattttctccttcttaattttgttacaagttatagataaccttatattaatcttgtagtttaatggctataattataatatatttgtaaatttaatattcttttctaatgaaaaatattgggaggaaagttttctgtaggtatgtacatggataataataatgataatgattaatacaaactacatggggttttcacaaaagcatataatagaaagaaaatggtcaatggattaattgttttataaggtcattctgagaaaatttagtctagcttttttctgtatatatattgataactgaaagcacagcaaaactatataatacaaatacccccaataatctgttcagtgactgagatgacaaaaatccattttggagttatttgagttaaacaagaatcaagaacagaggattagttgttgaacccttgaaataagcaggaggcaagaaaacttctgtactacttactggccagctccaaacttaatacaagttccattctgggtttcagagatcctcatttataaaaccggaatgctaatttaagtatttatgtaacttcttcctctgaagacgattcctagattctttaatcctaatatagcatcacatgtacttaataggattatagagtttagaatattcttatgttgaacttaggttaagtggaaagtgtagaaaaatatacaacggggcagtaataccctcctcaatagcatgtgtttgaaaaaaactgggtatctacaagcagaaatgggagactgagctgttgtccaaatgaattaaaaacttaaactatgtgataagaaatcgcacaacttcctgaacaaagtacagaaaaagctcttgacacttgctgtggaagtgattccttggagatgacacaaaataggtgatcagggggagaggagacaggggattttcggagggtaaactaggaagggggataacatttgaaaagtacaaaaagaaaatatctaaaaaaagtaagatcagcatacacacaaaatatagacatgtgaaaagctcctgagcagcaattccttgttgaaataaaataaaacaaaacaaacctaatgaaatgaaaaaaaaaatttctgaccacttatccaagaaaaaagttaatattctaacatatgcacagaagatttaaagctcaataacactaagaacaatgtcatcaacaacataaatatatactagttgttacatgtaggaaaatcagaatcagaactacaaatcaatattttatttctcttttaaatgcaccattcatgatagccaaaatataacttacatttctatgaacagatgtgtacattacgaacttattcatgtcggggggtggtggtgcatgcctttaatcccagtacttgggaggcagaggcaggcagatttctgagtttgaggccagcctggtctacaaagtgagtttcaggacagccagggctatacagagaaaccctgtctcgaaaaaccaaaataaaaaaagaaagaaagaaagaaagaaagaaaggaaggaaggaaggaaggaaggaaggaaggaagaaagaaagaaagaaagaaagaaagaaagaaagaaagaaagaaagaaagaaattattcattatcaatagtatatcaatagtatatacagtggaatatttctaaacttaaaaatagattttgttatttattattacttgtgacatatagatgaacatcaaggttattattgtaagggagataacctagacagaaaaatccatggaatgtgttatataatgaatataaaattctcagagttgtagatgcaaagtgaatttgcatgtaggtttgacagtgcagggatcaggaaaatactagttaaagggtctaacataggatgatcaaaggtgtgcatatttaagattttgtttctccttgtgcatctcctcatggatcctccacaatgattcaatcctgttcattcttatttttttctttttctttatttattagatattttcttcatttacatttcaaatgctatcccaaaagtcccctataccctccccctgctctgctcccctacccacccactcccacttcttggccctggcattcccctgtactggggcatataaagtttgcaataccaaggggtctctcttcccaatgatggcttactaggccatcttctgatacatatgcagctagagacatgagttctggggatactggttagttcatattgttgttccacatatagggttgcagttccctttagctccttgggtactttctctagctcctccattgggggccctgtgtctgttcattctttttctctctctttagaaaacaaacagtaaatcaaaaagcaaacaaatgaataaaaaaattaaaaaaaaagaaaattcatgagaaacacagagggacacacaaatgaacagaaacaaattccatcaaaacacaaaatcagaaaacataatatatagaaaaacaagcagtaggattaaaatgtccagacctccttggagaaaactaatctttcttttgcaagagttttcaagtggagatagcttttttgttaaagaaggggaatcctttctgattcatatggacattgtgcatgctgcccttgtctctgtgagtccatatgtacctcagtcctgctgtgtctagaagaccttatttccttcttatcttccatccccactggttcttacaatacgtctatctctcttccatagaatttcccaaaacctaacatgtgggatttgatggacacattttgtttagaaccaagaattcccacgttgggagtgcaggttttattttggctattcttatcctagcctgtgccccagaatttacactgcaggaatcttcataaaggatatttatgacacagattttagtaatggtttaatttatgtgtttttacctacaaagacatcatgttatacactatataagtgtagctttttatatgtactttgttctttaatgaaacatgaaaggaagtagatagcaaattaaatattttaaaaatataattacaaaggataagggtatagactgttgtatatgccgcatgctatcatatagtctgtagtcagagtaactacagtctttctgtttactctactgtgcagagacatagagtgtgttatgcagaggtcccaattatgactgagcattccaaagaaacttattatctgcactttgacaattaataagtctctacattcattgtcatccactacataaagaagctttttggatgaggaatgaaagctacactactctatggtcatagtggtatatacttagaaacacttgaataataatatatcaatttaatataataatagtagttgatcctccccctaagatcttcgagctttcttatcaggtcttcttggttagatttacatcaccagatagtattttcctctttaagggagtgtcataaatttattcagacatcattttttaccatcataacagttatttcacctttgtgtttgtggctatattcttgctagactgattgatattgtagccctcagggttcacaactgggtaagagtgttgattactgtttccctcatcaagctacattgcaacttctggcactatggaagcttgccaaacgtgataaagcttctagatcagaaatagctcgatttaatttcccatgtagtgctttcagccatggggtcttactctcaacttttgttaggagaacaggaactatgaacacaaccagtatttttagggatctttaagtcttccaacctagcagattgatgggacatataacacttctggcattgaactttttatttgaagggactcaaagttcatatgatgcaaaaggtaagcagtagtggggtaaaacaatattttgttgatatgactgttatatttatggactcacagcagctgtggttgtctacataatgcctgcacaaaattaagtcagttagaattcaagcatagatatggaagggactcaagtgcttacaatcctaactgaggagttattgataattaatgggtaccatatataagagttggtttttagagatgtgccttctggtaggcagaccatgcttcagttgatgtacctatagctattcataatacacccattatgaatagctcactaatatggctgccttaataagacctaagcaataaaaataccaatagacatgttatcaggaaacatacatgcaatgtgaaaggggcaaatctcctgatttaccacctgtagataaagagctacacacaactaaggactgttgagaaatgagtagcactaaataaatttagatgactatgaaataaatttggagggaaaattttggagagaggatttggaaggagtcagaaggaactaatgagattgcatgaaattgtcaatgaatttaaaatgttataaatgttaaaaattaccatgaccaaatattggtctgataatgaaacaggcacgtaagaatagaggttatagaagtaaatgttcaaatataagtaagtgtaatatatatgcatttccttgaaacatgggtatgtcttccattctaattatatttcagtcccttaaatataaatatttttcattttgtattttaatataatttttatttttaaattagatataattacattattttgtcccttccctttcctttctctaacctcttccatgtaacctattctctctcctttcaaatccatttcttcttttagaaatgcttattattgcatatatatataaatacatcaatttagaaatatagaaaattgactccattcagtgttactagtgagcatataatttcaatgattaccatttggtttagatattcagttgaggattttcatccctgcagatgactaaaccacattctctcagcagtttagaggtgggagctcatgaaattgactcttccatgacaacatttgttattggtactgttcaggtctcatgacagccatattcttgagctatcataggtgtttgttggagacaaagtcacatctgattttctggtctcagaaaattattttccactatgtaccttgagcattagatatgggtgttatactataaatgtatccagtgagtctgggtactacgcctgagatcaattgttctctgcatattgatcaattttgtggactctgtgaaggtttctcttctgcatacaaaagcattctttgatgaagaactagtgcctctcttatctatgggtagaaggataagaatttaaaatgcagttaggacctatgatagcttactaaaatggtaaaatgatcttctataagatccaaaatatcagaatccctggaaactttgataaactccagtatcaggtatgattttcatcctgttgagtaggttttaagtctaatttatgttgtttactaaacaggtataactaacaatattatgcttgtaggaatatcttgccaagaagatcattattggggttcataggcttcacaaattggcaagatctcttgttagcagtatagttagtattatgtggtattatcaaagctaatcctcaaaaagaaggctttcaggatagatgcagttcaaattctctgagtcctatgtctaaaatgcatagtatctttgataataggaacttcaacctttaggatcaaccaaaggcaatgagaatagcatgtattgattttggaatctcttgaattctcctaacaacttaaaatggattttgtcatgcctagcaacagggttcttgttagtgatatgacagtgtgtgtgtgtgtgtgtgtgggggggtgtgtttatgtttatcccatgtgtaaatgtgtaatgttacataaaactaatatgattctttacggctttttcaatcacactcagtatttttctctcttccaccccctccttctttatggtagttgcctcaactaaagcctcaacccccatttttttttcaattctaccttcatattgcttgtatcttgccactgccctctctacctctctagtgcttcccctcctatagtccttttttaaatttacttatctctcctccatcccacatcccgacttcagagggtggacccaacattgaatatatccattcatcctgacacatcaaatcactgacagattaggtgtatcctctttcactgaggcccgagtaggaagccatggagactgagctgcacatctgctacatatgtgctagagcctcattgcagaccatgaatgttctttggttggtgtctcaatctctgagagttcttaagtgtccaggttagttgactatgttggtcttcctgtggggtttcctccccctttagggactataatctttccctcaactcctccataagtgttccaacctccagtctaatatttgcctgtggttatctgcatttatttcagtcagctgctgcatggagcctctcagaggacagttatgccacctgtctgctagcataacagagtataattaataatgtcagggaattggccatgggatagatttccaggttaggttggttattgtttggcctttccttcagtctctgctccatccctgcatttcttagagacaggaaaaattttgggttgaaagatttgtgggtgcattattgtccgtatctctccactttaggccctgccctggctacaggggtgacctcttcaggttccatgaccccaatgtttggcatcttggctatagtcactcacattaacctggaaacctccagtattcaagctgtcttagacttcatagagattcccctctccctctcacccctagcagctttagatttctgttcatatatacacagattttaagtttttgctgttaatactttctttacttaaataatgaataaagtaaacaactgtaatttttaatctttttacttgtttctccgtgcttttaattggggataagttaacccatagtctcatcttttaaaaatatattttcgtgatatttgttatcagaagttattatgagttgaaaatatagttttcaaatattcattattttaatgcttacttatgttttacctttctgcatgtccatcgagcacatttcttttaaataactccccagattttcctgtcattaaggaattattcccatttttaaattgatgattctgttttaggtatcacagctgcagcgatggctgaggccatgaagctccagaagatgaagcttatggcaatgaatactcttcagggtaatggaagccaaaatgggactgagtcagagccagatgaccttaattctacgacaggtgagtgatgtcggcagttgcccaatggtgacacttgctgttttatcatatactggaaaagagaagaaaaaaatgagtgagaatagttattctagagagagcttttaactttttaaaagcatgtacactcaacttagaaaactattgctggtataactgtaaattcccattttatagacatttagaactctctgggttttgtgtgtgtgtgtgtgtgtgtgtgtgtgtgtgtgtgtgtgtgtttgacaagaggtttctctacatagcacagattgatcataaatccacacctttcttcttgcttggaccctatgtctgccacctttctactgttttgttgtgtaatttcattctaattgttataatattagctatcacactccatatctgaaaaacagtgtcctattctagatgaaagacatacttcttaccccatcattctcaaaatgaaaggcacagcccatattccaggttgactggatcaatcttctcagttgtagaactacctgttcaggtagattctgctagattcaaaccattattgaccatgcctacgttaaaaagcagtacaaaagagagctaacaaagaagcaaagacaggagagagaaagaaacatacctatagtaattctatgacaattgtaatgtgacctttatcatttaatagtgttcttatatttctggagtatgtgatcataactcttagcatatatggataaatagattaataaattaatgattaagatttgatttaagagaaaaataacaatcaaggcaacaaatatctgttgcagaagctacaagttcccaagctaaaattaaactcaaaatagtgcagcaaatagattggtcggcttatttctttacaactaggctctgagaaaaaagaatgctacaactttattttgaagggaaatggaaaactgaattaaggaggaaaagtatttaatcaaatcaaaatgtaaaatgactgattttaatacactgtggatctctctatgtatacttgctatgttcctggtgaattacagacttagatcttctttgagccagtggtatttttgttgtatacttctgtattagtcagggttctctagagtcacagaatttatgtatagtctctctatagtaaaggaatttattgctgacttacagtctgcagtccatttcccaacaatggttcagtagtagctgtgaatggaagtccaaggatctagcagttactcagtcccacaaggcaagcatgcgaaggagcggagcaagagtgagactcccttcgtgagactcccttcttccagtgtccttatatggtcttcagcagaaggtgtagcccagattaaaggtgtgttccatcacacctttaatcccagatgaccttgaacttggagatctccctgtattaatcatctggaatccatagccactatgcctcaagatctccataccaagatccagatcagaaacttctatctcccagcctccagattaaggtcactggtgagccttccagttctggattgtagttcattccaaatatagtcaggttgacaaccaggaataggaactataatatctttggtacaatttaacaggaaataagttgaaaatgcatgtcttatggatttataatatttggactgctggcttctataattcccaccaaaatacagtgaaagggttgttctaatatttgtagattttcaaataaaagaaacagaggcacacagtaatattctttgtctaagtcataaaactattgaattctagccttaaatattgatctcacatttgactcagtccaaagggttgatatttttagcattctgtctagtcaccaatgctgtattataaaaagactgtgtcttgatctaatcactgaactaagaaaatatcaaaatgaatatacaagaagaaaactaccatcttctatctcaaaaggcctatcaactcaagctgaaattcagccttaaagtgtcttaaatgtgcccagagttaaaccaagatcagacaggaggctagtatggctgtcttctgagaggctctaccagcaactggctgagacagagacagatactcacagccaaccattggactgatgtcagtggcccctatggaagagttagaggaaggactgaaggagttgaaggagatgacaactctgaccaacaaatgccaattatcccggactcctgggggctcccagagactaaaccaccaaacaaagagcacagatgggctggtccaggtcctctagcttatgtagcagagggttgccttgtctggcctcagtgggagaacatgtgcctaatcctctagagacttggtgacccagagatggaggatgcccaaggggaggtcaccctcccagaggtgaaggggagtgaggataggggaagaactcttcaagggaggactgagagggagggcaacatttgggttgtaaataaatataataattatcattattattaataaaccattttaatatgcaaaaatgtgatcagtgtaagaaaataaaaaccttttgaaatttaatgtttttatgaagaaataatttactcagtatcctacactatatatatttcaggatatcacaaacaattttgagcaacataccagtgctccaaaatctggcagtaaataattattgttattttctagatacaatcttcttcttaagatgtaaattactactgtaaaattgatttcctactgtatttcatgctatatgggacactatagaaacagaatacagtagtctctgttatggaccaggcaacatttataacccaatttcctcattttgatgtagaaagaaattgtttgtaccctgtgtagtgaaggaaagcaaactggaatattcatactggtattaatctatttaagtttctgagtttttaaaagcctgcataattaaaatcttgatacactacaaaataataaattataattttcaaagtttacattaaaaatataatcttattttaagaattttatgtgacatatttttctttattttttaatttttttattacatattttcctcaattacatttccaatgctatcccaaaagtccccccccccactcccctacccacccattcccatttttttggccctggtgttcccctgtactggggcatataaagtttgcaagtccaatgggcctctctttccagtgatggctgactaggccatcttttgatacatatgcagctagagacaagagctccggggtactggttagttcataatgttgttgcacctacagggttgcagatctctttagctctttggatactttctctagctcctccattgggggccctgtgatccatccaatagctgactgtgagcatccacttatgtgtttgctaggccccggcctagtctcacaagagacagctatatcaccattgcatacactagaagcgtttgatgcaaggaccgtgacatatttttctgaacctgagagagtagtatgtctttgatgtctttaggtttcctatctcaggatttaaaatgagatcaaagactgggccagatttctcgtttttcaacttcagtttattttagtgccttccagggaaaaaatgaagtacaggatcttgacaagggagatcagagtcagcaaaatttatgacctaattactagttatgggcatgatcttcctgaatgttcatggtttaaacagaactgggaaattgcatgtataatccaaaggagaataattaagactatttacatggtagatactggataagatcatgtaaacaaattgtacttactatagtaataatattcaattaactgccttatgaattatcaggaaagaattcatattgaattttcatttaaatgctgacataaaagtgaccattaagttatatgctaatagtcattttgtgttttgttatatggaatactaatgacatgaagcacttaggtagtaacaggcatttcatacatgaaaagtctctctagatatgctagtaatttaattcacttgtttaggttggggtaaatttttacattaattttagattaataatgtctgatatttagcaataaaaggacaatattttgatctctaaaaggagaaaataaaaattgttgaattttgatgattatgatctgaaacaggtgtaaacaaccaaatcactatagaggtaactctaatctaaagtagatggcagtaaggaaataggaaatataaattattatgaaaatactgaaaaaaaagagaagaaatttgtcatggcaaagaaagacataaaaaagttccaatgaggaggcagcatttaaattgctatttcaaagatgtgatagtgaaactcacagatggaatgactttatttgctgaattaaactgcctctactatctccgtgaataatcgtttacaaatgactggtgcccaagccctcaggtcatatctatatgtttgggaagatttgtgcttaaggatggcagaaatgtagcatttgttcactacaaagttacttttatttttgttatttttttttttactttttggtttttttaaggatagccccaccactcatctgatgtgaggtgctgtgtgtgtgtggggtgggggggtgggggtgggggtgtgagtgtatatgcgtgcacgcgccctcgcatgtatgtgtatgtgggtgattccctccccacctctcaatacaccacctgttgcagtcaggagagctggctctggagtcatgagagtggaaaagctggccctgcacttgtctattgtcatactctgaagagtgggctcccctgagtagcacaatagagcttgtcctggtgtagaggggcacagttgaacccaccctgagggtgagatcatggaagaactggtctggcagctcctctgccctgaggtggcatgggtgcaggggagatgcccctaccaccacctgcagcagataagaactgcctgtagcatcctggagagcaggcccttcacttcacctgggcaaaaattggagctggccctgatggtgaaggcccaagtgagccagccatgagggcatgagagtgagagaattgcctcagctctttgcaagctgtagcactgggagagtgggccctgaattgcacagaggagctgtccctggaggcaaggttcctggagagttggctttgagggcatgaaatcaggagagtttaccctgcctcctgcctatggaagcatagggtggcctcgccagagcagtggagagctctacttagtggtgttgatagggtgaagctgaccagatcacctaccatgtagtcccagattcagggctctgagttgtcccaaccccaaatctatatcatctgagaacggctgggatgtgttaaagggcttagcctgctgatccaaagctacaggatctccatgacacagggcaacaacaggataatggtgaagagacccagtgaggatctaatattgatggtgccatagaagacagagacctcaaaccagactaatgactcattgcaataaacctttgcaagtgaaggtgtatggacatatatactgtgtgacacactgtgacatactagtttctaagatgagatttttttatgcttcattctctttggtgtgtgtgtgtgtgtgtgttatttgggggggtgttgcaaggatggagaacagatacaaggggatggagagatgagtggactggagtgtatgatgagaaacccacagagttggtccctggaatgtggtccacaatttagtagaagaagatacatccaagaatacctgggtatcacaaattggtctcaatgaagtaaaaaaataagacacaaatcctggtgggtaaaaaaagggggatagatagaaaagatctgggtgagacaggtgaatgtgatcaaaacatatgacattctttaatgtttatttattccctatagtctgtactgatccctgtgacttgtgagtagaggtgaggtgtacatgttactgtagggctgaagattttgttgtatcttagtgtcccaactttgtcatctgagggtctttttgttactcattttattagttgcttttctattgtaagaaaataccatgaccaacacaacttatatttaaaagtatttctgtctagggtttaaaagtgttagagtttgtgatagctgaacaaagatatgatagcaggaacagctgagaactcaaacctccatccacaaatattaggtaaagaaagcatacttaaaattgcatgaatcttttttatctcaaatcaggttcccagtgatacacctctaccaataatgccacagttcctaacccttcccaaagagtttcaccaactgaggatcatgcactctaaaatatgagtctatggggccatacctgttccagtacccacatgcatcattttctgcatcatttctcatcatttgtgtagcttttaaaattaggtttaagatatatttgtccataggtataatgataaactatttggaatcactttaattttttttaactttcattttttaattacttatttatttcatttacatttccaaatgctatcccaaaattccccacacacctcccctacccacccactccaacttcttggcccgggtgttcccctgtactgaggcatataaagtttgcatgaccaatgggcctctctttccactgatgacctactaggccatcttctgatacatatgcagctagagaaacgagctctgggggtactggttagttcatattattgttctacctatagggttgcctatccccccagctaattaggtactttctctagctcctccattgggggccctgtgatccatccactagctgactgtgagcatccacttctgtgtttgctaggcccaagaatagcctcacaagagacagctatatcagggtcctttcagcaaaaccttgctagtgtgtgcaatggtgtcagcgtttggaggctgattatgcgatggatccctggatatggcagtctttacttggtccatcctttcatctcagctccaaactttgtctctgcaactccttccatgggtgttttgttcccatttctaagaaggggtaaagtatccacagtttggtcttcattcttcttgagtttcatgtgtttagcaaattgtatcttgtatctcgggtgttctaagtttctgggctaatatccacttatcagtgagtacatattgagtgagttccttcgtgattgggttacctcactcaggatgatgccctccaggtccatccatttgcctaggaatttcataaatccattctttttaatagctgagtagtactccattgtgtaaatataccacattttctgtatccattcctctgttgagaggcatctgggttctttccagcttctggctattataaataaggctgctatgaacatagtggagcatgtgtccttcgtagcagttggaacatcttctggatatatgctcaggagaggtattgagggatcctctggtagtattatgtccaattttctgagaaactgccagactgatttccagagtggttgtacaagcttgcaatctcaccaacaatggaggagtgttcctctttctccacatccttgacagcatctgctgtcacctgaatttttgattagccattctgactggtgtgagatggaatctcagggttgttttgatttgcatttccctgatgattaagaatgctgaacattttttcaggagcttttcagtcattcggtattcctcaggtgaaaattctttgtttagctctgagctccatttttaatggggtcatttgattttctggagtctaccttcttgagttctttatttatattggatattagtcttctatctgatttaggataggtaaagatcctttcccaatctgttggtggcctttttgtcttattgacaatgttttttgccttacagaagcttttcagtttcatgaggtcccatttgtctattctagatcttacagcacaagccattgctgttctattcatgaattttccccctgtgcccatatctttgaggcttttccccactttctcctttataagttttagtgtctctggttttacgtggagttccttattccacttagatttgaccttagtacaaggagataggaatggatcaatttgcattcttctacatgataactgccagttgtgccagcaccatttgttgaaaatgctgtcttttttccactggatggttttagctcccttgtctaagatcaactgacagtgtgtgggttcatttctgggtctttaattctgttccattggtctgcttgtctgttgctataccagtcacatgccatttttatcacaattgctatgtagtacaactttaggtcaggcatggtaattccaccagaggttcttttatccttgaggagaatttttgctatcctaggttttttgttattccggatggatttgcagattgccctttctaactcagtgaagaattgcgttggaatttaatggggattgcattgaatctgtagatcgcttttggcaagatagccatttttactatattgatcctgccaatccatgagcatgggagatctttccatcttctgagatctttaatttctttctttagaggcttgaagttcctcctatagtgctgaagaacccttcagctccttgattactttctgtagttccttcattggggactttgtgttctatccaatagagaactgtgagcatccacttatgtattttccaggcactggcatagcctcacaggagacagctatatcagggtcctgtcagcaaaatcttgttgacatatgcaatagtgtctgggtttggtggttgtttataggatggatcctagggaggggcagtctctggatggtccttccttcagtctcagctctgaactttgtctgtaactcctttcattggtattttgttcccccttctaagaagaaacgaagtatccatactttgaccttccttcttctaagatgttccaaattgtaagaaggacacatgctccactatgtttattgcagccttatttataacagccagaagttggaaagaacccagatgtctctcaacagaggaatggattcagaaaatgtggtacatttacacaatggagtactactcagctattaagaacaatgaatttatgcaattctttggcaaatggattgatcatccttagtgaggtaacccaatcacaaaagaacacacatgatatgtactcactgataagtggatattagcccagaaacttagaatacccaagctacaatttgcaaaactgtggtagatttcttggtattaaattaattatgctctattttattcctagaaaaacaaatggttcatttggaattctaaaacaatttctgaataatatttcataaaaaattttcagcacccacaaaaagctcaaatgattgaataagattttaaattttctataccctttaaggtcaggttaatgatttaggctccagctttgttttattgacttttatttttttagatattttcttcatttatatttgaaatactatttccaaagtcccctataccctccccccaccctgctccccaacccacccactcctgtttcctggccctggccctcccctgtactggggcatacgatttgaaatttaactgagtatttacttattctctttataagcaccatttccattacggagaactcttgatagtcctatgaagatattagatgagaaattttgggctcatcaatcactacttttacactggccagtgaatataaaatttacaggatgatttacaatttaatcattgttattagtattttaaacttcagaagaatatcagctacaaaagcatagaaaatatccagttatagtttttttttgttggcattaatatatttacttgtcactgaaaaattgctcacattttcttcttatttttcttcttcttcttcttcttcttcttcttcttcttcttcttcttcttcttcttcttcttcttcttcttctacttcttcttcttcttcttcttcttcttctttttgttttttctttttttatatatattttttttccattttttattaggtatttagctcatttacatttccaatgctataccaaaagtcccccatatccacccacccccactcccctgcccacccactccccctttttggccctggtgttcccctgtactggggcatataaagtttgcaagtccaatgagcctctctttccagtgatggccgactaggccatcttttgatatatatgcagctagagtcaagagctccggggtactggttagttcataatgttgttccacctatagggttgcagatccctttagctccttggctactttctctagctcctccattgggagccctatgatccatccattagctgactgtgagcatccacttctgtgtttgctaggcccagcatagtctcacaagagacagctacatctgggtcctttcaataaaatcttgctagggtatgcaatggtgtcagcgtttggatgctgattatggggtggatccctggatatggcagcctctagatggtccatcctttcatctcagctccaaactttgtctctgtaactccttccatgggtgttttgttcccaaatctaaggaggggcatagtgtccacacttcagtcttcattcttcttgagtttcatgtgtttagcaaattatatcttgtatcttgggtatcctaggtttggggctaatatccacttatcagtgagtacatattgtgtgagtttctttgtgaatgtgttacctcactcaggatgatgccctccaggtccatccatttggctaggaatttcataaattcattctttttaatagctgagtagtgctccattgtgtaggtgtaccacattttctgtatccattcctctgttgaggagcatctgggttctttccagcttctggctattataaataaggctgctatgaacatagtggagcatgtgtccttcttaccagttggggcatcttctggatatatgcccaggagaggtattgctggatcctccggtagtactatgtccaattttctgaggaaccgccagactgatttccagagtggttgtacaagcctgcactcccaccaacaatggaggagtgttcctctttctccacatccacgccagcatctgctgtcacctgaatttttgatcttagccattctgactggtgtgaggtggaatctcagggttgttttgatttgcatttccctgatgattaaggatgttgaacattttttcaggtgcttctctgccattcggtattcctcaggtgagaattctttgttcagttctgagccccattttttaatggggttatttgattttctgaagtccaccttcttgagttctttatatatgttggatattattcccctatctgatttaggataggtaaagatcctttcccaatctgttggtggtctttttgtcttattgacggtgtcttttgccttgcagaaactttggagtttcattaggtcccatttgtcaattctcgatcttacagcacaagccattgctgttctgttcaggaatttttcccctgtgcccttatcttcaagacttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttagctcccttgtcgaagatcaagtgaccataggtgtgtgggttcatttctgggtcttcaattctattccattggtctacttgtctgtctctataccagtaccatgcagtttttatcacaattgctctgtagtaaagctttaggtctggcatggtgattccgccagaagttcttttatccttgagaagactttttgctatcctaggttttttgttattccagacaaatttgcaaattgctccttccaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagtttttatcatacagatctttcacttccttagttagagtcacgccaagatattttatattatttgtgactattgagaagggtgttgtttccctaatttctttctcagcctgtttattctttgtatagagaaaggccattgacttgtttgagtttattttatgtccagctacttcaccgaagctgtttatcaggtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccaacacttttatcatgaatgggtgttggatcttttcaaatgctttttctgcatctaacgagatgatcatgtggtttttgtctttgagtttgtttatataatggattacattgatggattttcatatattaaaccatccctgcatccctggaataaaacctacttggtcaggatggatgattgccttaatgtgttcttggattcggttagcgagaattttattgaggatttttgcatcgatattcataagagaaattggtctgaagttctctatctttgttgggtctttctgtggtttaggtatcagagtaatagtggcttcataaaatgagttgggtagagtaccttctacttctattttgtgaaatagtttgtgcagaactggaattagatcttctttgaaggtctgatagaactctgcactaaacccatctggtcctgggctttttttggttgggagactattaataactgcttctatttctttaggtgatatgggactgtttagatgatcaacttgatcctgattcaactttggtacctggtatctgtccagaaatttgtccatttcgtccaggttttccagttttgttgagtatagccttttgtagaaggatctgatgtctttttggtttttcaagacagggtttctctgtgtagtcctggctgtcctggaactcactctgtagactaggctggtctcgaactcagattcacctgcctctgcctcccaagtgctgggattaaagacatatgccaccattgcccagcctcctcctcctcctcttcctcttcctcctcctccttctcctcctcctctcctcctcctcctccttcctctctgtctctctctctctatgtatatatatatatccttatatgtatatgtatatatatacttggagttttttaataaaaatatactttttaaatataatatacaccaactcttccaagaacctctctatctctcatcccatccaaatccaaaaatgttctgtctctgaatttatgaaattcctagccaaatggatggacctggagggcatcatcctgagtgaggttacacaatcacaaaggaactcacataatatgtactcactgataagtggatattagcccaaaacttaggatacccaagatataagatacaatttgctaaacacatgaaactcaagaagaatgaagaccaaagtgtggacactgtgccccttcttagaattgggaacaaaacacacatggaaggagttactgagacaaagttaggagctgagacgaaaggatggaccatctagagactgccatatctagggatccaccccataatcagcttccaaacgctgacaccattgcatacactagcaagattttgctgtaaggacccagatatagctgtctcttttgagactatgctggggcctagcaaacacaaaagtggatgctcacagtcagctattggatggatcacagggctcccaatggaggagctagagaaagtacccaaggagctaaagggatctgcaaccctataggtggaacaacattatgaactaaccagtaccccggagctcttgactctagctgcatatgtatcaaaagatggcctagttggccatcactggaaagagaggcccattggacacacaaactttatatgccccagtccaggggaacgccagggccaaaaaaatgggaatgggtgggtagggaagtcgggggagtggagggtatgggggacttttgggatagcattggaaatgtaattgaggaaaatacgtaataaaaaatattaaaaattaaaaaaagaaaacaaataggcatctaaagagtaatactaaaacaaacaaaataaaataagataaaccaaaacaaaacagaataggacaaaagaaataaacagaaaacaaaaatatctaaacaaaaggcacaagaaacacatattgaagcagagatacacatttttagacaaacaggtcacataaaaggaaataactagaagctgttatatatatatatatgttctaaggacctgtgggggagggaaagccatggcaaaacatgtaacaaataaccactaataatatcattgagtttggtggctgattatgggatggagctagagaaagtacccaaggagttgaaggggtctgcaaccctataggtggaacaacaatatgaactaaccagtaccccaccccacccccagagctcatgtctctagctgcatatgtatcagaagatggcctagtcagccatcactggaaagagaggccccttggtattgcaaactttatatgccccagtacaggggaatgccagggtcaagaattggaagtgggtgggtaggggagcagggaggaggaagggtatagggaggagggagggtatagggaacttttgggatagcagttgaaatgtatataaagaaaatatctaataaaaaaagaaatataaaaaaaaatcattgaattcttttcatgttgttcatctgctgaacacaatgcctgatccttagagtggttagtatatcaggtgagactcctttgaagagtactttcattactatgaacacttctctgtaggggtgaaggcccttgatagacactgaattgacatttctgtgttcagtgtgttctatatgtgctgtctttgacaatagggccttatagtaagtttgtggaaagtcaccaatagccttggcaatagcatgggttatttgaggattcccctgggtccctttttaaaaacaactggattagatgtacttcattcctggtactggaattttcatttttttgacaagtggtatacaatttggacttcatctttcccattatttcgatcgttttatatgtctatattttagggagcttctatcacaatgcatttttttacacttttttaaaaatgttttttattattacatattttcctcaattacatttacaatgctatcccaaaagtcccccatacccccccccccacttccctacccacccattcccattttttggccctggcattcccctggactggggcatataaagtttgtgtgtccaatgggcctctctttccagtgatggccgactaggccatcttttgatacatatgcagctagagtcaagagctccggggtactggttagttcataatgttgttgtacctacagggtagcagatctctttagctccttggatactttctctagttcctccattgggggccctgtgctccatccattagctgactgtgagcatctacttatgtgtttgctaggccctggcctagtctcacaagagacagctatatcagggtcctttcagcaaagtcttgctagtgtatgcaatggtgtcatcatttggaggctaattatgggatggatctctggatatggcagtttctagatggtccatccttttgtctcagctccaacacaatgcatttctatatggatattcaaatagccattagtttttcgttgttgttgttcttccctgtctttcctcccttaatcctttgatccaggattcttctctgtcctgcccattcataattatctacttgaattcccctacctatggtgatagaatattccccattattccattatctaaaatcagtggttatatagattgtagcttgcttaattgaaaattcataccatatttgtcttttgagatctgggttacttttccagctcttccccatgaatttcatgattttcctttttaaacagattagtgattaatacctcattgtgtaaatgtaacatatttttattatacattaatcttttgacatacatctaggctgactctaggttctgtctgttacaaatattacaacagtgaacatggctgagaaagagtctctacggtaggatgaaatgtcttcagggtatatgcacagagttatagctaggtcttgaagtagattcattcttcctgaggaaccaccatagtgtgcaaccatagtgtcattcccaccagcaatacataagttttctcctttcccaacatactagtcagcattaattcccacttgttttattgaactttgctattcttgtaggtgaaagatgaaatctcaaagtagttctgatttatatttcgcaagaagactaagaatgttgatcacttatttaggtgcttatgagccatttgtctgtcatattttgagatttccattaagatatctacatcatttttaaatttggcttgttattttattgatacatactttttttagttctttatatgttttagatatcagtcctctatcagatgtgtagttggtaatttcttctccattcaatagctttctactttgttcaaatgatgttgtcttgtgacttacagatttttttttagtttcatgaggtcccatttattaataattggtctgattgcctgtgctaatgttgtatctgttcagcaagacttacacatgataatgagttcaaggctattcctcactttctccacattcagtgtatctggttttatgttgaatactttgatccatttacagttgagtattgtgaaggatgatgagtatggatctagttacattcatctacatacaacaatccagatggaccagcatcttttgttgatacttgtaactttgtagctttcacttttcattgacccttgtcctctaattgtggaacttcaggattatatttaattgtaataattttaacaaaatatgacttgaaatgtcatcttctccatatagacacagaacagcatacagaaaattattattttcctaaagagattgaggttaaacattctgaatttttctgttcacacaaaccatctagacaatatcagaattcatactccatgacatgaagaaatttctgaaacttttgactcatcataaaataaagacacttttgatctaaaaatatatttatatttagtttatatttagtctatatttagttgaaatgtttgaataactgtgggaaaaagacatttttcattttagaaatttttatttcattttagttaaccattttgaaacattctgtaaaaccagaggtaagagggacaaatttaaaattaataaatatagacattaaggggaaaaagcaactataaatgcttgaagaatcatcaggcaagaagagcattttcttttgtgaagacaaactgatagcttctctgattcatggtatttaataggttctgtaatggcagcaccatgactctgcatcaagatttcagcacaaataacaatctgtttttgtttcattggctccaaatgagaaattctggggttttttgttgttgttttaggaaattagtctgtgtattattgctcctggagctttgtaattaatcactaaagattgctaatgtggagagtttgtgggaaatagatgcctgagtgattataactgcaactatcaagtaacaagtatacctatatagaaatgggtctctttaaatgactataatgaagtctttgatacatttctatttactagcagaaatacattgttatttcttaactctggtgcttttttttttttttcaggaagatctgtaccatgatttcctgtctaagatcataatcatgtaaatctttttttaattaggtattttcctcatttacatttccaatgctatcccaaaagtcccccagactatccccccccccactcccctacccacccactcccacttcttggccctggcgttcccctgtactggggcatataaagtttgcaagaccaattgggctctcttcccaatgatggccagctaggcaatcttctgatacatatgcagctagagtcaagagctctggggtactggttagttcatatgttgttccacctatagggttgccgatccctttagctccttgggtactttctctagctcctccattgggggtcctgtgatccatccaatagctgactgtgagcatccacttctgtatttgctaggccccggcatagcctcacaagagacagctatatcagggtcctttcagcaaaaacttgctagtgtatgcaatggtgtcagggtttggatgctgattgtgggatgaatctccgggtatggcagtctctagatggttcatcctttagtctcagctccaaactttgtctcagtaactccttccatgggtgttttgttctcaattctaagaaggggcaaagtgtccacactttggtctttgttcttcttgagtttcatgtgttttgcaaattgtatcttgtaccttgggtattctaagattctgggctaatatccacttatcagtgagtgcatgtcaagtgagttcttttgtgattgggttacctcactcaggatgatgccctccaggtccatccatttgcctaggaatttcataaattcattccttttaatagctgagtagtattccattgtgtaaatgtaccacattttctgtatccattcctctgttgaggggctataataggcagaagctagaatcatgtaaatctttattctacttatttagagttctttactggtttagcttctgtggagcagatgttgtatgttttgctttttttttaaagatgttttcttcatttccattttaaatgctatcacctttcctagtttctctccaaagataccctatccccctgcagccctgctccccaacccacccactcctgcttcctctccctggcattcccctgtactagggcatagaatcttcacaagaccaagggcctctcctcccattgatggcctagtaggccatcctctgctacacatgcagctagagacaagagctctggggatactggttagttcatgttgttgttcctcctatagggctgcagaccccttcagctccttgggcactttctctagctcctccattgggtactctgtgtttcatccaatagatgactgtgtgcatccacttctgtatttatgccagacacttgtatggcctcacaagagacagctatgtcagggtcctatcaccaaaatcttgctggcatatgtaatagtgtctgcatttggtggttgtttatgggatggaaccctgagtgggaccgtctctggatggtccttcctttagtctctgctccaaactttgtgtctgtaactccttccattggtattttgttcccccttctaagaaggaacgaagtctccacactttggtcttccttcttcttgagtttcctaagttttgcaaattgtattttgggtattctaagtttctgagctaatatctgcttatctgtgagtacatatcatgtatgatcatttgtgattgggttaccttactcaggatgatatctttcagatccttccatttgcctaagaatttcataaattcattgttcttaatagctgagtagtattccattgtgtaaatgtaccacattttctgtatccactcctctgttgagggacataactaaacataaaagaatcaatatacagcaaaccagtagccaacatcaaactaaatggagagaaacttgaagcaatcccactaaaatcagggactagattaggctgtcaatttctccctacctattcaatatagtatgattttacctctttgagcatcagttgattgactatagctctctatataggagtgatgagaccttgtaaaattttcgctatctacattggcatgttaacatatgttattgaaaagttctttttgttaatcatactgttcgcattttataggtataactttcctatcatgtttagtagatattatatacctgtttgtgtgttggtctagctttccattttactgtgctcatttctttaatcttcctaaaccttagatatagggattatgttacagttacttgattgaattggttatgtaccaacttgtgccaagttgttctcttcattttgaccagttatagatctctgttataacttttatttattgtagaaagaagctttttgatgaggggtaagaactacatttatcttctttgttcttgcacgttaggactgcttgataggaaggcaattgtgacatgtaatataaacctagccacctacaaatgttattgaaatcatggctttcagagaacaacatactattggcacatctttataccagaataaaattttgcctatttttaataccttaatagggaaatgggagcttcttttctgtgtatgtactgttaaggttcatttgtatggatgttaattttaagcatcactatttttatcagaatacttattttaaattaatgttatttttctctacaagttttcccccagtctctagtatttataacatttctttacaattgtttacttttttgtcaccaactgcatattattaccaaatataaaactctacgtataagaaaagagaaaattattgttgcatctactctgtctccttatattttatatgcattaagtgcccctgaaatttaacactatgtatgtaagtaacttgaaaaaaaatttactgtgattttaaataagtgcctctttcttttggattagttacaatttagcatttaatggttaaaatattaggtataaattttaatttccattttttaatttttaacatcaattgtccttgcccagttctgttggttttacatagtaatcgaacattatcctgaatctgatattcttagttcaagatattatgtttactgctacttccagattctgaactcattctaaaatgttttatatttatgtttccctatttaaatgtacctctgtcaatgtttggacactgacagaaacatgtagcctgtgtggcctgctatggatagccaagagagtcttttttaaagcatagccccaaatagacattgatccattgcgatcacctttgaatgcacatttctctttttatgaactttctacaggtatgtgacttgcctggattttcagtttattgatgagtcaattgtttagactggtctgaaaaccttgataaagtcaacataaattgcatctaatgttgctcttctatttctcaaactgtcattctgtcatagaagcgagattagattggccagacaggacttgatctttagtaagccaggctgagttttacctagtataatattctcctcaaggcatttggaaatcgagtttgtagtgtttgccaggatgtctgtgctatcattcagactagattttttaaactatgaaaaataccagatataacaattctttttaaaatggtacaaattccttgtacatgaaactgagtttcctaaaaacattttaatgcaagtataaaatttactttaaaggtgttctccaaatccctctgtgctttccatctttcccttacacctattgtttcttttcattcctcataggcagttttactattactttcatgatagagagagagagaaaaaaaaagaaaaagagagagagacagaaagacagagagagacagagaatgtatgttaatgcatatatatgaaatctacgtaggaaatacaaataagggaaagtatgctatttgtctttttaaagtggtatctatttgctaaatatgataatttgaagtttaagcaatagatcccaaacctgggacaagtagtacagaactttaattctgtatctaacactcatgaggacattattgctattgagttactttattaatattaattgtagattgtcttcatcatcagattttatagcaagcaccatgttgtttttatcagttcaaaaccattcttcaattgtcactagataaaaagttaatacttttttttattccaaatttcaaatttcaaagcctattatataatagagctttctatgctttccctaatggtatctgcctttgttagtatataaagaaaattatatttactttttatgtaatatttcaatttacgtctcattttgagaaatccacacatttcagaaggatttattaattttttctttaatttctaagatatttaatatctatattctattatacatgttatctatgtattttattttggtcatatccatatccagttcctctatctaactccaacctggcccccatgtcaatgtatcttctgttttcctctcttgtttattttcagttttataacccactaagtttgattagtttcacccatctgtgagggtcaatttcttagaagtatgtaatgcattctgattagtcttatatctctgtacttttatcacccttccaaacctactagcatttcctctttcctacaaatctcatttctatgttctttatgttctttttgttcggtttgctttgtaaacaactcatggaatcatgccgatatgtgagaccatgcctttggaactatccctttgagcctggtgagctcaccaattgttccatataagaataaataatcatgttatcatttaaggaaatcctagtggaaaactcaaaaattttaaaaatcatcctcatgcaatacactttaaagtcatattatttttgattattacaaatcaagactttgttgtcatagttttgtttctttatgtctatatattcagttaaacattgtaattaaattgtgtattatatatgctgaaattatattagctgatatattttagacaatgctctttagcactctttggcatgatagtatacacaggagagtatttacatgttctacagtaaaaaggtttcagggatgtaaagtgatagagcataagttagtgctgccacaaacaatttttgtgaactacacattttatttgaattactttattgatagttgtacattcaaaaacctctactgttagcataggttttataaacactgcatttacttatttgatgctgtattaaattataatccacagtttaactatctaggctccatgtaataattagtttttgaggatttgtttcctaatatacatatcaataatttaaactaatatctatggtatattgatatgccatcattattcctactgcttttagaaaaggctgttgggttgatgtgtgaacaccattctcccacattcagtggcttcttctttatggtagatataagtttggcatatgaaaatagttacatttaaaaaaatatgttagcatgtattttagttgagtatcatcagtgctgcatttaagaatgtggtctatattgacatgcaagtgtggggtgatatccatggggactctcacctgttcagaggagaaggaaaggggggatggaaaaaaggattgcgggaaggggtagccacaagggggcagtgagtagaatgtaaaataaataagtacaaaattaaataagtaaaaatttaaaaagaatgtgatctatacatgcaatgaacttagtactcagactgaagtttaataaatacttacatcccaatagatatatgtgaaaagttctggcatttagaaattttatgcatttttatcaaggtatccctgggctacccattaactttttctttgcactgaaaaatacaatttagtatctctgaagtggtacattattttaatgttttggaaaccgaattttgtggattgtatattcatagattgatttcaaaatttatagtcatcatgcatttcctagatattccatattctatgtaattggctgttcaaaatttgcatttcttttacattatagttgccttttataagtgcaaattaatcttgccaagaacatccccagtgttcttagtaatattatgacacacaaaggttatgactttaaagatatattaagaactgtaatatgataaccgagttgatgaaggaggagccatgacctctgacttataaagcttgaagtatacccataaagattgacaaaataagccatcaaagtgttattcatgtaagtattttcatcaaaatcaatagtttaaatgaaactctcataaagttagtttagctttctaacccttaactggttaaaaataaaggcagaaggtgatttacgattgcatagagggaaaagcagataagtagaaagataacagttcaatcaaagttaggtatatttggtcctgaaggttagagttagaacttatatttttttctgaagaaatatcatgagtctcaccctaggatttgtaaattacaggatattttttcactgactgaactattaattcaggaaggttgtttaggagttactatatcatgttaggataattatttcttggcttaccaaaaagaatgcagcttgactcttattccttactaattaaattagaaacactttaaattgttttatgaaatatttacacatgtatttatattatttatatgtgtatagtatatattttgctctgtacaatatgccatataacaataaatgagtagttattcaacttgtatttaccataactcaatctgagttgttggattctgattcaattgtataagtaaggacttatgcattaagatataaactacagagggtaaatagtcccagtatagtagttaaaaaaagtctctagtgttctgggaatatcattggataatcattgtaggagccactaataaggccactggctctctgtgtgaaaaattaagtatataaaaaaaatgttggcacttgttgtaggaaacatgtatttcattactgcattagaattttggtttttttgaaatgcttaagaaatttgataagatacagcttatcacacattatgtgcatgtgcatgttgatgtgtgtgtatgtgtaactagaatcggatatagtaatccagtactataaggcacttcctcacagctgccttatctataacaggatttcatggacgttaagaaatttcactgtttatttcagcctcaagtttctttgaatgagttttgtgcaaagtacaaagcttatttcaacaaaatttataaatttctgacttaccatagtataaatttcagacttattgtagtttacatcttaatgtggatgcacaaggaataatgctggagagagagcgttctctgggaaaaacctaaaagacaagagaacagggcactgaaaaacagaagcaaacccaattttttgcttaaggttattccattcttttctgaagttgaaacattttcttaaaatattttttattaaattttataaaagataatgcacttatatttctaaggtaaacatgagattgtcattacacaggggacatgcccattgagctgagtttcccctttctaatgcattttcacaatagatcttcttgtctgtttgaattaaattgtagagcttttctagttaggtcacaaacagttccaagtgccttctctccaagatcatcatagtatcctaatgtatatcttacatggcttacagaaattaataaagaaacccccagaaatactttaagctgcatctaaatcattttttactgagtcaaaatgtgtttgtttctccagatccccaaagtttgcattaaacagctgaaaaatatatacctcattataaaaatagactataactgcccttctatctaactctcagacttcttccctctgccaagaaataatcagtggattatcactacattaccatagccagaaaatctgctcccatagaagactgagcaaagagataaaaacactcatttccttatgcagattctaaagtaaacctgcatgctttcttgaaagcatttttgctttctcaggaggaatataaaatactttgaagtattatattcatatttcttaatcaaattcaaatgcttcaagtacagacatttttttaaagagtaagaataatatattaaaggaaactatttaaagaataaaggccatataggaaagtgtttgttttattttgttttgtacagctatattgttttggaattaatatttttcaaattatactaccatagagttttctcataactacaaacatcttgagaatctgtggttaaaaaagtcacatgtataacactcagaggtacagttaaggaaccatgaggagggacaattttattggtttaatgaaatactgtcaagaaaaatcaccatcatgaacaacactgggacagaatttatacttctggactgtcatgttaaaagaaaaaaactatgttttatttagaacactgggcaatgtgtcagctgtatgattaccaagttagcagaagcaggaggatgctgctcaaattgaaaagaaattcgtaggcatatatatatatatatatatatatatatatatatatatatatagtgacctttcagattctatactcaccatgaatactgagatattatatggtcagcattttaaatttcaagtgtataaaaatgcaaaaggaatagatcattcattctacaaaggaaaacaaaaaactgtctaacctgttattttagtgttatagtaaagatgataagattggaaaaaaattatctttcatttttatggtcctataaatgtttctgaaaaattcttttatagttattggtgtatgtattatgtttgaatatttaacctacaaagttttttcttagccactctgccttcagcaagcataaggaaacactttgtttattgctttaagtatattatggtagaaggttttcattactagtatgatataaataagacaataaatatgtgaacatttttaatcatgttagcaattaagaaaaaaagtaaatgtggaaagttttcttaagatactgagtttaatgtgttatgctttgctgtgtccccaaacgttcagtatcactaaatttatatgacttgccagagaacttagctaaagaatttgctgcattttaatttatgctatgactgataaagaaaatatcatatatccaggcaatcaggggaaatcaatagaaattagactaaaaacagaaaatcaggtttggggtgtcatctctgtcataagattggtgtgcagatggtggtagcttgggcacagagtctgcagacacccgcaggttacccacaagactctccaagggatcttaagacctctggtgagtggaacacagcagctgctccaatccatcacgtgggacctgagactgcattagttagggacgcagaaaacccggcctgatcaggggcacaagtcctttccggtccacgctagcaccagagtacattgggcatggagtttgcagacacccacaaggtatacacaggaccctccacgggatcttaagacctctgtgagtggatcacaacttctgccaggagacagattcgaacaccagatatctgggcaccttccctgcaagacgagagcttgcctgcagatagtactctgaacactgaaactcaggagagatctagtctcccaggtctgctgatagagggtaacataaatacctgaggaacaagatctaaccagagacaactacaacaactaactccagagattaccagatggcgaaaggcaaacataagaatcttactaaaagaaaccaagaccactcaccatcatgagaactcagcactcccacctcacgcagtcttgggcaccccaacacacccgaaaatatagtccctgatttaaaagtgtatctcatgatgatggtagaggatatcaagaaggactataataactcacttaaagaaatacaggagaacagtgctaaaaaggtaaaggaccttaaagaggaagcacaaaaatcccttaaagaattgcaggaaaacatgaccaaacaggtgataaaattgaataaaaccatctaagacctaaaaagggaagtagacacaataaagaaaacccaaagtgaggcaatgctggagatagaaaccctaggaaagaaatctggaaccatagatgcaagcatcagcaacagaatacaagagatggaaaagagaatctaaggtgcagaagattccatagagaacatctgcacaacaatcaaagaaaatacaaaatgcaaaaagatcctaactcaaaacatccaggaaatccaggacacaatgagaagaccaaacctatggataataggagtagatgagaatgaagattttcaactcaaagggccaggaaatatatttaacaaaattatagaagaaaacatcccaaacctaaagaaagagatgcccatgaacatccaagaagcctacagaactccaaatagactggaccagaaaagaaattcctcccgacacataataatcagaacaacaaatgcactaaataaagatagaatattaaaagcagtaagggagaaaggtcaagtaacatataaatgcaggcctatcagaattacactagacttttcaccagagactttgaaagccagaagatcctggacagatgttatacagaccctaagagaacacaaatgccagccaaggatactatacccagccaaactctcaattaccatagatggagaaaccaaagtattccatgacaaaaccaaattcacacattatctttccacgaatccaacccttcaaaggataataacaaaaaaacaatacaagaacagaaatcacgccctagaaaaagaaagaaagtaatccctcaacaaaccaaaaagaaaacagccacaagaacagaatgccaactctaaaaacaaaaataataagaagcaacaattacttttctttaatatctcttaatatcaatggacttaattgcccaataaaaagacatagactaacagactggctacacaaacaggacccaacattgtgctgcttacaggaaactcatctcagggaaaaagacagacacgacctcagagtgaaaggctggaaaacaaatttccaagcaaatggtctgaagaaacaagctggagtagccattctaatatcgaataaaatcaacttccaacccaaaagtatcaaaaaagacaaggagggacacttcattcatatcaaaactaaaatcctccaagaggaactctcaattctgaatatctatgctccaaatgcaagggcagctacattcattaaagaaattttagtaaagctcaaagcacatattgtacctcacacaataatagtgggagacttcagcacaccactttcatcaatgaacagattgtggaaacagaaactaaacagggacacagtgaaactaacagaagttatgaaacaaatggacttaacagatatctacagaacattttatcctaaaacaaaaggatataccttcttctcagcacctcatggtaccttctccaaaattgttcataattggtcacaaagcaggcctcaacagatacaaaaatgttgaaatcgtcccatgcatcttatcagaccaccatggactaaggctgatattcaataacaacataaataatggaaagccaacattcacatagaaaataaacaacactcttctcaatgataccttggtcaaggaaggaataaagaaagaaattaaagactttttagagtttaatgaaaatgaagccacaacatacccaaaattatgggacattatgaaagcatttctaagagggaaactcatagttctgagtgcctcccaaaagaaactagagagagcacacactagctgcttgataacacacctaaaagctctagaaaaaaggaagcaaaatcacccaagaggagtggacggcaggaaataatcaaactcaggggtgaaatcaaccaagtggaaacaagaagaattattcaaacaatcaaccaaaggaggagctggttctttttagaaaatcaacaagatagataaactcttagccagactcactagatggcacagggacagcatcctaatcaacaaaatcagaaatgaaaagggaaacattacaacagatcctgaagaaattcaaaacaccatcagatccatttataaaaggctatacttaacaaaactggaaaacaaggacgaaatggacaaatttctagagagatacctggtactaaagttaaaccaggatcaagttaacaatctaaacagtcccatatcccctaaagaaatagaagcagtcattaatagtctcccaaccaaaaaaagcccaggaccagatgggtttagtgcagagttttatcagaccttcaaagaagatctaattccagttctgcacaaactatttctcaaaatagaagtagaaggtactctacccaactcattctatgaagccacaattactctgatacctaaaccacagaaaaatccaacaaagatagagaacttcagaccaatttcccttatgaatatcgatgaaaaaatactcaataaaattctcgctaaccgaatccaaaaaacattaaaacaatcatccatcctgaacaagtaggttttattccagtgatgcagggatggtttaatatacagaaatccatcaaagtaatccattatatgaaaaaactcaaagacaaaaaacacatgatcatctcgttagatgtggagaaagcatttgacaaaatccaacaaccattcatgataaaagttttggaaagatcaggaattcaaggcccatacctaaacatgataaaagcaatctacagcaaaccagtagccaacatcaaagtaaatggagagaagctggaagcaatcccactaaaatcagggacaagaaaaggctgtccactctctccatacctattcaacattgtacttgaagtcctagccagagcaattcgacaacaaaaggagatcaaggggatacaaattggaaaggaagaagtcaaaatatcacttttgcagatgatatgatagtatatataagtgaccctaaaaattccaccagagaactcctaaacctgataaacagcttcgtgatgtagctggatataaaattaactcaaacaagtcaatggcctttctctacacaaagaataaacaggctgagaaagaaattagggaaacaacacccttttcaatagtcacaaataatataaaataccttggcatgactctaactaaggaagtgaaatatctgtatgataagaacttcaagtctctgaagaaagaaattaaagaagatctcagaagatggaaagatctcccatgctcatgggttggcaggatcaatattgtaaaaattgctatcttgcaaaagcaatctacagattcaatgcaatctacataaaattccaacacagttcttcaacgaatgagaaagagcaatctgcaaattcacttggaataacaaaaaaacctaggatagcaaaaactcttctcaaggattgaaaaaaaaaaaaaaaaaaaaaaaaaaaacctctggtggaatcacaatgcctgacctaaagctttactacagagcaattgtgataaaaacggcatggtactggtatagggacagaaaattagaccaatggaatagatttgaagacccagaaatgaacccacacacgtatggtcactttatctttgacaagggagctaaaaccatccagtggacaaaagagcatttttaacaaatggtgctggcacaactggtggttatcatatagaagaatgcgaattgatccactcctatctccttgtactaaggtcaaatctaaatggatcaaggatctccacataaaaccagagacactgaaacatatagaggagaaagtgggtaaaagccgggatgatatgggcacagaggaagaattcctgaatagaacagcaatggcttttgctataacatcgagaattgacaaatgggacctcatgaaactgcaaagcttctgtaaggcaaaagacaccgtcaataagacaaaaaggccaccaacagattgggaaaggatctttacctatcctaaatcagataggggactaatatccaatatatataaagaactcaagaaggtggactccagaaaatcaaataaccgcatcaaaaatgggctcagagctaaaaaagaattctcccctgaggaataccaaatggctgagaaacacctgaaaaaatgttcagcatccttaatcatcaccgaaatgcaaatcaaatcaaccttgagattccatctcacaccagtcagaatggctaagatcaaaaattcaggtgacagcagatgctggcaaggatgtggagaaagaggaacactcctccattgttggtgagattgcaagattgtacaaccactctggaaatcagtctggcggttcctcagaaaattggacatggtagtactggaggatcccgcaataccgctactgggcatatacccagaagatgttccaactagtaagaaagaaacatgttccactatgttcatagcagccttatttataatagccagaagctggaaagaacccagataccactcaacagaggaatggatacaaaaattgtggtacatttacacaatgaagtactactcagctattaaaaggaatgaatttatgaaattcataggcaaatggttggacctggagggcattatcctgagtgaggtaacccaatcataaaagaactcaaatgatatgtactcactgataagtggatattagcccagaaacttagaatacccaacatataaggtataatttgctaaacacatgaaactcaagaaatacgaagaccaaagtgtggacactttgcctcttcttagaattgggcacaaaacacccatgggaggagttaaagagacaaagtttggagctgagaccaaaggatggtccatctagagactgccatatccagggatccatcccataatcagcctccaaacgctgacaccattgcatattctagcaaggttttgctgaaaggaccctaatatggctgtctcttgtgagacaatgctggggcctagcaaatacataagtggatgctcacagtcagctattggatggatcacagggcccccaatggaggagctagagaaaatacccaaggcgctaaagggatctgcaatcctataggtggaacaacattttgaactaaccagtaccccggagctcttgactctagctgcatatgtatcaaaagatggcctagttggccatcactggaaagaggcccattggacttgcaaactttatatgccccaatacaggggaatgccagggccaaaaagtgggagtgggtaggtaggggagtggggggggggatagccttgtaaatgtaaatgaggaaaatacctcattaaaaataagattggtgtgcagaagttgaattgcttaagagttgggttcaatcaattttgactttgaaggaaaatttacaccattcttgtgtgattttcattgtaaataatgaaaggagaaagttatagaataaatttcatctctgatttataggccccttaactttctctggaaagaaatatacaagtagtttgagatgtaaagttttaaattttccttttttaagtttttgtctattgtgtatcatatataatacttacctggaggtaatatcagtttatactttttcaataataaaatttattgctattgttacatgctatatatgctaccaaacccacaataagtgaaaaactgttaataccctcccccaaattagatttttagcccacacataaaatgacttggtttttttgggggggggtggtctgtcacatttattttattattttattttatttttaacatcttttttattagatattttcttcatttacatttcaaatgctattccaaaagtctcctataccctctcccctgccctgctccccaacccacccacttcctggctcttgtgttcccctgtactgggatatataatctttccaagaccaagggcctctcctcccattgatggccgactaaggcatcctctgctacatatgcaactacagacacagacagctctatcagggtcatgtcagcaatatcttgctggcatatgcatatgcaatagtgtctcagtttgtgttctaaagtctgacttttgcctaatccaatgtcttttgatattgttttctgaatttgtattctctttctttccatcaagttcctttcattgcttcatggcaaatatcgcttattagacttctcatgttaattaagcatactgataaattaataaatacttaattttatatacttctgtaatatgcttaatgtttctggaggttaggaatggagggagggatggaaggagggagtgtgaaagagaaatagacacacagagagggggttgggtgtggaagagaactcacagatatttgaattcaaaggcattttacttccataactatctttacaatagagtcggggaaatatttctctttttttctaggcaaaatgttcctaattagctcttcttttagatggtgtcatctattcttcatcttaccttctgtggtacttgtgctggttacagataacttactatagacaactgactagatggaagtactgccctcttaggagaacaagaagttccatgatgctttgataagttatatcaagggagtgctttcaagtaaattagggaattgttgagacagaaagcaggatctagatggtaggagatcaagaaccacatcacaaatacatagatgtgaagctacaaccagtgggtattgtagcttaagtaattccatgttgaaagtattgcttttgtatcacatgcataagaacaagttaatatattagtaaatattcttattaagtatacttcttaaattttaagaagtagcattgctgatatggttttattgccaattattaattttattccagaagtttattttattggaaatagacatatgataggaaacattgaattgatatgtgatgcttcctaagaataaaaatttggtatataccacggacacatgctccactatgttcatagcagccttatttataatagccagaagctggaaagaacccagatgcccctcaacagaggaatggatacagaaaatgtggtacatttacacaatggagtactactccgctattaaaaagaatgaatttatgaaattcctaggcaaatggatggacctggagggcatcatcctgagtgaggtaacccaatcacaaaagaactcacacaatataagtggatattagcccagaaacttagaatatccaagatgcaagatgcaatttgctaaaggcatgaaactcaagaagaatgaagaccaaagcgtggacactttgccccttcttagaattgggaacaaaacacccatggaaggagttacagagacaaaatttggaagtgtaatgaaaggatggaccatctagtgattgccatatccagggatccatcccataatcagcttccaaacactgacaccattgcatacactagcaagattttgctgaaaggacccagatatagctgtctcttgtgagactatgccagggcctagcaaacacagaagtggatgctcacagtcagctattggatggatcacagggcccccaatggaggagctagagaaagtacccaaggagctaaagggaactgcaaccctataggtggaacaacaatatgaactaaccagtagcccggagctcttgtctctagctgcatatgtatcaaaagatggccttgtcggccatcactggaaagagaggcccattggacttgcaaagtttatatgccccagtacaggggaacgccagggccaaaaagggggagtgggtgggtagggggtgagggtggggtgggtatgggggacttttgggatagcattggaaatgtaaatgaggaagatacctaataaaacattaaaaaaaaaacatttggtattgcgaagatcatatgccccagtttaggggaatgccagggccaggaagtgggagtgggtgggttggggagtagggggggagtatagggggctttggggatagaatttgaaatgtaaatgaagaaaatacctaataaaaagaataaacatttaaaaagaataaacattaaagaaaagggtactggttctaaactattttctacaggatacattaatatatcgaacatattaatatttatgaaacagttaaaacttaattgagtttagtacttgtttggtcatagaatgagatgaattacattcatctttctaaagtttacatgtactttagtttttatgttatatgaaatagagtagtatgactagaaattgtaaaactttttctgattatatgagtctgactttccatgagaaaggtagaaataataaactagaagaaaacaacaaaaggaaaggacctctgtagttcagtcattcaccagtgcttcaaggtatagtgttgttcaaatgcactaatgttaaaattgtacacattcaaggaaacatatattaattttatttcaaccattacaaatactgcatgaacaagtttatttatctagcttgcaaccttccttgcgttctaaaagtaacactgtactttaatggcaaaaacatagcattgtctcacggaatcagaattacctatttgcacatgatctatttttgtatgtaagctttgttgtgccaaatttaattagaagtaaaagaacatatttttgtatagcacagccaagtcatagagaataactttgaaggttccagttatgtttatacaagaactaagtgtaacatacaaaaaaatgacaaaggaaacgtaacacaccccaaaccacatagaatgaagcattttttttttattacatgtgtttcactttgttgatcttttgaaaatttatagtctctgagtacagaggtctaaaccttcaaagcttaaaagacatagggcagcatgaactaatcttcatttcccccatatcttcttacagcagcactaatggaaatgtattttgtttaatgactctgaaatcctgtttgtaattagatgtgggaattggtcttactttgtaacagatgatactggaataataatatgagagatgctacactgagaccactatcttcctaaatctatatcatttttcattttattgacaggagatgtgtgcaaagaacaaagaagttgtttttttttaaaggaaaataggatctaataaaaagaactacaaaaccaactattttagcatcacttccaatatattacagtagtaaaagaaagaggatgaaccttggtttttaatcttaggaaacaaggattttaattttgtttctttattttgataatgatctttaaatattattgcaaagactaggttgaagtttaattaagtgacagagatcatatcattaaaagatattagtatggctacacaaaataattaatactgccttttaaagaaatagtttctgttcaaagagtttaaagagtggacaatttaaactcaacagctgttcaatgtatcatgtttcacattcttcattatcaataaacagcactgtcacacattattctggctaactggatactgacaacctctaggggccacaaaaagtagagtttaaagaacatatgaatctcatggatatgttttacactctgttccaaacacatgtgttgtaccttcaagagtaggactcttgttttcatggacaacccctgtgtgaagattatgataatatgtactcaataccatttcatttcaagttaattcacgttttaatttaatgtgcgtgggcgttgtgccttagtatatgaccatgcaccatgtatatgtctagtacccatggaaattagatgatagcatcacatcacctggaactgaccattgtgagagtccatatgggtgctgggaattgaacttggatactctggaagttcagcatatggggtattccttccagcttagtatgtgagatttaatgcattatttcatattctttttcttttggttcttttttattattattaggtattttcctcatttagatatccattgatatcccaaaagtcccccataccctctccccaactcccctacccacccactcccactttttggccctggcgttcccctgtactggctcatataaactttgcaagtccaatgggcctctttccagtgatggccaactaggccatcttttgatacatatgcagctagagtcaagagctccgggctactggttagttcataatgtttttccacctatagggttgcagatccctttagctccttgggtactttctctagctcctccattgggggccctgtgatccatccaatagctgactgtgagcatccacttaagcaacaggcttggctggagttagtagacagaagacttgaccaaagagaaaaataatttgttgctcatttccttgatgtttcccatttgtttgttcattactttaattttcaagcagtttcacatatacttatatactttaattaagatcctatatggtaagtagagcaagtactaacatggtatactttgggtagtagaaaaaataacagaaaaatttaagtaattgatgaaattatagaagtcactgagtacatagtcaagtgcatggcattttactacaaagcccacatacttacattataacttaaaactctttgagaaaaaattaaattgagaatagttgtttctattgatatttaggttaacggattttgctaacatttaaagatattagaacatgccatagttctcaactgcaggttcatgaaactgttcactttacaaagccatatggtagatctcaatttgatgatggtgaatgggttctttcatttgcagtgataattagcattgttatttttgtattgcatttttattaattatgttacttatttactttacatcccaaaagcaacttcccctccctcctttcctccaagtcccttcctctcaccttccttcctccttcatgaaaaaaaaaatgaggccattgtaatttctctactttttcttgtaaaacaaattaaaaaatcttatcagtgataaaggaaaatttaaaaaatttttgcttcgtaaaaattaaaacaagacatgtagtttgtcttacctgtttcattatatttcaaaatcaaactacttactgtggagtgtttcattagaatttcttttattttttctaataaatatctttaatctttgtgcacacagtttcttagcattaagtgctaacagaatgagctgaggtaagtgctgatttagtgtaaagtgctaggaaaaacatttataatttaaaaaatcatgagagttttaaaaaatttgcttagaattattagtctagaggagtgttttacatcaaattatcatagtaaatatgtaaattatatagatcaacgtcaacagaaaacttgagcacttacacagaatacttatcattaaaattttgttgaatgttgttcgtgttatgtgccatgacattgtatgcatcatgctgacaaacattccatttattatattgcatgacatatatacaatgtttgctgtgccttttcgatttacaaagactaaaaaaaaaaagttgaatctttataaagttcaaaatatgttattttctaattattttatatgtgattatatgtagtgataaagagtcataatgaaaaaagatctatgatagtttgactttagaaactaaggggaatattcagtgcattactttgattgtactctagagtcagtcacagcagacattacaaatgtgatcactttaaacttgaatggtaaattatatccaaaatgggactactagtatagagaaagttgcatactcacaaaaaggttatgatgtcatacattatttggatatatttcaaacaactgacatggctaaagggtaaaatattttcatttaccactgatagttttcataagcaagtgccaggcacaatggagaaaggtaatattgggtacattgacaataattacaaagccagaaggaattggaataaattccaaatcaagaaattttaagaacaaaacgagtaatggctgaatgaacttgtttgttgtttgaaatatctaaaaagtcatgacactgagtataaaagaattcaaataaaattaagaagcatttgaatataatattgaacatagtagaaggcaaagtgaaatgaacaattgcagacataaatatttaactatccacttgtttaaccaccgagaaaatcttatgtcttagtagaactcagtacacgaaaatcataaattacaatagactaatgataatgcaatataagttagaaatgaatcagaactaaagctattctagtaccaaagaagaatatgagctgtatttcaacttaggtattacaatatcattaaaataatcattttatatgttattatcattatattgctcaaattaaacaaaatatgtgcttccatttaaaaaaattcttggctatatacatatatatgtgtatatatatatatatatgcacatatatataacatatatatataaacatatatatatatatatatgtatgtgtgtatatatgtatgtgtttgtgtatatgtgtgtgtgtgtatgtatgtgtgtctgtgttattcagtctgtatgtctgtatgatgttacttttatgtatgatctcagatctgaccatttggtatttgacaaccatccttgcggaagactgtatttccagccctcagcattctttgcttgtctgcagttctgtttgcagttgaggtctacttggctttttccaattcattttggcaaaaatattggtgttgaccgtgtttatctcaagtttaggtagtcatctttgtgaaagttttaaatgtagcttctgacattgctgagagacataatcacataacaaacttgctaatcttctgccccttaaaatcattctgcattcttctgcattcttaggtactaaagtattttacaaactttttccattaaactggactccaaactttacattttgattggttttgattttttcagtagtggtttccatatgctgtaaagataattttccttgatcaaagatgaaaactaccataagttgtgggtgtaaggagaaacatttaggttgttgttagggattatgtggatttagtaaagtagtagctagaggttcttctccaagccccatgacttcactggcactgaaatgaagtttccagtagtgggcatgattatcctcttgttgaggatatgcatgccactaatgtttcaagatggttagtatgcattgctgatagttcataggcatcatagctggacatgactgttgatggcctccctactttggaagcttaatgtgccttgggaactgtgaaagatagtactcagagaggagacattcgggttatttccaggtttggggctcctgggtccctatttctacagtaaatagtgtcttcaacataaaagcttaccttcgaacactgaggacaaacgattgcaatagcaataggctctgtgttttgggagtcttttggactttcctaaccaacaaacagctcaaaagagggctttttttttttaacacctgctgttgctggttttgttaggtggtctttggttctttaggaaagcaccatcagcctatataaggacagtttattaaagttatgtatatgtatttgtaaacagaattatatatactataatttttaagttaactagctaatataagtattacttatgacattttaaatgttattttttttaatctagagaaaaactgaggaccttgaagaatctaatttagattcattgttcatattttcctttaggttctacatccatccaggaaaggcctaaacttcctcatctttttgatttatgagcaggaaaatggttcagagataatttctccgataagagtgtcttagttagggttttactgctgtgaacagacaccatgaccaaggcaagtcttataaaaaacaattacttggggctggcttactggttcagaggttcagtccattatcatcaaggtggaagcatggcagcctccaggcaggcttggcacaggcagagctgagaggtctacgtcttcattcaaaggctgctactggaagactgacttccaggcaactggggtgagagtcttaagcccacacccacagtgacacatctattccaatcagatcacacctattccatcaaggccacacctccagatggtgccactccctggtctaagaatatacaaaccatcacaaagagctagcagtatgactttcagtttcacctgtgtgattttcagggggtttagttttaaaatggcagtagaaactttccttccaggctaaatatactatggtactataagtaacatgtgtaacttaataattcttagttatttattacatgaatggataaagtaaagatgatatagctaccatcaaagtcacattagatcagagtcagtgctgtaggtcaattttgtacacatagaattgttggtgagattaataatgggacaagatattttaatgatatattttacaatctaaataatttatgtacattagcttttatttgaattgtttatcttggtgaaacaagcgaatcctatttgcagtagtaagagaactctgtattttatcacttctgcacgagtattaaatgaactaaactaagtcaaacggggcagatattgtctagtactactgtagtcatcaatcctcttttatgcataggatatattctatttctttttcctttctttctttctttctttctttctttctttctttctttctttctttctttctttctctctctctctctctctctctctctctctctctctctctctctctctctctctttttttaaatttttcgagacagggtttctctgtgttcccctggctgtcctggaactcactctgtagaccaggctggcctcaaactcagaaatctgcctgtctctgcctcccaagtgttgggattaaaggtgtgtaccactatgcccggctctatttctgttaggactttgtatatcccatactagcctctcctgttacaatctatgtagcataccataaaacaatgccaattagcacaagtgaagttatcttagttcaccaaactggatactgaagtattacaaagccagtacctgtgcatgacttctttccatacatagatcattagaactcttaagccattctaaaaccctcagcttttctgtatattttattacttcctaatccccaaatgtactattggtatattttgtctgtacacaaaaagggtatcatttattaatctgtaccagaagtcaattttaaattaaattttattatttaaattagagcttctctgaaaagaaatgtctgtcttctacatagccatagtctctcatttaaaacttttgaaagtcacagttcattggaattgacttgccactgggtctaagaagaatgcagtgattagactttgggatacagtgtatgtttaaatattctaccagcaaagaaatctgttcaggctccatagccaagtttgataaatcttgaatttatttttaacaatacgtacatacagttgattttgattcattactgttgaatggccaaaagaaaagaacaggatcatacttaaatgtaaattgtggcccattaaactatagaattcattgcatataagtaacatcattgtgaatacaaatttcttgggtatctgtctttatattttctggcatacaaatgatttattgcactaattaaaaatcagttatccctctggattttgtttcatatatgcgagatctgataaaatcaaaattagtactttaaaaggaaatgccaggtatttcaagttagttttgtgctcacaagaatacacatctggacacataattaatttcttagttaatctttgcttacaagatgttttgtcttacactttgctataatatttacaaacatgaaatgattgaatttatagacctaaaagagatagccaaaggctactgtgtgtatattcccttaaattaccttcaaaatatttaaaagaaaacaatatataacatatgcatactatagagcatagtataaatattaataactcaggacacaattaaaaacaaaaatattgttcaaagcttgtgtttacttacatttgtattccctttcccatctgtctgcctttctgtcagaggtaaacagcctgcacagttttgcatttatcatctcatctagcagtttacattgcttcttttcagaaatatgtatagtttcaaaaatgtgcagaatcactgaatgccagaagaagtcatcatttagttcatccagctaaattccatcatgactcatgaaaagaaactgaagcccacaagagacagaatgaggaagttaatcatcctttgagagactggctaattaacaacacctcatgattctatgattcttggagtgatactgttgcataatcataatattgacgtgtctaaaatataaaaatgatatagttttgagttagaaatatttattataaaactttaaaaatatatatcaagtatttatacttctataatattttttttaaatatccaattatcaaacctgtgtgttattatatatattagtctctaaattgttgcagaaatcctaagccaagatctcactgaaaacataaaacataattatttcaaagtatcatatcatatcaatgagaattattttctgtagagatattgtttcatttaataaaatagtatggtgctgggcgtggtggctcatgcctttaatcccagcactctggaggcagaggcagggagatttctgagttcgaggccagcctggtctacaaagtgagttccaggacagccggggctatacaaagaaaccctgtctcaaaaaaaacaaaaacaaacaaacaagcaaaaaacaaacaaaaaaaaaaaagaaaagaaaaaatagtatggtaagctattgaattaatgtgattggtatagtattatgtacatgagtatttttatctgattatgtgatattttcattactattaatttctaaagcaatacctaaatacatagtgtgttcttactttggtttgaaagctataaaatcaataatccaggacatatttctaatagctttctattgccatacccaatactggtttatttaatattattgtgggtaaaatgacagggattcaggtaaatgatacgtttatccttattaaacacatgcatgttttcaagttatttgtcagatggaatttttaaaactcaaattcactgccttcccattaaggaaaccaaaggaatgctaaattgtttgctaacaggagattcagcctttgatctatttattcttagtttcatagtttctttcaagtttaaatgtactaatttgtatcaatagaaaaataaactgtaaaataaagatttatggaagggagaccaggaagggggatgacatttgaaatgtaaataaaatgattaataaataaaaatatatagaatttatttgtactaaaaagaaaatagaaaaaggagctgtaaatgtagatttttgtcgtctaataaaaaattctaagatgaaagggatgtttcttcatgacatttaaaatggtagtcactggccacatatgtctatataacaatctcaatgtggctagtataattggaaaagtgaatttgtaatttcattcaattgaaatttaaatagtcacacatgtctcattactaccatattgcacagttcagataaaatactattaaaatgttaatttggtaattttcaagaaataaaagcgcaatcataaagtcatcgtagtgggcatgtttgcctaagttgataagcatttgtaattagcttagtatttgttttgaactttagttttagattgcttacttatatgagtcaaacaaatctaaaataggaataaaattatttgtcttcttgtcatgccaatgttcagagaaagaccagagacactcctcactcaacagaacagttacatattctaaatacatttaaaaacttacctttattcacaaggatttagtgaaggatacacacacacaacactcatctgaacagcttgcaaataattagagaaaaagctgccaactggagaaacttaaactaaaaatattttaagtcttaatatgattaaacatgtaaggtcagaaaaagcaatctgagacttaagtaacttggtaaacacaatagagaataaatatttacttatgtgcttctttctttaaggaagcacaataataatgagcttagtatgaatttgtacatttttctttaaaatactgactttgccaatcttaaaagataagcaagagcttctttataaatatgaccctatatattaattgtaaactatataaaggacttgtgtttgtagagttaaaagaaatgtttcttttcattgaatgggattcttttttcctaatcatgtaagaatgaaaacatttcccatctttcctggacactgagccacaattacggttaaaaaaatagattttggctccttagcatgctcatagtgcaaacagtagcctgccatgaactgaaaatgcagcaatgggctaggggttgagggctaagggtagaattagtcctgaattggagcaggtgctacagccctgtgccataagggccattagaaaattatgggggaaagaatcactttaccaaacaagtacgtcagttatcagaaatgaaaagtgaattctcaagttttacaaagtactagagctttgggaagtgtgtatttgtcattatggttaatttgcacatatctcactgaagaaaaggccaggggagctaggccgagaacacagctgtacaggcagctcaactaattgcctctccatcctcaacctcatttatcttcatttcttcccaattataccaaattatcaatagtctctgttgcatcagagtcttaatcccctttattcagacagcattagatagtggcagatgaattcttggagggagtcagggtaaacagccatgaaatgccacctctggcagatggcattgctcacaagaaatgtgacaaaacatttggaattcgtaactgggcattggtatgaggaagcaagctgttaaaattttttttaaagataaggtggtgcatggtaaaagtgtagcccataatttaaagaaaatatgcaaagttacagctgttcatatcaatgcaaaattaatacattttatttgttatttctcaatgatcactgtagcatgcaatctttcaggccattgtattctatgataataagtagcctatttacatttgaagttaggtacacgttttgtggccagagacaaaatattattacttttctttccaatcaacttccagattgtacaatatttttatttctatgacaatttggaaatatgtcaaaattagaaaacaaaccaaatagcataaagaaaacatattagtgagaaaacataatttgaaaatattttaaaatagtaacttttttctcaatggaaacaggcagaacaattattcattttgtaagatatcaacaataaaatatattctagtagatttaaacatttgataattttttcagaaataacttaagtataatattatttaattttacttccagaggcatatagtctatagctatgttcatgtaagtataatatgttgaatgaataaagaacaactttttaaaagacacacaaaataaaaggaagtcagcttagtgtattttactatcaaacaaagaattttttgaatgagctagtggctttatattttgccatttctatagtagagaaaattcttcgttgatggttgtatatatgtacttagtgctgaatccagttgcattctttcacattagattgttgtgctcagtaacagggaagggaaagggtgatttgtctgttgcctgcacacctgagtcccgcctcatttccttcttgggttatacctgggtaacttggtcttatatcattatccatcttctatactcatacctaagttacaccctagaatgttctttcctaactttctacaataatttaaaaaattgatacttttctttttacaaaatatgcttaaatttatattgattgaatgaaggaaatatatatgaattgaatccacagtcaatactggaaaataatacttttttaaaatcttttattccaaatttacttttaagattctttaattgaaactagtaaattattcactcttagaaagcaaaatttattcattttttaggtatttattttatttacatttccaatgctatcccaaaagtccaccacactctccccaacccacccactcccacttcttggccctggcattcccctgtactggggcatataaagtttgcaagaccaaggggcctctctttccactgatggctgactaggccatcttctgatacatattaagctagagacaggagctccaggggggtactggctagttcatattgttgttccacctatagggtcgcagatccccgcagctccttgggtactttctctagctcctccattgggggccctgtgtctgttcattctttttctctctctttagaaaacaaacagtaaatcaaaaagcaaacaaatgaataaaaaaattaaaaaatatgtactcactgataagtggatattagcccaaaacctaggatacccaagatataagatacaatttcctaaacacatgaaactcaagaaaaatgaagactgaagtgtggacactatgcccctccttagaagtgggaacaaaacacccttggaaggagttacagagacaaagtttggagctgagatgaaaggatggaccatgtagagactgccttatccagggatccaccccataatcagcatccaaacgctgacaccattgcatacactagcaagattttatcgaaaggacccagatgtagctgtctcttgtgagactatgccggggcctagcaaacacagaagtggatgcccacagtcagctaatggatggatcacagggctcccaatggaggagctagagaaagtacccaaggagctaaagggatctgcaaccctataggtggatcaacattatgaactaaccagtaccccggagctcttgactctagctgcatatgtatcaaaagatggcctagtcggccatcactggaaagagaggcccattggacacacaaactttatatgccccagaacaggggaacgccagggccaaaaagggggagtgggcgggtaggggagtggggtgggtgggtatgggggacttttggtatagcattggaaatgtaaatgagctaaatacctaataaaaaatggaaagaaaaaaaaattacgcttgaaccataaaaaaaaaaaaaaaaaaaaaaaaaaaaaaagagcacctcagcaaggcccagcgtgcattgcagaggcgcaagggggaaaaataaataaataaataaataaataaataaataaataaataaataaataaataaataaggctgctatgaacatagtggagcatgtgtcctccttaccagttggaacatcttctggatatatgcccaagagaggtattgcgggatcctccggtagtactatgtccaattttctgaggaaccgccagactgatttccagagtggttgtacaagcttgcaatcccaccaacaatggaggagtttttctctttctccacatcctcgccagcatctgctgtcacctaaatttttgacttagccattctgactggtctgaggtggaatctcagggttgctttgatttgcatttccctgatgattaaggatgctgaacatgttttcaggtgcttctcagccattcggtattcctcaggtaggaattctttgtttaattctgagccccatttttacattccaactttatatgtacaatgctatgacaagaatattgagagaataacaaccaaagagcatacatggttgtactgaggctcctggctcataagcagcacacatacatctcagtctccatatgggtcctacaaaaagtagagctggactgtccctaaaacagtagcctgactggaattcgctcctcacagggctgccttgcttggcctcattaggaaacaatgatcctaatcttgcagagacttgatgggacagggttgggatataaagagagaggtaaaaccctctcagaggagaatggcaggatggatgtggaggggctcagtgaaggggacagggagaaggggcaacatttgggatgtaaataaataaataaataaataaataaataaataaaaccaaatttttttttaaaaaaaagaaagaaagcaaaatttagcaaatttctgtcaatgtgtaaataagtattttcctcaaacatatctatgaagagtccatcctttcttcttatctaaatcctttaaaatgatacatttatgaaacattttggtatagttggtagattttttttgaaaaatgtttatagaacatatttacatcttctaaaccatttgcctatataattatcagtaggcattctcaaatctactgtgacaagcatactttttaaagtatgactgactgacagacagattgggaattgctgacttaatggtcatattttgaatctttgtcaaggatggctgtaattacatcttctgaatcaactgataaattgttggcagtagccctgtaaagtcatagatgatgttctaaattttcagtgctttcacatatttgactatataattttctttaagactaatatgttaacatacatatatggccattcaagtaaaaatgtaaaattagaaaaaatccttatgagaattatttatttagttcttgatatctctcatagcctcaatcctgtgctaatcctaatgatagtctattaggattaataatggaaccaacttgatctgtcttttgtggtttaaagtatttggctcttatctaccctagtagttacattaagtattttatatgttctatcttatttaattgttatagtaatagcaggataggtaaactgtctttatatgtgtaagatacggttcagaggatttaataccctttctaaagcccatagataccaaatgggtaggccagcatctagattcaggcctgttactatacttctagctacttttcattatgctgttataactgaggaaaatataactttatctaactttatgtgctacttggtcttatagactgtaacttattaacaagtggtagtcaagtgatgttaccctaactccactattcaaagactagtctataggtaggagactcaaaaaaagttactatctgggcaataattatttctgagcatttgctgtaaatgttcaaatggattcatttggtcattgttactacaagagtttatgattccattcaactatattcccaatcataaaaggttactattctgatacaaaactaccatgcttttaaggatgattttaagatatatgcatgatgaattcttaggagacagaaagacaaaaaagtgaattatgtgcccctattcggtgcagccagtcttgtcatttgctacttactctaactcattggcttaaaatccatggcctagttcattaattaatgtggtaataaaaactataaacctatataactgatatatttatatgtcataaatcttgtaagatgaaatattgagggaggtaaaaaaatatccaagtaatgcattttgtacaatttcagatggggggtgtgtaagaattttaaatttatcctgtatatcgtatttttaaattcaagataactttgtaaaacctcacccaccatatcatttgaatagtttttactgaacttttaatcttggattgttatcttttgtctgagcctgtgctatatcatcccaagagaaaatttaataaaaaataattaaataaaatactaattaattttgcactataaagcattatagtttcatagactaaatgaaagactagactgccaaggccagatagaacattcagttatctctgggcattactaacagaatttaaaagcgaccagttgctctgttacttaaaataaaaaatagatgctgtaatattttgttcagtctttttttttttttttggatcagaattttagaatataaatcacaagcacgtatgtcacagcttatgaattctaggaaatagctctttagcataaatcttcagtttgtattgtctgcagttgatgttcagtatttcagaaacactacaaaaggaaaaaaaagatatatgatggtattatatgattatttacgttacaatggactgtataatagtttgtcttaaagataccacttactattaaagatgacaaaaggaactcaaagtcaggtaagaaaatgctgtcgctgctttgaacttttattatttttcaagcatctttcaatatgtaatacagtagcaagaaaggaattcagtttttaaaatgtatggtgtattatagaaatattctctattagtcccagagtatagtttatatagacttaaaggcatttaaaaataattctgctccagaaaagactttagaagacatgtgtaaataaagtaagtaaagtctgttaagttcaaaaacgagcattaagttatatttatcatttgcagtttcaaaatagcaagtaaaacctgtttttttttaaattggtagtgccaaattaattttaagtataatcatcacactatgcaagatagcaagcatctttccaaccctgtgaccacactctgcaggtcatatagaaggtcactgtgcctctattatatgtgattttatagtctacatacctaaaatctttgaaactcaataattgaatattaaagttttagtcacggtgcctcataagtacatagggaatatttacatcttgcagtagtttaatttagaaacaaatgcactgggatttggggatttacacttatttgataaagtacatcagcataattcttagatgcctgagtcaagtacaatactttgtagtaagcctgggctgaataatagttttaatagtacatatacttttaaacaagaacttcctatttgttccaagaacaaacattctcatcaaataggttttgaatctcatagacttcatttcagatttttaaaagaaaattgtgtgtggggttatttaattaatatttgacaattcttacaatatcttttggttgcatacaagtccttcaactcctcccgggtaaatgtccacttccacatcttaccaattgtttaactcaaacccaaatacttcccaaatactggtggcaatagtcctaacccctggagctgtagtttttggtggggtctttagtgcctttcttatataaaatcatatcattttcaaatagtgatattttgactgtttttagtatttttatcctccttattactttttctggctaagacttcaagcactgtgttgaatgtgaatggtggaagtgggcatcctagttttttttgtgagtttagtcaactgctttgactttctttctctttagaatgatattgattatgggctttctgtataattgcttttgttattttaagctatgtctcacatatctttgtactttgggctagtgagattgctcagcaggtaaagcaacttgctgccaaacttgaattcaatacttagggccatatgttagaaggagagaactgacctctactacttcattttctgacttctaaaattggttgtggcatgacctctctcccttaaaagattaaataaaatataaatgtcaacttgaaagctttaaaagggattagtatgtgttgggaatgatggagtgggaagaatgcccaatgtgtggttgaattagatagatctacattttattcatgtgtggaaatgtgatggacaatattaatataagttggtataaatatctttggcatttttaaaatgccacacacattctaaaaaaggctctttgctttaatgcctccttctgttcattcatatttcctatgagaaatcaggtaagtaaataatcttctgggaactctaacattttaaaataagttttaatgaacatttaaaacttgtaaacttaaggtttgtcagtccactctaaaaattctgtctccacagttcatcactttatcatttagactgagtctaaggatgtatatttctgctaaatatcagcttaccaaaattcatgtttagagtaggtgtctcctggtaagataatgattgaaataaccaatcaactggagtattaatatgttaatcattttgtcacatatggtttatcatcattttaattttaataaatattaaaatcattactctcaaatgagattatttgtaaatagaccctttaaagtggaggctatgttaagtcaaaagaaggccatgggtgaatcacaaagtctatcccttcttactggagactgtgcataaaaaattaacacacacataagaattatgggtaagctgatacagaaacatgaaattgtcaacataaaggaagaaggcagtcatctgcaaagaggtagctagagaaaccaaacatgacaaaaccacagctgaggtaacaatattttgctgcttatgaaagaaattctgtctatgctatctagctagggaagtttcaacaaactattatatttaaatgaataagtaggcctacatattaaatggataaacaggtagatcaatagatatctagtgactgaacatagatcatattaataaaatttaaaatatttaaagtaaagtagatactgttacatttttacaaagagacatcactaacacaaagtttaagaccaccaagcacttttgactgagtcttaagctaatttgtatttatttaaaaatgaaaagagatatcattcagatgtcattgtgtccaaactgtttacacaaaatccacatatagagactcctcaatattccccagtcacctacttcatagatattgtctgtacaagaggacaaagtttgtatttataatcagagaggatagaaagaacaacaatccaaactatgattgtcatggtagttaataaacatgaaagtggttagaaagaaaataaagcttcatccagtgtcctcataaaagcaaatacaaatgcaaaacacttttaatgaagctttaaaaatatttttattccacttgggaggcagaggcagatggatttctgggtttgaggccagcctggtctacaaagcgagttccaggacagccagggttatacagagaaaccctgtctcaaaaagaccaaaaaatatttttattcaagttcatatagtgtacatgatatgaaaaccagtatcttggggtacaggtggtataggatgtggaaatgtcagagggtgaactgagaacaggataaaatctggagtatataaaaaagaatcaataaaataaaataaaataagaaaaaagaaaactggtagctcaattctagatatgctagttaatgtttgatgtaggctacaggttgttacaatgtaaatattgacaatttttaagcctaggattggtgtgtgtttttgctgctgtaatacagcactaccacattaatatcatgtggtatgatttagtgtcttctaaatttatatttctttgacaatgtttgcttaatccttttacagattgcaatgctgtaatggtaaggtaattcatatcttgaacacagtgctaaaatggtagaatacttccattttttgcttaataattgatcattcaaatgtttgtgttttcttgcatttatcatgtttataggcccaatgttattataatgaattctcagtattgcagtttggttagtttcatcatttattaagtattaccccctccaaatatacttcttcataccatataacaatttcttattgatttaattggaaatttaaatttgtacatgccaaattaattgattgcaccaaatcataaattatttccctgctcttagtcagtgacagtgcagcatcaaacatctggataaaatgagaacaattggtacagtcatagaagttttgaattgtctcaatgagcagaccaaacctcaacatgattaaaggaatgatttgggaattattaatcaagtctagcaaattaaaccaaacttcctatcataaataacttcagaataaggttaaatttatgattttattgggttgcgaactgtcagatacttttctccttatttgattcaaaaaccttattaatataggtatgtacagtaaatcctccatgcttatgcaaattatgaaaatatggtgtgtccttgtcttaattcatgaactcagagtgtagttagaactgttgcatttgaatcccatattaactttaaccacaaaagagcatttattgaaaatatttacatctttgtttgccagaattatctgtctgtagtgttggtgttttgttgtatctttacctggaatgagcattagagtaatactggcttcatagaatgaggttttgagtcatccttccttttctaatttttgaagggtttaagaaggaattttagtttttgaatagccaaatgaattctgctgttaattcatctaaaagtggacttttcagtaagaaggctttgcattactatatcagcaccctcctttgttatgcatctgcttgggttgttaatgtcttcttggtttaactttggtagtttggttgaatcaagaaattcatccatttcttttagctttgcttaatgtatgacaggtatttaaagtattcttttgcaatattctgtatttctttggtgtctattgtaatatttgtcagattatgtctgattttgttgtcatctctttttcctctcctctcctctccctctcctctcctctcctctcctctcctctcctctcctctcctctcctctcctctactctcttctcttctcttcttttcttttcctttaccttgttttgagatgttatttttttaacctttttaataagccaagggtgggaaattccaaagacctgagttagtgatggctagctgccttttctggaaatccagtaggtagagtgccaagggaatgtcatggggctgcacatctggaaaagttgttcccccaaaatgtcctggatttaaatttagggccatgtgaaagaagaggaggattttagtcatgcattgatgaaatcaataattacaactatacatcccagtttatataagttccttctttttctggattattttttaaaaaataattaattgttttatttatttacattctggacactgcctccctcctagttccccctcctcccacagttcctcatcacattcctcctccccttgcctctgagacagagtgactccctccctgaccaggcatccctcttccttgggacctcaagtctctggaggactaggcacatcttccacaagagaggccagaccaggcagtcctctgctacatatgtgcagtattgggcaggctttccttggaccatccactgtatgctgcctggttggtggctcagtttctgagagttcccaggggtatgagttagttgagacttctggtcttcctatggggtcaccaacttcttcaccttcttccatccttcctttaactcaatcataggggaccccgacttcagtccaatagttgggtgtaattatctgcatctgtctcagctgctggcagagatgctcagaggagagccatcctaggctcctgtctgcaagtacaacatagcatcagtaatattgccaggcttcatgatatggatcccaagttgggccagtcactgaaccacctttcattcattcttttctccatttttgtccctgcagttcttttagacaggaacaattctgggtcatatattttgatggtgggttggtaacattgtcccttttcttagggccctgtctttctactggaagtggtctcttcactttacctttccctactgttgagtattttagctagagccatccccattgttacctgagagtcgctcatatttcaggtctctaggactttctagagggtttcccacccacagaatctgcatatttccattcatttctttattttgattaattgggccaagggtctgttgatcttgttagagtttctatttcattaatttctgctttgatttttattatttctttctgtttaatagctttggtttgtctcctaccccaaattcttgagttgcatcattaagtcatatatttgtcctctttcttttgttaattttatttatttttattagatactttatttacatttcaaatgtcatcctctttcctagtttctcctccaaaacccccctatcccatcccctgtgcccctgctcaccaacccacccactcctgtttccctgtcctggtattccactatggaatttgtactctttctgaatattatgtgagcacttagggggtgcaatttttcctcttagaattcttttttgtttgtcccagaggtttttgtttcattttattttggtgctgttttcatgtttatttagttcttggaatactttattgatttataattttctattatgcttaatttctattattttcagtagagttttgttaattttataccttattgcataaagatcacatagaaatcatggatttttcaatattttttcaaaatttttctgtgtatttgttaagtctaactttgtatgttagcatatgatccattttagagatgtgtccatatgctgctgtgtacattgtatacttttagacatttgggtagaagagtttgttgagttattatcaaaaattgtttgtacatttcagacattttgatgttttcctgagctagttcttttagctgtgagttattttttattaaattatagcttcatttgttttctttctagggtctctttagttcgaacatttgcttctagtattgttattagcatttatttttgttggctataaaacattttaggttgtttggatgatggaaagtttttctttcacctatggtagatatttttgctgggtacagtataataggttgtgaattgtggtcttttagaacttggagtaggctccaagttttagaacttgttccagaatctctctctgtctctgtctctgtttctgtctctctgtctcactctgtctctgtctctctctttctctctgtctctctctgtaatttatttattttatctaatttatttttaaattttattacatttgtttattttaaagtctagattttattaccctcccagcctaccctcctggttccacatcccatacctcctgcctgccctctgtctccatgaggatatccccattcctgaccctccaccccactagacctctaaaacccctggggcctccagtctcttgagggttaggtgcatcatctctgactaaactcaggcctggcagtcctctgttgtagatgtgttggggacctcatgtcaactagtgtatgctgcctggttggtggttcagtgcctgagagatctcaggggtccaggttaactgagactgctggccctcttacagggtaactcttctcctcagcttctttcagccttccataattcaacaacaggtgtcagctgcttctgtcaattggttgggtgtaaatatctgcatctgactctttcagctgcttgttgggtttccagcttctggctaccacaaacaaggctgctatgaacgtagtagaacatgtgaccctgtggaattgcggggcatcttttggttatatgcccaagagtggtattgctgagtcttcaggtagagctatttccaattttctgaggagcctctatattgttttccagagtggttgtaccagcttgcaattccaccagcaatggaggagtgttcctctttctacaattctctacaatatgttttgtcatctgaggctttgatcttagccattttgattcctgtaaggtgaaatcttagggtggttttgatttgcatttctctgatcactaaggactttgaacacttctttaggtgtttctcagtcacttgagattcctctgatatgaattctcggtttagttctataccacattttttttattgggttgtttggtctttttggtgttagctttttgagttctttaaatattttggatattagacctctattgaatgaggggttagtgaagattttcccaatcacgaggttgccaaattttcttattggctatgtaatttgtcttacagaagctttccagttttatgaggttccatttatcaattcttgatcttagagcatgagccattggagttctcttcaggaaatttccccctatgccaatgagttcaaggctctttcccatttgatcttctattagattgaatgtatcaatttttatgttgaggtccttgatccacttggtgaggtgtttgtggtgtagtggtgagtatatctgccttccagaagtttctgctgagaaatgtgcttgatgggtttaccttaataaatgatttgtgtctattctcttgccacaatatcttatttgttctacatatttaatggtatgactctgatatctcatgcagattttctttttagtcttgtctatttgagtttttgtgtgctttttgaatctgcatggataggtcttttcttagtttgggaaagtttcttgttaaggatctagttggtgccattggactattctcccttttctatgttaatatttgaagatatggtctttttgtggtgtgctggctagccatatatcagtcaacgtcgtacaaaacaaaagttggctgaaaggaaggaatgtcagttgagaaaatgcctccataagatctagctgcgaagcattttcttaagtagtgatacatgggtgaggacccactcccttggaaatcaggacaagcaagccagtaaaaagtacccctttatggcctctatttcagcttctgcctccaggttctaactctgtttggattcttgccctgatttccttcagtgaagaacagtgatatggaattataagccacataagccctttcttacctaacttgctttctgtttatgccatttttgacagcaatagaaaccttaattaagataggtggtatctcacattgcttgcatgttcctatcttgagctttaaaaaatattacctctattttttcacagtataataaatttccatcatttttccctttccttcttctaaactctcccacatatccctccttgctgtttcaattattcattatttgttttgagcgtgtatgtatgtgtgtctatatgtgtatgtatgtttgaatacctacacacatatgcataactatatatatatacacacacactaagtgcacatatacaactagctcagtctgtatatatgttttcaaggttcaacatttagtttttcctgagtgagactagttttcccattcttagcattctgtagttgcccatacacgttacaggaacaaactcacacggttttctctatccattttagcaagcctatttatgttgtccttgttcagctcatgtttaggcagtcagtaatgctggtgatactttaaagatgccacttctgatattattaggaaacataatctcaaagaaaaatctataatactttggctcttataatatttttctccttattcggcagtgttgcctgacctctaagtgtaagagttatgttgtagatgtttcagttggtccctggttccccaactgcatttttgattggttgtgttctataaatgttctccatctgttgcaaagaaaagtttctttgataaagggtgagaaacagaatgctgtgggtataagcacaaataatttgaatgtagttagcaattatgttggtttaataaagtagttagttataggctgtcctcaacaatctttaacttaacaagttctggggagttggctaggttttctttaccagtctagaatttcttgttaagtgggtcgttgctggcggttggttctaatactttgatttaatcaggaatctgtgtgtccaaatgctgagggtccttgtcccaattggtttttgacccatcaataaagagccaatggccaatggctgggcaaagggtgattgggagggacctttagatttgcaagggctaggacaggggcaggtgaggaaaaggaggattgccatgatgtagtaggagacagatcagatgtagacctgcaagagagtcaaggaaccatgtaagaatttgagtaagtggtcattgggcctggggtagcaagaggaggattagaactgcccagcctttgagctaaccatggcatttcaaaaataaactaatgtgtctgtgtctttcattcatggacccaaggagtccctggatgtgactggaggtgcaccacctgttgggagcataaagcagtgtaactaaatctcatcactacaggtcttaagttggttatcacccaagtatgtattccatgaaagtacccttagtgatactgaaccctactgatcactgttatggttcataagcatcaaagcttatgtaggacttttgcttgcttccatacttttgaagcttgaataacagttagcagttttataaaaactaaccagaagggagacgcctttgaggtctggcagcttgaagtacccctattccttgtatcagaatatcattttatcttcacactagggattaaccttccacttctagaagacaaccaaaagcaataacactagcctacaatggttgtgtatctctttgacaaagaccaacagcttgaaacaggacttttcatgcctgggattggatttttattaaatggtattttgtttttggaaagaacattgtcagcctaggaaattttcatttaaactatatatgtttatttatacacatacttagatgtattatagtttattttagatagatacttaatcatgtgattccttatgaatttttcagatgtcctcatttttaccatcttctatcctccatatttatctccttcctcttacatgattagagaatcctacttttcccattttcacaatcagataacctataccatactattcctctctccattccccacatacaccagagccccgccctgctctccatttactttttgcttctttgttttgttttgttttgttttgttttgtattgttttgttttttcattttgccatatgtacccacatctgaagatttggagataggagcctcagataagagaggacattcacactttctcttcctaggtctgtcctcactcaagtgatctatcttcctctttttacatttttaaattttcctttgcttatttcatataaattgtctattttatgtttgagttctattatcctaccttctgcttgattcattctggttgtaaagctttttcctgaattttctaactgggatatggagtttttcagttccatttctacttcatcttctgttatctttgatatttttatatctttattgaattcagcttttaaatcccaatttatgtgtatttttcattcagttgtggatttatattttcttgacactactgtagcatttattgatattctaatgaatttaaataaaatgtttctttatgtcttcttaaaattcctgtattcttttattaagtttatgatttttttttaaatactgtgtgttctggcattcatttaggtaatttacactagagaacacttgcagaatactagtaagttttgtgtgagacatgctgtattggtcaaggttttgttgttgccattgtttttggttttggtggtggtgatgttgttgtagtccctgtttttatttttctgatttgacctaggcatgtgaacttgtttctttggttgtgtgtacgatacaattatgtgcccttccttagatggggccagaggcaagaaatgtgtcacctaagatcagttagtttgttgatgggtatgctaagttaaacatgatattgtttaaaacccatttgtcaggatctaggcttgtgagttagcatataccatgtgttggagaatgcaaagacaaagggaaaaagctacttacctaaggaaggtagctcatatgtggatgatgcaggctacaggtctggaatgaggcttgtggatttgcaaattgcagtgagtctgagagaaagggagagaaaaggaagatatgacttacccaagaaaggtagctcctaagcaagcagtctctgtgggccatcatgtgtctgaaagtaggattgtgggtttgcagatcaataaaacatttctaagagatactatttattacagttctacaaggaagattaaaaaaattatggtaaagccatcaacttaaatgttttcatttcaatttctttttaggtggaagtgaatcctcctgggataaagataagatacaatctccacttgctgcttctggacctcaacatggaattgctcatgcagcacttgctggtcagccaggccttggaggtgctccgacccttaatccacttcagcagaatcacctgctaagcaatcgtacgtatactatgccaacaaaattggatgtgttaaaaatataaggcaagaatttctagttatcttggaatggcaaaatttagtctatttctcttcaacaaggtataaagagttcaaaatcataggaagaaatagtgattcctttggaaatatgaaatttatatcgtataggtaactgggcaggcaaagcagaagaataaaataaaagcatattagtatgtgtgaggtgctaaacaggatattgacttggatttcaaattccatttttacaaaactatgtaattgtgttacattggagaagtaatcaagagggcataagtctcaatttctatacctataagatatcagtggaaatagacctattttggattattataagtgctacaaattgacaaagaaaaagacactagtaattaattgcatagaataattgttctgtaaattataatgattaatagtgctttggatattaatatagatgattcgtacgtgtttctatttaggtgatctctacaaggaagtaaaatattcttatatccttctgctgtaaaaaaaaaagatctttcattaatttacttaggtaaagtactgcatttcttataaacaagatttcccagagaagaggcccattattcctttttctaggagttttattccgtgttgaactctggggttgaagcaatagaagatttctgaaacaggtacccctcatagtataccatcaccagaataaggactttttataatataagtttgttgaagcagttactatgtgtttgaatttccaagagagataaacaaaatctggggttcagaaaaaaagaacactgaaggaaacaagaggaaaattgaataccacctattacacacttaatttagtctaactcaaatcttgttcaacataaaacatttccctaaagacatagtgttttcattcattatgcagctgataaatcatatgggactttcaaccagcaaccataaaatgcagctcatgaaaagatgattcaaatacatcccaaggattgatacaatgtctcatgagttcttgagaacataggtctacatgcttagatcacatgacaaacatgagcacagtagtgggtctagaatctgagcattccatgggatgaggccagaggaatttggatctctgaacctcagctgaagcaagtctaacagtatcagtgaggtctaggttcagttaaaaaaaaagaagaagaaggaggaggaggaggaggaggaggaggaggaggaggaggaggagaagaagaagaagaagaagaagaagaagaagaagaagaagaagaagaagaagaagaagaagaagaagaagaagcagaagaagcagaagaagcagaagaagaagcagaagaagcagaagaagcagaagcagaagcagaagcagaagcagaagcagaagcagaagcagaagaagaagaagaagaagaagaagaagaagaagaagaagaagaagaagaagaagaagaaagaagatttcaaaacctaaggtgaagagatattgaagaaggcaggatatttttacttttggcctgaaatatacatgtacaagcacatctgcacacacatacacagaaaataagtgtagtctaaagagacaaaggaaacaccagcaccgattcaaatacagcatctattttagaattacctactgactatttaaagtgcctgatgaatgtgctgaagtaatgggaatgtggcacaacatataaagcatggatgatgtaaacagagattaaaaactcaaaaggagtcaatagatacattagaaaagaaaaaggtccttgttacattatgatgaataacttttattgaataatgtgtaatttgtgatcctgaaattagtcaatagaaatttcccaaatgaaagaagagctcacgtcaatacttttcaaattattccacaaaggagacagaatattgcccaatttgttttatgaggccccaatgaccgatactcaaagcacataaagacccatcaaagaaagaattatagcccaatgtttcttatgaaaaaagatacaaaatttccaataaaataagtaaaaaccaaacccaagaaggtatataaaagattatccattatgatcacaaaggcttcatcccagaggcaaataaatgtaatcaaacattaaaaacaaactgaaagttgggtggtggtggcacacgcctttaatcccagcaattgggaggcagaggtaggcgaatttctgggttagaaaccagcctggtctacagagtgagttccaggacagccaaggctacacagagaaaccctgtctcaaaaaataaaaactaaaaataacaataaaatgaaaataactgaaagatgaaaaccacatgattatctaataatttccataaaaagcctttgacaaaatctaccaccccatcatgaaaaaagtcctggagatattagggatacaagggacattcctggagaagataaaggccctatttagcaagctcagagacaatattaccttcaatggagagaaacttcaaagaaatttctgttaaattaggaacaagacaagactgtccactttctccttatctgtttaatatagtacttgaaatctcagctagagtaataggacaattaaaagagattaaggagatatgaattggaaaggaagaagtcaaaatatcattagttgcagatgatatggagtatacataagtgaccccgaaaattctaccttcagtgaagtagaaaaacagtaacttcctttatacaaatgacaaattaactgagcaagaaataatagaaacaactttcataataacctcaaataatataaaatatcttgtgataacttgtttgatagaaatatctagttttgaagaatgaacttgaagaagatatcagaagatagaaagattttccatgctcatggattggtaggattaacataaaaattggtcatcctaacaaaaacaatcttcatattagatgcaaacccaatcaaaatatcaacagaattctttgtagatcttgaaatgataatatttaggttcttatgcaaatatacacactcaacaagaatggctccaataatcctaaataataaataataataataattttgggacaccatcattgacctcaaattgtactgcagtgctataataataaaaccaatgaaggactcacacagaatcagacacttttagcaatggaatcaaaatcaagaccacaacattagtccacatacctttggacacctgatttctgataaacaaaacaaaaacactactcaagtaggatggccacatatagaaaaatctagataggtccatactcattatcctgaatacacgtataaacataaaaccagatagactaaatctaacagaagaaaaagtatagaataatcccgaattcactggcacaaaacagactttctgaacagaaaaccattaccaaggaactgtgattaacaattaataaatgtgacctcatgaagttgataaacattattattcagacaaggtgacagcctacagaaggagaaattattttattaccaactccaaatctgatagagaacttagtatccaaaatattgaaagaactcaaagacctcaaataaaacaactaagaaaattgaaagtggggtacaaacataagcagaaaattctccaaagaagaaaggtaaatgtctataagatacttaaagaaattaacatcaatcacaaaggactcattggttctgaaagcatcatttggtgaaaagagaaaatcagaattgagttacatctaattgatttgtagttaaagggttccatgagaatctccaaacaatcaaaatgtttacaagaccacagactgttctctgtcagttaatggcaaagccctattactgaagaaaagaaacaactcaatgaacatggagaaattgagctggtgcctacagagagccttcacccctatgtgcttatatctttggtataacaggtactctacaagttaccaaaggagacatgtaaacatcaatgcagccataaaccctttagcttacaatgttgatctgcagatgtgttagggcactggtggtataaaacttgtgagaggaactaaccaccaacctatctctaatctgaccttagttccactccacaaaatagaacctatacctaacactactcaggtaaccatgaacatgagactagatagcctgcacctagagtaaaaccaagtatcactggtctaaacaatgacaacaaaaattatagcaatgaaatgactcccagtgacattctgctatactcatatatcagtgctttgatcatccatcatcagagaagctttctcatgtagcagacgggaatgaacatagactcataggcaacattatgcatataatgagaaaccttggaatactcagctaatatctccattaatcctccccctcagggctcagggaacactgtggaagagggagcaaaaagattgtcctttgtgtatttattatgtcttagaatttattattttagggggaccccagagtataaaaaatacggggtctctgcaactgaatctgtttcttgtacattttcttagactcttttctatttgctttctttattattagtagtagtttttgttttatcttatcaaattatattttattttattattcaaaaaaatccaactgaaaaagaaaattcacagcttatttacctaagatgtagtgttctaaaaatatataaggaaaatgtaaaaaaaaaatatgaactgtaaactatttgaattatcagtgattgttgttctagttggctctgtgaacttggaaaggcggggccttaaaatgagacagagtaaaatcttatataataaccaactttatttggggcattagataacttacattctaagaattcggcaaaatcatatgagcaaatttcacttgagttcaagatgtacacactcacaaatgccaaggcacatgagtttaaactatatacagtcataaaagacaatttgtgcttggaaacatgattctgaataataatggatgagataatgagtaatctaaagtaagcccacctttgttcattatacctgagagcagcagaatagcacatttcaagaacaacctatgttatggagaaacagaggttacaagacttttttcttgttattgaacttttctcacatgcactctgaaatatcctcatgcagcttcattcatggatcacgttctatcaagtgatagaatttttctaaaatcattgaaaaagaaagaaaacatgtcaaaagttcactaatatgttaaataccaaagcatgctacaagccttcatatcattcaaattgaaaggaaaaaaaaaaaaaaaacaaggcagagaaagtgcaagaaagaatatggcactattgccacagacctgatgcaagaaatatagtgtggacagtaattcagaaagaaaaaaaattattctgctgaaatattctgaaataaatacaataatgtaaatgtttttcttattcttaatttagcacaataatatgtccataaagtagccaactgagtgattattccttgtagataagtaaataaattacactaggagagaagatttgaaaactctcttcaaaatttttgatgcagaattattcctgtctaaaggaaaggaagggacaaaaatggagaagagactgaaagaaaggccatccagtgaccgatacaacttgggatccatcccaagtgcaggcaccaaaccctgacattactactgatgcctcgttgggcttgcagacaggagcctggtatgactgtcctctgaatatctgtactagcagctgacagaaacagctgcagatacttacagacaaccattggactgaggtcaggggatctctatggaagagttaggggaagggcggaactagctgaaggaaattgtaatcccactggaagaacaacactattaactaacccagaatcctcagagattccagagactaagctaccaaccaaaggacacactctgtgttcccccacccctgctacatatgcaattgagaattgccttgtctggcctcactcagaaaggatgcacttaatcctgtagaaacttggtgccccaggaaagaggaatgctagcagggtgaggtgagagtgggtgggtgaatggcggagcaccctctcagaagcaacggggagggagcatggagtgaaaaactagtggatgagggaccagaaaggggagtagcatttggaatgtaaataaagtaattaataaaaaagaaaatactctttttatatggcatttgtactgtccatatatttatgtagtaatgtttccaactatatgtagatgaattctaaatctacaggaaaacctctccagaaataggcaagtttatccaaacccaagctattagccataaattcatacacatatgagcaatgtgagcaacagtaaatgtactcagaagaatatatttatcagtgtgtgtgtgtgtgtgtgtatgtgtgtgagtgtgtgtgtgtgtgtgtgtgtgtgtgtgtgtgtgtgtgtgtgtgtaattaaagaaatggatttgagaaagaattgaggtatatgggaggagttgtggttgagaggactggaaatgttataaatacagaactcatacatgaagttccccaaaatcattaaatttaaagtaggccaagccaaataataaacttatctataagtgacataagagggaggaaagcgactagggaaagtaagaagtgaaattgttataaattgtttataaattgttcctctaaaacctaagaagacaataaaaggaggaagatggggtaaaagagattaagaaaacatgaaaaacaacaaataaaaataaatgcaaaaactacttaaattagtttaataaacactttacaaggaaatggtctgaattggccaattaaatgatatcaactggtgtgtgtatcctaatagcaccaaacatgagaggttttacttgaaagtgaacttactccctttgaaattctctcctgactcagcaaaatgcagcaaaactaagagcaaccacaaaaaatattataaaaaaacaaagataataagaaaggttgataaaagaagaaacaaatatatgcttcctaagggatatatctatatctatatatctatctatatgcatataggtagatataaataattaccatgcagaagaaataaaaagctggagtaactatattaacttttaaaagccaacctcagaggatccaaaattaaattatcaatttcatttaaaatggcataatgtatcttcaagtacttgcaccagataagagtgttaaattatgtgagaaaaactgaaaggaagtgaatgaatctactcttgaatcctttgtcaccttacctagaagtaattgacacatctagaagatgggcataattgaactgagcagcacaattaaacagctgaatttaatagacattttaaattactttatacaatagcataataacacatattcttaaattcacaggggacattaccaagataaacacattgtggtccataaaattcatattaaacaaatttaaagaaatagaatcttataaaatgcattgttcaggaaacagtgtctattctatcgcatgtgaacagctacttatcacagtggaagcctatggactcagattgcttaccacattacctcagattagacactgtgtgctcttaccatcaaggtctctttgccaaaaaaaaaaaaaacattaatggagacatgagggtgcagatacatcagcaggtaagcagatatggtaccagctactcatgctcttcggattttactgttctgggttttggaaatatttataagcatggtatgtcacatttcttatttggaaacacactgtgccaggtagactgaccactaggttgtgcctgaattttctcctacaaaaagataaattaagtgaatctaaagtaacttcaaaagaattaataaataattttgtaccaatgaatgaaattaaaagcagaacttcagtttaaatgactagaagtgaaagcaggttcatagaccaagtcttagcaggttcagaaaaagaagagggacatgtttttctaatattagaaaagagggtactgatctcatgtatgttaataaggtaatagaaaaatactctggactattgtatatttttatattgtagattaaaacttcttgaaagatgtactttagaaattatattaaataatatcattggtatacataatacattaaataaattaaatatataatttgtaattagctgtcttccaaaacataggttgccaggtcaagttgtattaacaggagaatattaaaaattaagaatttacaacaggtttctataaactcttctacaacctagaactgaaggcacattctaacatattctctgaggtcagcattggtcagatgacaaaaatcaaataacttcccaatagaaaggaactatagctcagtatctatgaaagcaataaaagaatcttcagtaatttataaaaattttatctggaaatataaaaattttattgattgggaaagatgaacttgtctttcccaaagtaatgtgtttgtatatggaaaaacagaccaaagataatcataatatgggctttagattaaaaaggcaagatttcagcattaaatattaacataaaatctgttgctttcctatgttatatcaatataatacttcaatttgaaacagcattgagttatttatttataaagataataatatatatatatatatatgtatatatatatatatatatataaccacaaatattaaatgattaataaattggagttttgtaaaattgaaatctctgtaggacacacattttttttttcttctatgttaaggtcaccacattgacatcctggaagtgtcccctatccccggcatctggggtagctgcataattttaatcattaccagggcctctaggcctctctcctgtgtctctctgcacctgctcctgcctccccattctccttgccctcctcactcctacctacttctctcctgttagcttaatcctatgactattttatttccccttctaagtgtgaaatttggggcttcctgcttatttaacttctttgggtctatggattatgtgtattctgtactttatggctaatatccacttatcagtgggtacataccatgcatgttcttgtgggaatggcttaccacacttaggatattttcttgttttatccatattcctacaaaattcatgatgaccaagttttctttttataaaatactttattagatattttctttatttatatttcaaatgttatcccatttcccctctgaaaacccctctgtcccattcctcctcctcctgctcactaacccacccactcttgcttccctgtcatgacattcccctacactggggaattgatccttgacaggaccaaggtcctctcttctcattgatgtcccacaaggccatcctctgcaacatatgtggctggggatatgagaccctctatgtatactctttggttggtgttctatttcctgggagctctgggggttgtggttgtttcatattgcttttcctcctatgggtctgcaaacccttcagctccttgagacctttctcaagctcctccattgggaatcctgtgtccaatattaacctgagagcatccacttctgtatttatcaggtactggcagagcctttcaggagacagctatatcaggcgcctgtcagcaagcacttcttggcatcagcaatagtgtctgggtttagtaactgtacatgggatggattcccaggtggggcagtctttaaatggactttcctacagttactgttccacacttgtctttgtatctcctccaatgggtattttgatcctccttctaaggactgaagtgtccacactttggtctgtcaccttcttgagcatcatgtgatctgttcatggtatcttaagtattccaaatttctgtgctaatatccacttatcagtgagtgcataccatgtgtattcttttgtgattgggttatctcactcaggataatattttctagttccatacatttgcctaagaatatcatgaagtcattgtttttaatagctatgtagtactccattgtgtaaatgtacaacattttctgtatccattcttctgttgagggacatctgggttctttccattttctggctattataaataaggctgctatgaacatagtggagcatgtgtccttattacaagatgaagcagcttctgggtatatgccgaggagtggtatttctggagcctccggtagtactatgctctcaggttaatattggacacaggattcccaatggaggagcttgagaaagatctcaaggagctgattgatttccagagtatttgtaccaacttgcaatctcaccagcaatggagaagtgtttctctttccccacatcctcactagcatctatggtcacctgagttttttaacttagccattctgaatgctgtgaggtgaaatctcagggttgttttgatttgcatttccctgatgactaaggatgttgaacatttctttaggtgcttctcagccatgcagtattcctcaggtgagaattctatttagctctgtaccccattttaaatagggttattggttctctggagtctaacttcttgaattcttgtatatattggatattagccctgtatcagatatggggttggtaaagatcttttccccatctgttaattgctgttttgtcatattgacagtgtcctttgccttacagaagctttgtaattgtaaaggtcccatttgtcaattcttgatctaagagcataagctattggtgttctgttcaggaaaatttcccctatgcccatgtgctcaaggctcttcttcactttcttttctattagtttcagtttatctggttttatgtggaggtctttgatccatttagacttgagctttgtacaaggagataagagtggatcagttcacattcttctacatgataactgccagttttgccagcaccacttattgaaaatgctgtctttttttccactggatggttttaactcctttgtcaaagatcaagtgaccataggtgtgtgggttcatttctgggtcttcaattctattccatgtatctacttgcctgtcatggtacaaataccatgcagtttttatcacaatttctctgtagtacttgaggacagggatggtggttcccccagaaattcttttattgatgagaatagttttaagtatcctgggttctttgttatttcagatgaatttggaaattcctctttccaaccctgtgaagaattgagtgggaatgttgatggggatttcattgaatatgttgattgctttacacaagatagccatttttactatattaatcttaccaatccattagcatggaaaatatttccatcttctgaaagctcttcgatttctttcttcagagacttgttcttgtcatacagatctttcacttgcttagagtcacaccgtggtattttatattatttgtgactattgtgaaggacattgtttccctaatttctttttcagcctatttatcctttggagagaaaagccactgatttgtttgagttaattttatatccagccactttgctgaagttatttatcaggtttgggagttctctggtggaatttttggagtcacttaaatatactatcatatcacttgcaaatagtgatattttaaattcttcctttctaatttgtatccctttgacctccttttgttttctaattgcattggccaggactttgattactatattgaacacacagagagacacacacacactcatttgtataagtaaaacatagacagaaacttgaacataaacttcaacaatatatgggtagaaaaataaacttattaaaggaatttttgcatcatatgtcattaggaatttataaattcaaatgagatttcattataaaatattataatatataacattcaaaactctctcaaacatatcctgcttacacaatcatcaatcataaagaaaatgctttgatactgagtaaaattgaaaccagcagagtcacttcgatataatgttggcccattttacaaaccaagtaaagtttttcatattttactaattaatgtgaaacatgtgccaacacaaacacctatacatgaaaacttaggataactttataattactagatattgaaagcaaacagggtgtatttaaataggtaaatgggtcagaaactaccataataaatgttataggacaatgaaagtaaaaatacacgacctattctgagtgctttaaggtggaattcgacttatatttctttttttaaatttatttttattacatattttcctcaattacatttccaatgctatcccaaaagtcccctgtaccctctctcccacttccctacccactcattcccatttttttggccctggcgttcccctgtactggggcatatacagtttggatgtccaatgggccactctttccagtgatggccaactaggccatcttttgatacatatgcagctagagtcaagagctccagggtactggttagttcataatgttgttccacctatagggttgcagatccctttagctccttgggtactttctctagctcctccattgggagccctgtgatccatccaatagctgactgtgagcatccacttctgtgtttgctaggccccagcatagtctcataagagacagctacatctgggtcctttcgataaaatcttgctagtgtatgcaatggtatcagcatttggaagctgattatggggtggatccctggatatggctgtctctacatggttcatcctttcgtctcagctccaaactttgtctctgtaactccttccatgggtgttttattcccaattctaaggaggggcatagtgtccacacttcagtcttgattcttcttgagtttcatgtgtttagcaaattgtatcttatatcttgggtatcctaggttttgggctaatatccacttatcattgagaacatattgtgtgagttccttcgtgaatgtgttaccacactcaggatgatgccctccaggtccatccatttggctaggaatttcataaattcatttttttaatagctgagtagtactccattgtgtaaatgtaccacattttctgtatccattcctctgttgaggggcatctgggttctttccagcttctggctattataaataaggctgctatgaacatagtggagcatgtgtccttcttaccggttgggacatcttctggatatatgcccaggagaggtattgtgggatcctccggtagtacttactatgtccaattttctgaggaactgccagactgatttccagagtggttgtacaagcctgcaatcccaccaacaatggaggagtgttcctctttctccacatcctcgccagcatctgctttcacctgaatttttgatcttagccattctgactggtgtgaggtggaatctcagggttgtttagatttgcatttccctgatgattaaggatgttgaacattttttcaggtgcttctctgccattcagtattcctcaggtgagaattctttgttcagttctgagccccattttttaatggggttatttgattttctgaagtcaacctttttgagttctttatatatgttggatattagttccctatctgatttaggataggtaaagatcctttcccaatctgttggtggtctttttgtcttattaacggtgtcttttgccttgcagaagctttggagtttcatgaggtcccatttgtcaattctcgatcttacagcacaagccattgctgttctgttcaggaatttttcccctgtacccatatcttcaaggcttttccccactttctcctctataagtttcagtgtctctggttttatgtgaagttccttgatccacttagatttgaccttagtacaaggagataggtatggatagattcacattcttctacatgataacaaccagttgtgccagcaccaattgttgaaaatgctgtctttcttccactggatgattttagctcccttgtcgaagatcaagtgaccatagctgtgtgggttcatttctgggtcttcaattctattccattggtctacttgtctgtcagtataccagtaccatgcagtttttatcacaattgctctgtagtaaaactttaggtcaggcatggtgattccacctcaacttatatttctctgttgactaaggactttgaacatttctttgatatgtgcttctctgccattcaagattcctctgctgtgaattctccatttaactctataccccaggtttgatttggttgtttggtgaatggaaacctgaaaccttgcagagtgtgatgtggggggaccctctagcaagtaccagagactttagagatgagagactctcaggactcaaagggaaggaccttggatgaaatgctctacagtggggagagggaacctttagagttcacctccagcagaaagataggggcatcaagtggctaggttgggtggctatccaactgtcaagaagtctgacccagaattgttcctttctgaaagaattgcagggacagaaatggagaggagccttagggaaaggaggtccagtgacaggccaaacttgggatccatctaaaggcctggcactattactgatgctatggtgtgcttacaggcaggagcctagcatcgctatactcagtgaggccctacaatcagctgactaagacagatgtagatacttatacccaaccaatggactgatgtcggggaccctgtggttgaattagggaaaagctggaagaagctgaggagggcgaccacaaaagaagagcagcagtctcaacttttctggacccttgagatcttccagacactgagatatcaaccaggcagcatacatgaactggtctgagacctctgacacacacacacacacacacacacacacacacacacacacacatatatatatgtatatacacatatatacacacatacacatcctagcattcctcatataaacttgaatgagtgttatatgcacattagtaagtgcaaaacaaagcatctgaaaaggctagataatgcatgagtctgactatatgacactagaataaaagcaaatctatagagatagaataaagtttagtagttgccagaggttaatattctaatagaaagctcaagagaaaaatcacagtgtattttgatataatgaaatcattctgtatgataaataaaataatagatctaagatattatgcattttaatacttgtggaggtataattcaaagtttgacttctagtataaactaagtaatttgatgaataataatttataagtattgatatgcttgttaataatatactaaagtaatttaggatactaataaaaaggttagttgtgtagggagagtggaggtactgtatagcaaaaaatttttgcttatcttttctacaaacctaaaggtgcagattgtcttaatgttttaaattgagatagaattgcatcactatcccccatctatttgtgtgtatgtatgtgtatgttagagaacataaattcaaccttcttagtctgtttttattgttaatacatatatatgtttcaatgaatgactactctgcattgaacagccaataaggggattcaccactgggagaagcaaaaaattccttaataaaatgagatttcatctcttttaaaatttgttgtgttgttctgtgttattctgagttagagatacagttattctaaccggtcatccatgtgaggtgatgctatggtgagttacaactctagataaatataaatagtactgtagggctagactgaagaattagaaattcagtgaccaaactaattttgtgtgtgttattctagtgtagaaattaatcattagaaatttacaaattgaagttaaggggtaactgaaatggcttaagaagaagagccaaagacactgggaattgttactgaagggagtgctgtctgttatcactatagaaatgaaaagattcgataaaaatcagtaaacaaattgatgtcagatttagatggacaattggcgtataactgaagtttgtacccttcatggttaggaagaggtggtagacgcattcatattagaatgttagcagttactagaatactaaggtacagccgaaataatgctgataatagcttgcattaggtccttgtagttcagaggaatgagaagacaaaaccctaatgattattttttaaactcagatttatcttcatcaccatgatgttaaaagtctatatacatatctagcatgtgaattcaataaaccacattgatatcatgttttatactgttgatgggttttaatttaatgtttccagctttagcaaaggggtgacttaagtaattcaatatttgtatatgctttccatgtgtagctgatgttgtgatcacttttaaactggcatccaatgtaaatattagcttagagtctggggaattttagccaattggcaattaggtactgcaggttaggatctaaaatgtgactctttttttttctttttttttttctttccattttttattaggtatttagctcatttacatttccaatgctataccaaaagtcccccatacccacccacccccactcccctacccgcccactccccctttttggccctggcattcccctgttctggggcatataaagtttgtgtgtccaatgggcctctctttccagtgatggccgactaggccatcttttgatacatatgcagctagagtcaagagctccggggtactggttagttcataatgttgatccacctatagggttgcagatccctttagctccttgggtactttctctagctcctccattgggagccctgtgatccatccattagctgactgtgggcatccacttctgtgtttgctaggccccggcatagtctcacaagagacagcttaagtttttcatggttatttgaaatatttggtgaattatattttaaaactaccaatgaactggtaaattctgtttgtagtttgcatttagtttgcgtgtcaattggattttaagtaagcatatttcttgatgtggccatatgttgtctgggtgatgttgaatatcatttgaaaatgagaatatatcattacacaattaagggaaatataaattacactaaaacatattaaaggttttgagagtaaaaagagacatggatagcaacttttaatacacagtttaatttttaagtaaaatattgtgaatataaacaacaatcatagtttaaaattattttgaatttgtgaagagaaccatgtaaggttatcaatgcttattatatggaataagaggtaaatatttttaggactaatgtgaatcttaataataatcatatgttactattctgtcatatgaagtgcatgattagtaagttatataaatgcataaaaatgcaagtaatttggtaagactgacaagaaatttctactttgagagtttccacatatatgagagatcatgtgatctctgtgtgtttagtttatttcacttagaacagtactcttagaattttaagtatttgagatgaatatgtgcgtgtttgttagccacattcaatccatcattataatgtcactttgtacccataattatacaaatatgtttatatatcaattcataattaattcagaaggaatttcagaaacaataacttccaatagattgttgtagattgtatacaaatatattaggaaaacttgtccattgaaattaagacatatttttgctattcctttgagaaaaaactaaatgcaatatagtggaagtcaatgttgttattctttgctagtaataacttaaaagagaaatctttgatagctagtacattgatgtcataaattgtttctaaaatgtacttaaatgttgaatgctataatatggatagggacttttatttaacacatagtcataaagagcataaaacattccctttcttgactttgatgcattatttaaatgtctaggcttcttttaacccttgggcaactctcatgactgcatttcatagctgtccaccccatagacattaaggacaagtgtatttattacttaggaagttttaaaacttcaatggtcacttaaatgttgcaagagcctacaatctggacttatattttattatcttttgttctcattgtacttctcaacagctttaaattaaccatcacaattgaattcagaaggcacacctcaaatgaatccactttttccgttcaacctctaagttgtatttcattttaaattttatgtcaaacatacacattcacagagtgggagacaagtgctacctatatcatatgattgagtgatagtattacttctattaatggtttgataaattggacatcagtgtctgctgaaaacactcctaaaacactctgaaagtatgtcagagaggaaaatagactactttttgttattgttggtaggatcaatatgagtcctgtccatagtatttgcatagcccattgtaaatcgtataaagtaggtaatgctgttttagaacatgtttaaaaacattgttttacagcactgtccaaaatgcccacaatactgtaggagaaaaattcaaaattcattttaaaataataatgtttacatggttaatctaacttcatcttgcatctcttcaaagatacttctaaattctgacaacttaataagtagtaattattaagtagacaattattttagtttgcagcatatttcctaataacatgtctgtgactatcacaagtggaatgcataacagtttagagttatgccttaggatatctaaaacacttgaaaattatttcaacttgtaaaaaaaagtattgaattcctggtaatataaacaacattgacatttgctactataattgaaagcaggttaggactttaacatgacacttattctctattaacaaagatataaagttggagttgtaagcattccttttattgacatattttctttaatagtttgaaacttaggcaatttgtattctgcctgactgactcacctattaacatctgttaaaggaagtgacatgccagaaactatgtgaatatcaaaagattctattgatattactgatggtccaaaatgttactattgtgcaataaaacaatttttaaatgctataataatgaacaaggatgctttagaaaatcttcctcatgctattatgtaaatattttaatgtgcactgtctcttttaggtctggatctcccatttatgatgatgcctcatcccctacttccagtcagcttacctcctgcatcagttgccatggcaatgaatcagatgaatcatctcaatactattgccaacatggctgctgcagcccagattcacagtccactctccagagctggtgcctctgttataaaggtaggaatcactattttgaagaagatgagggtattgattgtgtacaaattttgataaatatcagcagtaccactaaatcttcagtaataacacatagatcattgactctattattatgcagtgtttttgagtctggtttctgactaggcctgctgggttttgttattgttcaggtttgttgtctttttactgccacagatctctcttttactcaaatcttgtatcttaaaatcaagtgcactgtatataagatatgcagccaaactaatcacagggaggactgtaatgtaaaacacattcccatttgtggaatgagatgatgcaacattgtacatctttttgaaatttaagtgaaaattgtaaggtaatctttactgtccaatatttatactcaaacaggctttggtcccagttctagtttgccaccaattgattaaatggcctgaaaaatgatatgtccctctcttgaatacatttcttcacttgtaaaatgaaaatcacagtaattctctattctacttgactgactagagataatatatgaacaaaatatctgttaaatccagtagagcatagctaggaaatgggtcagtcattgaagcactattaccaaaccatgaaggcctgagttcagattgccaacataaaaagctagcaattgtcatgcagttcagtagctctagcattgacaggatagacctagccagatacatgtccattcattctagcatgtcaaactaggagaagaccttttctgatatcaggaaatgcattacagttgatggactttaactggaaatgtgatcgtttttatacagtctcatatttttcagtgttcatgtaaaaaatattctacttttaaaaatattttcacacagatttaactaagaattacagtcgcctttgtgaacaagttgtccaaagatatttcttaaatcatggactaggctccatggtttagagcacttgtaatatttgcagaggtgcagaggacctgggttgagtgccctgtacccacagtcaggttcataccacctttgtgatcttggcagtggtggcgtatgcctttaatcccggcatttgggaggcagaggcaggtggatttctgagttcaaggtcacatttcttcatttacatttgtaggataacttttgttaaataaacagaatatatttaaataaatgttattcattgttttacagaacttctgaattaaactcattatttcttcaaaactatataatcaaaaattttagtacttttatacagaaataaatgttctaattatggtttactattacaaatttactttatattaggcaaaaatctcagtagcttatttcatacaaacctcctgtttattgactaatataattgatctttgaaaatctattcttttctcatatattacaccctgacccaagtttccctaccttctctctttccaggccctctcccctactgcctctcttctatcccagatccccttctcagttttccttcagaaaaagggcatatatcaaacaactatcaaccaaacatggcataaaaagttgcaataagattaagtgcatcccctcatcttaaggctggacaaggcaacccagtaggaggaaaaatttccccaaagcaggcaaagtactcaagaaacagcctccgctaccaatattaggagtctcaccaaaacaccaagctgcattccaaacccatacaggctcatgactcttggtttaatctctgtgagttctgcctgattagcgtcttctgtggcatctgctcttgtcatgtccttgacccctctggctactaaaatccttcttccccttcttccacagaatcaatttaaaacatagatagatatcaaaatttcatatacaaaataagggagtaggacaagttacaaaaatgcaatatgctcaatttttctaaaattcataaaatgtttgccaaataaaatactcaaagtttattaccaagtctatgcttataattttactagaatttttctttgtctctgattttgaaatttcttaaaataaatttgtctatgtgttgaataaaaagtaatgagaaagtaagctatgaatttgatagtaatgagggtatataggatcaccggggagggtgacaggggagggagcaataatgattatattataatctctaaaagagaacattgaaacttatgggatgcagacaattgtggctgagtcttcctagagtatatgtattactttctttattattatttttattaggtattttcttcatttacatttccaatgctatatcaaaattcccccatacccccccccactcccctacccacccactcccacttcttggccctggcattcccctgtactgaggcaagaccatttcccctgtattgtttgaaagaccaatgagcctctctttccattgatggccgactaggccctcttctgatacatatgcagctagaaacaggagctcgggaggggggggggtactggttagttcatattgttgttccacctatagggttgcagatccctttagctccttgggtactttctctagctcctccattgggggcccagtggtccatccaatagctgactgtgagcctccacttctgtgtttgctaggccctagcatagcctcacaagagacagctatatcagggtcctttcagcaaaatcttgctagtgtatgcaatggtgtcagcgtttgaaggctgattatgggatggatccccgggtatggcagtctctaaatgatctatccttgctgagatgaaaggatgtattactttcatatttttcactgtatatttggttatttgaatgcttaaagaatcagatggacataccatttagtgtatttatatgaatttccaacaagcttagtcaaattatgttgactattacatacaaatcaaaaggctcagattactgttggtaatttacaagttcagttttcaagctctctcatttgagccattatccaatactgtgcctggaaattagctctcaacactgccagtgccaccatcaccagcagcagtagcagcagaataaaacaacaataaaccaaaagaacaatttcaccgcaatatagatctagatttaagtcgatttcagtaacacacaagtattctcaccaacactgattccatgcccctacaagtacaataagtaaaatataaaataaaaaaaaaataacattgaccctggaggtaggcttcaacagaacacatttatattaaagccctccaaataatatgaaaacttttgcaaacacctctatgtcacattcctggatgttaattaagctaaacaaaaacaaattttccaatctatttacttatttatttgttttcaatgtatcaggaaaacataacaaactaaaagtttggaaaattatcgaaaaagtaataaggagtttgattatcaatgtaattatacctgtgctttaatacagaatgacctcaaaattaaagatagctggacagaattagatttgaaccattttcttcaaattacataaatattttcaccacagttttaaaatgttcttttcctccccaaaaagggattagatagatttttgaggtcttagacatattagaaaaatatatatatattgtttttgatagatttctttatttacatggatgactttttcttcttctttcttcctcttcctcttcctcttcctcttcctcttcctcttcctcttcctcctcctcctcctcctcctcctcctcctcctcctcctcctcctcctcctcctcctcctcctcctcttcttcttcttcttcttcttcttcttcttcttcttcttcttcttcttcttcttcttcttcttcttcttcttttcttcttcttttcttcttcttttcttcttctatttacattcccctccttgtcaatttcctacacaatgcttttcccattcaccctccccttctcctgtgagcaggtagaggtttctagggcattcccccattctagtacttcaagtctcagcttgcttcctctcccactgaggccagacaagtcagcccagctggaagaaaatattcctcagacaggcaacagcttttaatataggcctgctttagttgtttgggacccacatgaagaccaagatgcacatctgctacatgtgtgcagggaggcttaggtgcagcccatgtatgtgctttggttgatggttcaaaactctgaaagccccaaaggtccaggttagttgactctattggtcttcttgtggatttcttatttcctttgggtcccacaatccttcctcctattcttctgtaagagtctccaagctccatccactgtttggctgtacgtgtagtacttacttttttaaaataatttttagctacatagaataatcctactgtaactcagatacttgcaatagtaggtacttgctacatgttattatttcaattttaatcaattaagcaagatgaattccatgatttcttggttgtaattagtcacatttcaattattcaataacaacatgttatgtgtggctaatacattgggcaataaaaacaagtaagatttctttttttaatatttttattaggtattttcctcatttacatttccaatgctatgccaaaagtcccccataccctcccccacactcccctacccacccactcccactttttggccctgccattcccctgtacttgggcatataaagtttgcaagtccaatgggcctctcttccaagtgatggccgactaggccatcttttgatacatatgctactagagccaagagctccggggtactgattatttcaaaatgtttttccacctatagggttgcagatccctttagctccttgggtactttctctagctcctccattgggggccctgtgatccatccaatagctgactgtgagcatccacttctgtgtttgctaggccccagcatagtcccacaaaagacagctatatcagggtcctttcagcaaaatcttgctagtgtatgcaatggtgtcagcgtttggaagctgattatgggatggatccccagatatggcagtctttagatggtccatcctttagtcacagctgcaaactttgtctctgtaactccttccatgggtgttttgttacaaattctaagaaggggcaaagtgtccacactttggtcttcattcttcttgagtttcatgtgtttagcaaattgtatcttatatcttgggtatcctaagtttctgggctaatatcaaagtatcagtgagaacatatagtgtgagttcctttgtgattgggttacctcactcaggatgatgccctccaggtccatccatttgcctaggaatttcacaaattcattctttttaatagcttaatagtactccattgtgtaaacggaccacattttctgtatccattcctcggttgaggggcatctggggtctttccagcttctggctattataaataaggctgctatgaacatagtggagcatgtgtccttcttacctgttggaacatcttctggatatatgcccagcagttgtattgcgggatcctccagtagtactatgtccaattttctgaggaactgccagactgatttccagagtggttttacaagcttgcaatcccaccaacaatggaggagtgttcctctttctccatttttttctttttttctttttttattaggtatttatttcatttacatttccagtgctatcctaaaagtcccccacctgctcccccacccactcccctacccacccactcccacttcttggccctggcattcccctgtactgaggcagataaagtttgcacaaccaaacatatggttaaaaaaagtacatatcaacctgtgtatttcaattagccttgttgtttttaagaaaagagtcattgttatgtattactattatttttgtttttgtaaatttgaatgtagagtaaacaaaaatttaatgatttagaaaaaaatttaatgtgttcaaatgagtacatttttccttgttttgttatagttcttgagaacctgtgaacaaatgactattcattaaatatagggaccctgttacccagcaaagaaatacttcctcacaagtctctgttaatgaaccattacatttattggagttacttccaagagtattggtggggttagttaggtaactcagcatggttgaagaatcacagatgccccattcctagtgttccctgcatactttgcatacagttcagttgactggatggtcttttccttgcaatttcattacttatgcaaccttagggagaggacttattaagcttataggattcaggagcttcctggacattgtaggttttacttcctgagtttttgtttgtttgtttgtttgtttttataagcccctatctctaggtgggatatttcaatttggggaaaataaccacacaacatccttctcctttgtctggattcttaaattcttcctttcctctcttttgtggtgtttaatgagcctcagatggggttatataggtgtctgatgattttcttccatcaagctattatgtcactgaaacagtcattttttttttccttaggagtataactagatatgagtctctgttatgtcccacaactcactgaagaaagtaattgttccccatacctgactgaagctgacagcaatagtagtttttggacataaatgcaaatatctagaattaaatttgacagacagacagcttgcatttagtagcagttattttccactgggatctatgactaccctactcacaagcctttgctttgccttacagtagcactagattagagttgtgccctgttaggggattatgaatccaactggaatggtattggctaaatttatgaatgtcctaccagtattataacaacaggcacatattgtctagcattttaacagcatatcacatggagtttccattagaactattgagaataattctacaacaatatcatggaagaaatatccttgtagtttgtaaggtagccagcagtgaggaagcttaatatacctatgtcctgcattcaaaggatgtttcatttgagcagtagacatttatatcctaatactggtatgagtccaacaacagtgataatagtgtcaactctttccttggccaataagtttattttaatttgtcttttaagtgtcttagaatttcatttggatatagtttgtgtgtgtcatatctgtcttccatttctccaactccttcaagactcactcaaccatgtactcttccaattacatgccctcttttgttgaaaataaataaatctttggaatatgattaattctttgtataattgaatgaataggatcatctactagagcaggaacaaactagcagagacacatcactaaagaaaattgactctcctttcctcagcagccatagttcccaacatctaggcattggagcttcaagagattttcctgtctttatgatggcattttgataggctctgttttatgaagacaaagactgctgcttcattcccataaggcagcagtcctatcatttccagaagatacagttattcagcattcttctccaacttatggtcctttcagtctttctgccccaacttccatgatgattccttagttttgggggatattgtttatacaatataagtcccattttggctgagcactccaaagacccatattttctgttctttaagcagttgtgagtcattaacctccctctactccaagaagcttgtctgctgaggagcaagagctataccaatttataaatgtaaagataaatgttcagagaagaatctagtactatatccattgagcaaaatagagttattcttaagaatccatccctcatttagtctaaccgctctgtaggttctggaagtgtgttttcccacccttacagaatacattactttaaatacttcagcttcttatctgttctgccagatgctttttcatatctcttacacactcaatgttttactttccatgcaatgaagcttttcacaggaagtatgggcaagccttaagaagagtaaccacctttcagtccaagctagctctacttaataccagggttcagcaagtaaggagacactaaataaacatatcagcatggtctaatacagcatgaaaagattccatgacttatatgaattgctcattaaaagaacaatattaagtatagcagtatgaatggcaggtcttatcatattaagctctctatgatctgtaatcattttttatgagcaatccagcttctttatcctggggtgctacctggggcctcttttatatgcctatgtccaatcatgatgggttcagtggggactgctcaagctgcttagcttggcacaaggcctagaggcaatgaaccaattctcttgcctgctgtggatgtcagtctgaagaaatcttgggtatgacagtgtggtactttgaagtggctcatactgaaacctttctcttacatacaatttctaagagtttcacatgctgaatgaaaaattccagtatacctttctaaagaaaagaaatgaacaaaattttctgaatgcatatgacttatgtgggacaagattctttttttaattttgcacttttctatcatttatcccatttatgaactgctatgtagaaaaaaatcttattgaagtttaatatcacagcttttttctttctgtaatcatttccctaattccaaatcaacaaaagtcatgacatacttactttcaaaagatccagaaaaaaaactcttgtttagatttcaagtttactttcttttttcagattgcctagcacaatataaatccaaatttcatgtaaaactaagtcacacagatttaccaaatggtctcctacctaataatgatcattacctaccattgggatcaagaacaacactaatcacccagtagtccatagaatcctgttcaattaaattatttctttttaaactttttattgattctttgctgagtttcacataatgtacctcagtcctgctaatctccccactccttcatatcagcccttagctcctgcaataccctccccaaataaaacttataagcaaacaaataacaaaaaacaaaacatagacaatatctcactgtagaagctgtagtatgtcacagtatgcccctttgtccacatatctttactttcaaatgttcatttcaatgagtcgttagtttggtttgacttctttggcttctttgacatcatccatattgaatcctcattgggacttctctaggctattctgttgttgtcccatgtcatggagatcctgcagctttggaacatcaggattggtcctttcacaagttccaatgattttcataggatatagacccaattcagagtcctggatctgtgcctgggtgatagttgaggtagtcagcctgcctgtttttcctcatctgtatcaccatgatgtgctcttcagctctgttactgctaggccacccaaagctgccaatgataggagtcaaggtcagcactcctgctctcatacctcagggacagctcactttgactgtgctgccaagtccaggacccactcttacaagtgttatagttctctagtacctttgccattagggacagctccattatattgcccaggtttggtgcagggtcctctccccagagtgctagagcaagtgaaggggtcagagctagtactctttctctcataaatccagggtcagcactcctggctaccgcaggcagcaagagagggagagggaggcatcacccctgtacccacatcacctcagataagtgggggtggctagctttcccatgcatctaggccagctcaccggatctccctccatcaggatcagctttactgggatgcccaggcaagttttagggcttgtcctctctcgagtactgcaggttggtgaagcacagggccaacacaccaactcttatcactccaaggccagttctccatactgccacaagtggaggggggtgaaggggaagggcatggcctttgcacccaccccacctcctggcagatcattggtggggtcagctctcactcaccatgtcctgaggactggctgacccactaccccatgcccagggtcagcactactgtgctgcccaggcaagatgcaggacctactctcctgcatgctgcagctgcagaggggcagggccagttaccctgctttcatgttccccgggggcaaccctcccaaatgctgcaggtcttaaggagcaaggtgtgtgtagggggcatggtaggagggaaggactattatacacagtcgctggatatccatgtggtccctgaaagcagccctaaccagggacatccccatgtttttttaatggtaaaagaaccatggacatcatcattgaccgctgttgctgcatagccatgggctcagaaatgggcctcagtggcagcttgggataggacttccccatggtcctagctggcaggggtggccactcacagtgtgctattcctttccaccctcaagtctcaagttccatctctcttcatacagctcaagctgttccacttctctttccaatcttgctttagtaacttcaggagttttgtttcctataagcctcaatactccaggatggactgttttaatccatgggaaagagctacctatagcttgaaaaaatatgacacagatacaggagataaaaactgtttgcatattttcatgccatttgtgagtttagtcattatactttgcagctaattaagactaaagcatgaatagaaatggtaagacactatttgtgtagatgataatcctgttatcacccattggtaccatgttacttgagacaaataggttaatctccttgtgacatagtgtattccttttgatctagcatctagtatccaaacttgagttccctgaaaacaaaattatatgctgctcttaactattgagccatctctccagtctaagtactgcctgccacgccaaattcagagatatctacggcctctgctctctgtaggcacctgcacatatatctacacagccacaaatacacataggtgctcgtgcccgtgtgtgtgcgtgcacgcgcacacacacacacacacacacacacacacacacacacaccaatgtgaaagttgatttccaccctcccctgagagattactggcagtttcttcagtgacataatcactggaaagttgacattgttcccataaataatcaccttgtccatgcctagacaagaacctaattcaactttatgggacacacacacacacacacacacacacacacacacacacacatacacacacacacatggcttgaaattaggaaagatagaagggttttcagtgagagaggaagggtgataagaaaggaaaatgtgggtcaaaactactaaaatttattatataaatgtatgaaatgtccaactaaaaaggaacaaaaacatttatgtgagttctaatttaccttaattaattaatgaatgttttcattttgggctatttaggctttaccttggaagttaagcatctatatgccatatagcaaacactggccttccatctatccgtaacatgaataattaggaactcaaaaatatctgtattaaggttaagaatttaatgtttattaatttggagaatagtatttaatgtaaactaccagcaatacaagcttgaacttcaaaagtggaaaagataatactttgggacacatgtttgctttacctgttcttgttattttatcagaacctactttggtgatgttgctatgccaagcacatagtagattttagttctggctcagatccttttagtgtcagctcagctattagcatttgtagttaataagtaatataaccataacatgaattggaaatagcattatgatcattaggctggcaagtgttacatatcattttatgtggcaagattctgaaagaaaaaacccaggactgatacataggtatatttcatgttgagactctgatatgttgtatattattttctgcattttttcagaagctttgaaatgcctttgtgccatagttttctctgataaatctaaggattttaagttggaaacagttatctggctgtttaccaatatcatctgcttagctatgtttcttgtttggctgagcagctggcaattaatgaattgataggaaatggtcacaaggcagtggcattagcatgtgaacatctggtattaaaattagtcagcacagggtttttgatgattgtttgaatttactgaaaatcactacttaaatcttcctctaagtgttctatagcaaaacaaagctattactatcttttaggacatgagagggaaatacactggatctaaatggtgggttgtttgtctttgtttgtttatttgtttgggtggatggcagagttccaagtccacaacataatttagacgctgtgcagattccactgaatatacattctgccacttgagtccatttacatgctatgaacagatattgcagctgattcccttaatctgtcatcctcttccatgataagttgttcacactggagaggtgagagggtcctttatctaaacatcacataggttacacatttagactatgcataacattttacctttttttgtaattgtatgttccagctgcaccccaaatctggcataatttctaatgtgccatattatgttgtcttttccaatgaataacatatggaattgtatataaccaaatgatggaggtttctaattcaaacacattagtactatctaagtactccataaaatgattaatttgatcctaacaaagtaaagatcacaaaattttactgttaaatcctgtaaaattgaatcttctaagtagtcctccttctttgtctgaagaatcaatataatttcaactttttagtatgatatacttctcgtttgaccatttgtgatgcacctctaaatgaaaggaaatagtatggtatttctcatagtgatgcattcactttttgttctttctttctttttttaacttatctacccactcaccccctcatgcaatccttcctctctcccctgctgtccttttcctttgatccccatgggtaacctgcacccaccctggcacttcaagtctctgtgaggctaggcacttcctttcccagaaaaggcagtccagctggaagaacatgtcccacagacaggcaaaaggttttgggacagccccaactccagtttttctagatccacatgaagaccaagctgcacacctgctacatatgtgtttggtggtctaggtccagcccttttatgttctttggttgatggttcagactctaagaggtacaagggtccaggttagcttacaatgttgggtttcctgtgtagttctatcccctttgggacatgaaattcttcctcctattcttccataacagtcccagagccccatccactgtttgactgtgggtgtctgcatctgtctgagtcagctgctgggtggatcctttcagaagacagacatgccagactcctgtctgtaagcataacagagtatcaatatagtgttaaggatttgtgcttgcccatgggataggtatcaatttgggtgggttattggttagccattcctcaatctctattccaatcccctagtgcctgcatttcttgtaaacaagaaaagtttggagggaaagttttgtgcatagattggtgtctctatcactccactggggttcttgcctggctacaggaagtggcctcctcaggttccatatccccaatattatgagtcacagccaacttcattcacattgattctttggcacttctctaatcctaggtctctgtctagtcctggacatgccccacctcttcactcccataaattgcagatttcctttaattttaatggccatgtagctatcgctcctgtccttgccacacctgatcctagacacccaaattcctctccccataccacctctctccgtgcccgtcctccatctgcatttttatgactattttattccctcttctgagatccaaccgtcctaccttttgccttccatctcctttacctttttgggtctgtagagtatagcattgggtattctgcattttatggataatatccacttataaatgaatacattccatgcatgtccttttgggaatgagttacctcactcaggatgatattctcaagttccatctatttgcctgcaaaattcatgatgtctttgttttaaagagctgaatagaattccattgtatagatgtaccacattttctttatccattccttagctgggggacatctaagttgttcccagttctgtgttattatgaataaagctgctatgaacgtactggagcaaatgtctttgtgggatattggagcatcttttgggtatatgcccaggagcgtatagctgagtcctgaggtaggagtattgccagttttctgagaaactgccaaattcatttccatccttttatttttattcataaaactgtataattacatgttagaaatgcaggtatagttaaagataattttactaattgtagaaaaataagaatttaatgatgtgctaatgtgctgattccataaattcttctttgctgttttgaatctggaaaactatgaaatgctttgcaggagctacagctatttttgatggattatgaatgaaacacatgaagaggaaaagggttgtaaaagtcataaatgacatataaaatgaaatcatcaatgagtaaaaatgattggggttttataaaatgaaatcatcaatgagtaaaaatgattggggttttataatttacaattttccttttaaatgcccttattgatttgttacaaatactgttaaccctgtatttggcaaatggtgaggacactatcacttgcattctcatttgtaacacaacagattaacttgctgtgaaattttaagtagactgagacacaacagtaaccacctaatgaaccagagcacattgcagttaagtatctaaatagatgcatactgattacagggctgaaaaatggttgtgtttacttgcaaagaagaaattgttcatagaactatcattatttggggaaaaattaaccttctaatatcataaaagcagtgtttttgaaacactcctaactgtaaattgatatatgacattgaatttctctaaggtgatttgcaatacaaatataaaaagcagaagaaaaacataacaaaaccaagcaaagcaaaacaaaagaactcctgcaactttcagaatacctttgaaattttcttactacttttttataaattttactaattttgatctttaacaaatttatatatttgtatagtgcattctgatttttctcaggcagtcccttcttatctgtgtcccatgttgttaagccccctcctgtctaattgtccctctcatacatttgtgtagttttgtgagccactgaatgatcacaacaaccacctgtgtagttatgagtttagaactatccaatggacatagtgaggaatgttggaatagtgaatactttggtcagctagccttgggcacaacatagcaacactgaagtagtaccatcatgggtctactatgatggtaattgagatattgacttttttttttggttaaagtaagtgcaaggacatggcacaaactttgacctgctacaaagtgaaagggtaaatgaaagactgatagcattatataggtttcatgatgtcagtatccaccatggagtatgtcattgcagtgatggggtaaggcaacagtttgaaggtcacctacattcctgtgagtaacccctcccccactttctgtaagacagctccaaaatttcatttgtttagtacactggaatttggaggaaactccccaccttgtttttgtctcctgtgccttaactttagtgagtccctgtttgtatattactgggaaaagctaaagcaaaaaattgtcaagtatggtgtgtggaataagcaaaagtagacttggaaggaatgattgtgtgtcccttgcatggatggcaaaagcatgcaattgaggctgtactgtctgaggtagatatatttttggaggcaatcataatgtgatagttatatatggtatatcatagtgcatcttcttgctacagtgggtcttgctctgggccttaagacatgtaactaagattgtgttatcatgaggtggagtatctcagggtgaccatcttctttcatgtggtatgaagtagaattcctacttgatgactttttcttccatgtgaatatgagcatatcctcaaaatagttgaattatagtatataccattgaagtctctgagaatatctcaaacatgaaaagattgtcagcaagtaatctcagaagttacatggctattgttatatgtaatgagcctttcaatattgaatcagagttgactgcccagttgaaacctgcttgtgtttcagaagaattacagagcaggaatgctagcatccaccacttattctctgatttggcaggtaaattgtagaacagagagaataagattggaggggctggcttgccatttattatatgtaatgattctacgtggaaagggaactcaaatatatgctcaatgataatgatcccatgctgagctaccaaaacctggaacctattgcaagagtaagagagtgaagggaaaggaaaggcagtggaagtgatagaagatactgctaagtgtatctttcctctgatacaaaggaaagaaaacatgtctcgggatagagacaagccttaataatgcactgacaaaagataaaattgatacaggtaatggatgtaatattttagttctgttatttttattatcatttaatttagtattcccttagtttttgacacctgagatcattatgtgttccaagaaagggccagtagatctcaggatcaacacgtttcaaacaattaaaaaggaaacaaacaaatggaaaagaagcttcaccaactttcatctgagttaggattagtgtctagaatattacaaacaaacgaaaaatatagacattaaggaaacaacaataatcaaagtgaaaacaaagtgagctgtggaacttaagagttattaagagaagtacaagtggctagaaatcacctaaaaatgatcagtatcactagccatcagatcaatgtatattaaagctacatttagataccatgtcactccagtgaggatgaccatcatcaagtatacaagtaacaacataaactactgttgatgatgtgaaggaagaacacttatatactgttagtgagaataaaaaaataacttagccactctggaaaccatctagaagtctctctgaaaaactaaaatagatctactatattacccaggtattctgctcctgggcatatattcagaggactcaatactctaccccagagacacttgcacatctagtccaatactaatctcttcagaatagcttggaaaggacttcagcttgggtctccatcaatgagtgaacagataaggcaaaagtaatacatatacagagtggaatattagtttccacacaaagaaaaataaataaaaaaatttggagggaaatgtatagaaatttgaaagaacattatactgaatgagattacacattaccttaaaaacatatctcatgttctctcccatgtgtggatcctatcctcaatgttttctgtgtataatgtttgggtaaatggatgccaggaacctagaatagagctataggagagacatacattaaaggagaaggggcagtagatcattggatttgtgatgatttctattgtattcatcctttaaagtaggctttccaaatttgttaactgtttcacatacttcacataataaagcaaacaagaattgggaaaataaattattcaagtgcaagttttcttatcaaatgatattttttaatatgtcaggcacattgctttttatagtattatatattttctcactatttatattatttgtgtggatgttcctccaatcttcctttattcattatgagtcataattttttacaacgtagtggaaaatgttaataccattgtcagttgttctgttttttcccaaataaacaatatcaattactaaaaacaatccacttatattatcgtaggatataagggtgtgtgtgcttgtgtatgcctctgtgtgtgattccttgtgacactgatgtttctctttcagttaaaattttcctagcaactactgtattttctttttattcattcacttataattccattgacagatataagtaattaaattaatatttttaccaaattttcagtattagagttcaaagacaattatggaattcttttgcattttatgtatatattctgccctaagcccattgatattatattataataaaaccaaaaatggtctcacatttggaatcattgctattattaaatttgtttgttgtttatgtgtatggatgttttccccacatgtatgtctatgtataatgtgtgtgtttgctgttcagggagacagaaagaagttgtcaaactccatgggtctggagttatagatagtagtgaactgcaatttgggtgtgggggtaattgaacttatatcctctgaaggagtagcctgtgcccccaactgaaaataattccatacatgaggatgtatggaattattttatgtttctgatattcttctcagtttctgagatatatgtttgtgtgcataggtgtgtgttcatgcatacttactctgtggaaaaaaaatttcaaagatgaccaatcaagttggatttttgacttataaacttccagtcttgaaagggtttgtggtttaaagcctctatatagatctttctgaattttctcatacatccctccgaactacaaaaaagaggctgttttgtaaattttctatctgctttgctttatacatttctttagattgtgtcttatgtgcactgataaaactacaaattttgctgtatattacacaccttagaattttattgttttaagatttggaaataacagtgaaggattaaaaatgtactttctatttacaatttcctattttagtaaaaatattatagctgatatactaagtatctactgctcagttctgtaaacttatttagtgatacctaaaggctgttataactcaaaatgtaactttaaaatcaacatggtaccatgtaagtcaattagaatttgtcctgctttgcattttatccccttgggaaacaccctaagcaaaggcaacttgggaggggtgacatttctttttaaccattaatcaagaaaatgcccctcagatgtgctgacaagctaatttaatatgtgtaatttcacaattgtttctcagtttgtgtcaaatggacaaaaacctaaccagcacatgttcccaatattgctataaccaactatcacaattttagtgacttcagacaatgcaaatttgtcatgttatattttgtaggtcaaaaacaagaaagaagtttaatgtgaccaaaattaaggtgctagcaagcccatggtcctttttctaggtccaaaagtgaatatgtttctttgtatttttcagcgtctacaagccattttgcttcttgattcatggcctgttttacctccaatgccaacaatattgcacttttttttaatctttaaaatttttagaaaacctcgtgataaaataggcctcactgaaaataatatgataagcctaacgtaatattttctttttttttttttttttttttttttttttttttccgactaggccatcttttttttttttttttttttttttctttttttttttttttccattttttattaggtatttcgctcatttacatttgcaatgctataccaaaagtcccccatagccacccaccccctctcccctacccacccactccccttttatggccctggcgttcccctgtactggggcatataaagtttgcgtgtccaatgggcctctctttccagtgatggccgactaggccatcttttgatgcatatgcagctagagtcaagagctccggggtactggttagttcataatgttgttccacctatagggttgcagatccctttagcttctttggtactttctctagctccttcattgggggccatgtgatccatccaatagccgactgtgagcatccacttctatgtttgctaggcccaggcatactctgacaagagacagctatatcagggtcctttcagcataatcttgctagtgtatgcaatggtgtcagcatttggaagctgattatgggatggatccccggatatggtagtgtctacatggtccatccttttatctcaactccaaactttgtctctgtaactccttccaagggtgttttgctcccacttctaaggaggggcatagtgttcacacttcagtcttcatttttcttgagtttcatgtgtttaggaaattgtatcttatatcttgggtatcttaggttttgggctaatatccacttatcagtgagtacatattgtgtgagttcctttgtgaatgtgttacctcactcaggatgatgccctccaggtccatccatttggccaggaatttcataaattcattctttttaatagctgagtagtactccattgtgtagatgtaccacatcttctgtatccattcctctgttgaggggcatctgggttccttccagcttctggctattataaataaggctgctatgaacatagtggagcatgtgtccttcttaccagttggggcatcttctggatatatgcccaggagaggtattgctggatcctccggtagtactatatccagttttctgaggaaccgccagactgatctccagagtggttgtacaagcctgcaatcccaccaacaatggaggagtgttcctctttctccacatccacgccagcatctgctgtcacctggatttttgatcttagccattctgactggtgtgaggtggaatctcagggttgttttgatttgcatttccctgatgattaaggatgttgagcattttttcaggtgcttctctgccattcggtattcctcaggtgagaattctttgttcagttctgagccccattttttaatggggtgatttgattttctgaagtccaccttcttgagttctttatatatgttggatattagtcccctatctgatttaggataggtaaagatcctttcccaatctgttggtggtctttttgtcctattgacggtgtcttttgccttgcagaaactttggagtttcattaggtcccatttgtcaattctcgatcttacagagcaagccattgctgttctgttcaggaatctttcccctgtacccatatcttcaaggcttttccccactttctcctctataagtttcagtgtctctggttttatgtgaagttccttgatccacttagatttgaccttagtacaaggagataagtatggatcgattcgcattcttctacatgataacaaccagtcaatcacacctgggtagtccctttggctatgtaatttaatgtgtaatatgtattcagtttcctggcaaatgccatagaagatggacatcttttgcaggaaagtggcaacattctgcctgctgaaatgacatatattgcagaatattaacttctacaaatgaagtaataacttttaattatcatttcattattttaaattaaaatttttctttaggtgatttacaaatttggaggtcatcatgtaaaatcaatatgaaaatgtacaagcacaaacttgataaattagttcttaacattgtgaggattggattgttgatgtaattacagaaaattagatggagcatttagtgtaaggaatttattatggatgaagtaaatacttaatagaatgtttactatctctggatttatattggtgaatcatatttcttctatatgtacattaacactaaaaattagttttcacattgatcacattaacttaatattcagattagttttaaaaaattcaaaaagatattgaatagttttagtctttaatagattttacacctggatacaggaggtggcctcttcacatttccaagtctcctatgttaggcatctcaactaaggtcacctgtattgaccttttctatcctaggtctctgggagatttcccccaccaactacccacttcagctatagatttccatccattctcctgaccctctgaatctctctactgtttctcaccacagccgatcctgtcagtaaattcccatcctttcccctcccatccaatttccttctccttctgtctcctatgactattgtgttgccccttctaagtgtgattctattatcctcacttgggccttccttttgtatttctatttatacagtattttattcaaggtattttattggattttgacacatttgtaatatataaaagaaaaggcagagctgacagggtggttcagcaggtaaaagaatttaccaacaagtctgatgaccagagttcagtcctttggacctaaacagtagaaggatggaataaattctccatcagttggtacatgaccccacatatgtgcacatgcgcacacacacacacacacacacacacacacacacacacacacactaaatgaattttttaaaaaaaaattaaacaaaaaaagcacatttgatggcagaagcctaaatccaaatattgactctattccttggtctgtttccctgagtaatttttctcatctttccatccttcctgttctctgccttgtcaagtggtgaaacagtctctgttaagcactgctgagtataggatccatccttggcttctctttgtgtccacacaaatgctaggcaaggcaagcttctgctgagtcatcatttttgtgaagaattatccagttggaccttccttcttgtttaacttctttgagtctgtggggtgtatcatgggtatcctttatggctaatatccacttataagcaaatgcatagcatgcatgtcctttttggtctgagttacttcactcaggatggtattttctagttccatccatttgcctgcaaatttcatgatgtcttttttttttttaatagctgagtagtactccattgtgtaaatgaaccacattttctgtatccattcttctgttgagggacacctgggttgcttccaatttctggctattatgaataaggctgctgtgaacatagtagagtccatgtggtatggtggaacatctttggggtatgtgcccaggagcattatgattgggtcttcagttagaactatttccaattttttgagaaacctccagattgatttccagaggggttttacaaatttgcaattcaactagcaatggaggcgtgtttgtctttctccacatccttgccagcatctgctgtcacctgagttttttatcttagccattcttatttgtgtaaggtgaaatctcagggttgatttgatttgcattttcctgatgtctgaagactttgaacatttctttaagcgcttctctgccatttgacattcctctgttgagagtttctgtttagctctttggttggttgctcagtctctgtgagctctaaggggtccaggttaattgactctgttggtctatccccagtttttaatggggatattttatttcttggagtctgacttctttagttctttatatattttgtatactagccctctgttggatgtagtgaagacctttttccaatgtgtaggctgccattttgacctgttgacagtgtcttacagaagcttttcagtttcatgatgtcacatttatcaattgttgatcttagaacctaagccattggtgttttattcagaaaattgtatcatataccaatacattcaaagctatttcccactttctcttctattaaatgtagtgtaaccggttttatgttgacatccttgatccacttggacttgagttttgtgcagggtaataaatatggatatatccatattcttctacaggcagacattcagttagaccagcaccatttgttgaagatgcttttgttattccattgtatggttttggtttccttttagaaaagaggctacctcctatagccaggcaggaccctctgtggagagatcaggactccaatctgcccacaaaactttcaacctaaaatttgtcctgtctaaaagaaaatcagggacatagagggaacagaaacagaatggatgcccaaccaataactggcccaatttgaaacacatctcatgggcaagcaccagtctctgacattattaacggtaccctgttatacttacagacaggagcctagcctaagtgtcctctgaggggttctacccagcatcagactgaaacagatgcagatacccacagccaaacattggctgtaggtctaggacccttgtggaatagttgaggataaggattgaagtccctgaagaggataggaacttcacagatagaccaagagagtcaattaacgtggaccccttagagctcacagatactgagcaaccaaccaaagaacgaggccccagcacatatgaggcatacatctagctctgtctccgtggctgccttgtctggcctctgtgggaaagaatgtgcctaatctggcagagactttatataccagggtagggaggatacccacgggagagcttaccctcttagagaaggggttggggtatggggcaagtggttcagcaaggggaatactgggagggggaacagcatttgcactataaataaataaaaaattagattgtataaagatgaatcctaaaagtcatgccagatactttgaaaacataaaatatttgatctttattaagattcattatttaaaatataaaattctaagcaacaaaatactaaaggattgacaatggtagactatactgtcagtttgtataatgcaatattgcgttctatgatttttcaaaagattttgttggtagaaatcagcatatgcctgttacaaattacaatacttcaaagcatattgtttccaaatattcttgcattaacaaaaaaaaactacccatctaagaaataaaatatttgacatgttttacagggctcttatggatctgtatttgtaaattctctttaattacataataatgttactcttcagactctgcatgggtttttatcagtctagacatttgtgatattaataaccattacccacacctacatttataatcatttataacttctgtctccctgtctctgtctctctttctgactgtctgtctttctcccctacatgtacccatttcaagaccaattgtttacattgcatgactttctcaactgctgctctctatcttttttttttttttttttttttttagttagaatctctcactgaacctagagcttagtgttttagccagcctagctggtcagtgatgtctgaagatgctctggtagctgcctctttcaatgctgaggggtacatccacttctttgtgaggagtctttgaatctgacctcaggtcttatgcatacacatagcacttgaccaactaaggtatctctctttgctcccgtttatgcaattttagaaaggaaacaacataacttcaatttagccatatgcaaccttccattatttaattgtaatggcatgccatttatttctccaaaggtatcttgaagtgttccagttcacatagtttggtgtgtatactttcaggataagtgcaaggtgactatttccaatgctattgccacaaccttcatgaaaatttcagcacacatgtgaatcattttctctttcattttgtgtcaggaacggatcccagagagtccttctcctgctccctctctggaagagagtcatcgtcctgggagccagacctcctcccacccaagcagcagtgtgtccagctctccctcgcagatggatcatcattcagagagaatgggtgagtgattgccctgaagaaaataattggaagatatgtttttaggcaattccatattactcaactaagacaggaagaccctggaagaactgtcattttcttttaatataaaatgccttttgaagtaatcacggtttgtgaagcaatacaggaaacagtagaaactgtaagacttttcatacccaccaaggcctttctttaatatatttcttaatctcttgggactgataccatgagatacttattggtacactataggtcttagatgaatgtgttgctatgtaccacttactaaaagacaatatagttgtaacatgcacagcatctctgggatatttgatataacatatactttagaaaattaggcatttaaagaaaatttaaacgccaaacaacatacactatgccacaatattggaaaatgcatttctctacattttttgtctcacaagacttacctcttagaaattgtaatagagcctatatgacacctgaatttgtccatatgatcgttactttagctatctttaaatttttaggtaaaccatttaaccattattaatttcagtgtctataatatggaaatatttactttcatgcctgttgtactgaaatattgtgagatgtaaccttgactatctgtgggataaaaacatttcaggatgtcaaagtgctaaaaacattaagaaaataaatgtattttgctgtttttatttttactttgcttaacatttcattttctatgatcttactcatctatacagaaattgtcaggaacattcagctaaataaattctcagtataaaataattatgggttaattttttacttggtaaaatgttcataactcttctatttttacacaatccagtgtcctatggatatattttcttttagaaatatgatctccgctttttggccagcaatcaatgtccaggcatgttttatgtgctttagattttcactgctcatagtagtgcttattttaggctctccaaaataattgggtgttgaaggaggagaggaattcaggagattaggatctatattctcttctaaatttgtgctatgaaaagatagagataatttcttcttcatggaactttatccacatctaactttatcaccattatatattgtctgtgttcccagttttgtacatagctctcagtgattcttaaacaaagccgtacattataataacctgtggagctttttgaatacagtgtgaatttaattcacttgatctaggacatggtttgcttttcaatatcgccttggaagtccctaatgcacagtgaggttaaagacacgatgaacaacagcttgaggattctgttctttagtgaccaagtttaatttccagaaagaaatatttgacctttcctctagttgatggacagggattacctagctgttacaaacttgagtacaaataattataggaaatctgaacaagacaagaagctataactgaataaatgtaatgaatcaaaaactaaataaagcatatattattctgttgggttattgaaagaaaatatggaagctatttatttctatgtgatctatctatgcaggagagagaatcaattattgagtgctggatgaaaggtgaatgtataggaaaatatacttgtcaaatgttatggcatagactaatgggtaatatattttaacataaaataaaatatttcatacaaaatggaatatcttagaaaatcattgacaaatagtgcatatgcaattccacagacactgattttcactatatgcacattttacaactgcccaaccatgatagaaatgttatctacagttgaatagaaaggtgtaatagattttagctgtaaaaatgtggtatcttattcatggagctgtaatgtttcaataaaatataactgcagagaatgaaatgataaattgcaaattagtatgttttttttctgtaaatgtcaatgttttacaaagactcatagtaagtaccagaaaatttattctactttgaattttatataaatttaggaaagtttccacagtaagttaaaggcgaaattattttaacctaatgaatgattaactgatgaattctcttttgaaatattttgagtttattatttatatagctaaaccctaaatttcataatcattttaaggaaggaatacatacatgattcaaatagtatatattaacatattgctagtactaagtatcaatgatactacaaaattcatatgatttgtcatcttagtgattttcatgattttggccatcatagcaaatctttcttatgtaacagaagtttataaaataaatataagttgttggaatatgttagtcatttatgtacttttatgcatttctttaggtattttgcatgaaactatacccagttccctttttcatttttagttatgatgcccaacaatcgagaagagcttattgttgaccaagataatggacaaagcataaaaaaattccagagggataataaaggtaaaatgattttggcttatttgatatgtgtgtgaatattagacactaattcagtactgcagtagtgtatatcttattggtgtttatccaagtcagaatagattaatcctggctttggataaattcttttgcccatgaaaatagtttgtacagatttttgtttggtgttgtagatttgaaaccaatcttaaatttgttaatgcatgtggttaaaaattatcactctgttttcactgtgccttctcaagatttatgtaatatatatgtaacaattttaaaatatagttatatgactcactatttaaaatttacattcacagaatcagagttgttgtgatgacaattgctgctcttttatgtatttcaaacattttaaaggcatatgttaatttgagcatttaaattaaatcttaccaagaaatcaattgaatacttatttaggtactgattaaaatggcctcaaacttacttattatttgctcaagcatgtatcttaacatatatctttgtagaaaataagaagtaaagaaatttcaagtgattcttccctgaactgaaagctaagacataaaataaagaggatattttgttataagctgtgcattattgctgttacactgcattgtatagtagcttacacacacacacacacacacacacacacacacacacacacacacatacacacacacatttgataaagatctctttttactttatacaagaatacattttatatctccattaaaatgttcacattattcagactacaagattcagtgtgatgaagtgttaatggagaattgtctcttacttcttgaggctgaacttgcttcattattacctagatgagcattttaactgtaatttggaaaaatgtatgattttaatttcagtgatccatggttggtttccttgccacatgtttagtattttcatagccagatactgaaagaccataccctctgggacttcaccatgcaaatgattgattacagaatagttgtcagaatgaaacaagtctggttcagtatattagagtgcttaaacttttcgcaggtaatgaaattccagttaaaaataaaatttcattgataatccaacaatttgttcctgagaccactttttttaaaaatgccaaatctgacctctttgaatactgctggaacatgaggatataggcataatcaacttttttgataaaacaaaattgattgtatttctttgttactttggaaagatgcagtaaactcattttactcaaatagttttttgccatatactgataaagtaattgatagacagtagcaaacatgttaaactacatttaaattataatggacaggtttctttaagaaaaaaattacttcatttcaacttctgcctattctttttgtgatagtaaggtaaaaatgtattttttcaactagacttcaattactgaaaggcaataagatacagtgtaagcctcaacatttattaagtatgacaaataagcagtttatacaactggagcaaacatatgctttcacatctgctttgaataatatcatcataattttaaagatgatttatatctttgcaaactataaaatgccaacattgccattattaacaaaattctgaaaataaagaaatgctgctatttttcatatagcctaatgattcctgaactttaaaaaactataatacacattttaaataattatttgaactttgcattgaacttgaatatgtgagcatgtaaaatttatatgtactaggatttcttcacactgaagtctttcagactgattccaaaatgactcaccaaatgacagcttatttgaattaaatattccaactaaactgactagtcatttaagttgggtgtttgattttatctttctgtaaactttgccaaataaattaagcaagtcgattgtgtattataatattgtgtcacatggtcccttgggtgctgacctcattgtcttttcatctctaagacccccatattaaagaaaaccagggggattaatctaaaaataattccaaacaatttttcttcacataattagtgctttgatatagtcttaaactgttgaaaaagttggtaatatgtagtactattcacttctatttggtctatttatattgtataatgtaatgttgtaatgttcattgtttgtgaagacacatttaggtggtgacatcataaaaattctccaggttattaaaattactgaacataaagcaaaaatagaactggggttctatgtagtatagcaacattatcataacatactaataataaggctagtcacatgtagaaatagtggaaaaaatgaatgagtagtacaaaaaacatggtatgggcaaggtacaagcaatacttaacaaaggtcattgtgccagagatttacaagggaaaaactcgttttactgacccaaaagtccttagtactaaaagcagaggctagtaagctatagccacatgttgcttgcaagaataatggtggatatttgttgtatatggttgcttataacatttggctgctttcagtaaatgattctcaaaacacatatagattattttgagttaacgtaatggaagagtgcataacttaagattaaagctttaaattaatgggaggattgtttttgtgaatattttaaacattttaaattttatatattttactttttatttgtcctcttatattccatcccaactgcaattttccatccctcctctcctcccagtttctcctcccaatatcccctcatccccaaactactcctcctcaggttaccttcagaaaaggtcaggcctcccatggatagcaatcaaaaatggcatggcatgttccagtaagattaggtgtctcccctcatattaaggctggacagggaaacccagaaggagaaaaagaggtccccaaatcaggc
